United States Patent 11,180,807 (METHODS FOR DETECTING A GENETIC VARIATION IN ATTRACTIN-LIKE 1 (ATRNL1) GENE IN SUBJECT WITH PARKINSON'S DISEASE) - sequence listing, part 38

SEQ ID NO: 512 - DNA, 205259 bp, Homo sapiens
ctgaaatatggaggatgcagctgcacttgactgaccgattaaaagatttcccttgactttgagaaacgatatttaatcagaacaaaatactgtgcactaaagatggagttttcctggggaagcggccaggaatcccggcgtctgctgctcttacttcttctcctcgcagcctgggaggcagggaacggtcagctccactactcggtctccgaggaggccaaacacggcaccttcgtgggccgcatcgcgcaggacctgggactggagctggcggagctggtgccgcgcctgttccgggtggcgtccaagggccgcggaggccttctggaggtaaatctgcagaatggcattttgtttgtgaattctcggatcgaccgggaggagctgtgccggcggagcgcggagtgcagcatccacctggaggtgatcgtagacaggccgctgcaggttttccatgtggacgtggaggtgagggacattaacgataacccgccggtgttcccagcaacacaaaagaacctgtccatcgcggaatccaggccgcttgactctcggtttccactagagggcgcctcggatgcagatatcggggagaacgccctgctcacttacagactgagcccaaatgaatacttttctctggaaaaaccacctgatgacgagctggtaaaaggtcttgggcttatattacggaaatctttagacagagaagaagctccggagatttttttagtgctcacagccactgatggaggcaaacccgagttgactggcaccgttcagttactcatcacagtactggatgccaatgacaatgccccagcttttgacagaaccatttataaggtgagattactagaaaatgttcctaatggaacattggtaattaaacttaacgcctcagatttagacgaaggattgaatggggacattgtttattcattctcaaatgatatttcgccaaatgtgaaatccaagtttcacatagatccaattactggacaaattattgtaaagggatatattgactttgaagaaagcaaatcctatgaaattattgtagagggcattgataagggacagctcccactttctggccattgtagagttattgtggaagtagaagacaacaacgataatgtcccagatttggaattcaagtctttatcacttccaattagagaggacgctccactgggtacagtcatcgccctgatcagcgtgtccgacaaagacatgggtgtcaatgggctggtcacctgctccttgacgtcccacgtccccttcaagctggtgtccaccttcaagaattactactcgttggtgctggacagtgccctggaccgcgagagcgtgtcagcctatgagctggtggtgaccgcgcgagacgggggctcgccttcgctgtgggccacggccagtgtttctgtggaggtggctgatgtgaacgacaacgctccggcgttcgcgcagcccgagtacacagtgttcgtgaaggagaacaacccgccgggctgccacatcttcactgtgtctgcgtgggacgcggacgcgcaggagaacgcgctggtgtcctactcgctggtagagcggcgggtaggggagcgcgcgctgtcgagctacgtttcggtgcatgcggagagcggcaaggtgtacgcgctgcagccgctggaccacgaggagctagagctgctgcagtttcaggtgaccgctcgcgatgccggcgtgccacctctgggcagcaacgtgacgctgcaggtgttcgtgctggacgaaaacgacaacgcgccagcactgctagcgcctcgggcgggtggcactggtggcgcagtgagcgagctggtgccatggtcggtgggtgtgggccacgtggtggcaaaggtgcgcgcggtggatgctgactcgggctacaacgcgtggctttcgtacgagctgcagccggggactggtggcgcgcgcatcccgttccgcgtggggctgtacactggcgagatcagcacaacgcgtgccctggacgaaacggacgctccgcgccaccgcctactggtactggtgaaggaccacggcgagcccgcgctgacggccacggccactgtgctggtgtcacttgtggagagtggacaggcgccaaaggcctcctcacgggcgttggtgggcgctgtgggtcccgatgctgcgctggtggatgtcaacgtatacctgatcattgccatctgcgcggtgtccagccttttggtgctcacgctgctgctgtacaccgcgctgcggtgctctgcgctgcccaccgagggcgcgtgcgctccgggcaagcccacgctggtgtgctccagtgcggtggggagctggtcatactcgcagcagaggaggccgagggtgtgctctggtgagggcccacccaagaccgacctcatggccttcagccccagtttacctgactctagggacagagaagatcagctgcagacaactgaggaatcctttgcaaaggttagtgtataacatccttttgtttaattttcgtattgtttttctctatcaacttcttcgtaaatttatttctaagagtcaaatttccctgggttaaaattttacctctttttacatatccattttaactaaagtcttttggaattataggacatcagagcaatatatattgccttccttcattttatgctgcattattcaatgcatattaacagaactgtaatttctagtaaattttcactatattcaccctctttgtttttggtaataatcaacattttagaaaacattttactattatttaacctattacatataaacaaatgtgcacaggctgaaataataaagctccataaattgtatgaaagtgaaaagctccgttgcctccatcgctgaagcccctcgcatgcacctgccaaatcacttcccttatttttcctccagtgtaaccgcacatttgccttttataactgtttgttcggggcctgttttgggaacgttatctaattggacttgcacaacatgtattgtctgtgcatttgtgtgttatttgtatttatcactcattgtttatgaaattatccatgttgttatatgtagttgtagtttatttatttctgtttctagtactatttcataaatatactataccttatttattctactgttcaggaatttgcattgtgcctcaatgtctatttcaaataatgccatcataaatatattgtacatttctttgatgcccatgtacacagatttctctcaggtttttgcctaagagttgtgtttgtgggtcacagaatatgtgtgtatctttgtcttttgtagctaacaccaaccaattttccaagatgtttttacctgtttacattcctagtagtgcataaggctttctgctgggccacatcatctctacatttgtcaggttattttcatgttagccattttactgggtgacttttgtaatctcattttgaaattattttatatttaaatgaagttgagtacctttctattttattttggcaatttttataccttattttgtgcaatagctgctcaaatctcctatttctctagtctgttgtttttcttttcttttttctcttctttttgcttccatagaactttatttatttccttatcttgtttttcttattacttaaacaaatcttgtattctgaacataactcctttttttagtagttttcaacctcatggctagtttttaattcttttttgtcttttggtgaatagaaagtcataattttgattaaactcaatttatcaatttttgcttctgatcctatttcacaaagataattttctgtggtatcttttatttcattgtttacattacatctacaatccatttggaatatacatatttttatcattgttgtgaggtaggggtcaagatttatttttattccttcttattatttttattatactttaagttctaggatacatgtgcacaacgtgcaggtttgttacataggtatacatgtgtgccatgttcgtttgctgcacccatcaactcatcatttacattaggtatttctcctaatgctatccctcccccagtcccccacacctcaacaggccccagtgtgtgatgttccccaccctgtgtccaagtgctctcgttgttcaattcccacctatgagtgagaacatgcagtgtttggttttctgtgcttgtgatagtttgctcagaatgacggtttccagcttcatccatgtctctacaaaggacatgaactcacccttttttacggctgcatagtcttccatggtgtatatgtgtcacattttcttaatccggtctatcattgatggacatttgggttggttccaagtctttgctattgtgaatagtgtcgcaataaacatacatgtgcatgtgtctttatagtagcatgatttataatcctttagatatatacccagtaatgggtcaaatggtatttctagttccagatccttgaggaatcgccacactgtcttccacaatggttgaactagtttacactcccaccaacggtgtaaaagcgttactatttctccacatcctctccagcatgtgttgtttcctgactttttaatgattgccattctaactggtgtgagatggtatctcattgtggttttgatttgcatttctctgatgaccagtgatgatgggcattttttcatgtgtctgttggctgcataaatgtcttcttttgagaagtgtctgttcatatcctttgcccactttttgatagggttttttgtttttttcttgtaaatgtgtttaggttctttgtagattctggatattagccctttgtcagatgggtagattgcaaaaattttctcccattctgtaggttgcctgttcactctgattgtagtttcttttgaagatttattttttactaccatttttttgttggacttttaaaatgagtttggaagtgttccctctccttcaattttttttttttggaagagtttgaaaacaattatcattgattcttctttaaaagtttggtagaattctccaggaaagatatctggttttgggcttttgttgttgttgttgttaggaggtttggattactgattcaatctccttactagttacagctttgtttagattttttatgattatgtcttggtagtttgtatgtttctaggaattaatcaatttcttctaggttattgaattttttggtatatgattttaaaagcctcttataattgtggcatcaggtgtaatgccacctcttttgtttctgacttccagtctttttgtttttttcttagtctagctaaggggcttgtcagttttgttgttttttcaaaaaatcaactaagtttaaaaacttaatttaaactttttttcatttatttttgctctaatctttattatagtatttcctccctttgctttgggcttcctcatttgtcctttttttctagttccttgagttgttaagttttttatttgagatctttcttctttcttcatttttagtgtaggcatttacaactcccttctttgtttttgttttcatgtttaagagacaagatctcactatgatgtacagaggcacgatcatagctccctgcaagtgatccttgtgccttggattcccaaagcactgggattacaggcgtgagccactgagcttgcccagcttaatattccttcttagtactgcttttgttgtatcctgtaagtttttattgtgttgtgttttcatttttgtttatcttaacatattttctaattcatcttttgatttcccctttcattcaaatgaaattttgaacagaatttcgttcaaaattctgttgtttaatttctacatatttgcagattttccagttttaattccagtattgatttctagttttattccactgtggtcagaaaagatatttagtaggatttcaaccttcttgaatttgttaagacttgttttgtgacctgacgtgtgatttatcctggaaaatgctctgagtgtgcttgagaagactgtatatttgctgctgttgggtggaattttctgtatatgtctgttagttccatttcagctatagtgttgttcaagtcctctgcttccttgctgattttctgtctgaatgttctattccttattgaaagtaggataccaaaatctcctactacagtcattggagatacattctgagaattgtatcattctgagatttcatcactgtgcaaacatgagagtgtacttacatatttacacaaacctagatagtatagcctactacagacctaggttacatgatctattgcttctaggctacaaacctgtacatatgttaactgtactgaatactatagggaattgtaacacaatggtaagtatttgtatacctaaatatatctaaacatctaaaaggtacagtaaaaacattgtacagatttttaaaatggtacacctgaatagggtacttaccctatgaatggagactgcggggctggaaatttatctgcatgagtcaatgagtgaatggtgagtgaatgtgaaggcccaggacattactgtgcactaatgtagactttaaagcactatacatttaggctacactcaatttatcaaaaaattttctttttacaggctggtcatggtggctcatgcctgtaatcccagcactttgggaggctgaggaaggaggatcacttaagcccaggagttcaagaccagcctgggcaatatagtgagaccctgtctctagaaaataatttttaaaaattagctaggtgtggtgacacacacttgtagttccagctactcaggaggctgaagtgggaggatccttgacttgaggaggtcaaggctacagtgagctatggtcgtgccactgcactccagcctgagcaacagagtgagactctgtctcaattttttttctttcttcagtaataaattaaccttagcttactgtaacttttcaactttgtaaacttaaattttttaaccttttgactcttttgtaataacgcttagcttaaaacacaaacacattgtacagctgtacaaaaatattttctctttatatccttattttacaagtttttttgacttttaatttttttatttttttcacttttacttagtgtttttttttgttgttgttgttaaaaatgaagatataaacacccatactagcctaggactgtattgggtcaggatcatcaatatcattgtcttccacctccatatcttgtcccactggaaggtcttctggggcagttacacatgcgatgctatcatctcctatgataacaatatcttctagtggaatacttcccaaaagactttcctgaggctgttttgtggtgaccttttttcttttttttttttgagttaatgtattttttataagtagaaagagtacactgtaaaataccactaaaaagtatagtaaatacataaagcagtaacatttactatctgtatcaagtattatgtactgtaaattactgtacataattgtatgtgctatcttgtacttttatataactggtagtgcaataggtttgtttacaccaacatcaccacaaacatgtgagtaatgtgctacaacattatgactgctacatcatcactaggtgataggaatttttcagctccattataatcttatgggactactcttgtacatgtggtctgttattggttgaaacgttgttatacaacacttgactttattgtattgctatctatttctccatttctgtgaatgtttgcctcatatatttaggtgttttaatgttgggtgcatatgtatttataattgctatgtccttctggtgaattgaccttttatcattatataatgtccttctttgtctcttatgacactttttgacttaaagactattttgtgtgatgtagctgtttccacatttgcactcttttggttacaatttgcatgaaatttttttaatatcctttaactttcaggctatccaggtctttaaatctaaagcaaatctcttgtagttagcatataattgggtctttaaaaaaaatcaattcaaccactttgtatcttttgattgggggagtttatcccatttttatttaaagtaattattgatagggcataacttactgttgcctctttgttaattgttgtttgcagcttgtagactttttgctcctctttcctcctcttactgtcttcctttgtgttttattgagaattgtaatgctatgtttttgttcctttcctgttttcttttgtatatcttccataggtattttctttgtggttaccatggggcttacattttaaaactcttataaaaatgtattttaaactgatagcatctttactacaatcacaaaacaaaactcattatgtttacttctcccctacccaaattttatgttattgatgtcataaatacatctttttatattgtgtatacattattttatagttagtttttctgtacttttgtcttttaatcagattttaaaatatcagattttaaagtgacttttgtaccaccattacagtattatagtattctgtttttatctatatatttatctttactagtgagctttatactttaataaaatacctatgtatttctgtttagcatcccctaattttaactcaaaaggccccctcttaacatttcttgtaaggcaagtctaattgtgatcaccttcagcttttgtttaactgggaaggtctttatctctttttcatttttgaagacaaactttggtggatttggtattcttggctggcagttctttttcttttcagcactttcagtataacatctcacccctttctggatggcaaggtttctactgagaaatctactggtagagttaggggtgttcttttgtacgtgatgaggcatttttcttttgctgctttctaaattcttaacatttcttggatcttgatgtccatttccttcctcatatttgggaagttttcagatgtaattttaaaaaataagctgtctgtccttttctcttatggcttcttcttttgaaactgtcataatgagtagagcagcctgctcgaggatgtcctatcaatttcttaggctttctttactctctttcatttcttgctctttttgctactctgtctggataatttcaaatgatgtgtccttgagttcactgactcattcttctacttgattaagtctgctgttgaacatgtctgtaaaattttcagttcaattattgtattcttcagttccaaaatttctttttagttcttttgaatattttctatctgctgaaattctgattctgcttatgcattattttcctgagctcactgaacatctttatgacaattattttgaatactttgtcaagtaattcacatagctctatttctttaggtttggtttctggaggtgtgtttgtgtgtgtgtgtgtgtgtgtgtgtgggcacgcactatttgattgggccatgtttcctgttttctcatattccttattactttgtgttgatatctatacatttcaaaaaaacaaaaaacaacaacacaccagctacctcttccagtctttatggactggatttgtacatggaaagatctttactaatcaggctggctagagattctagggacctctcaaaccttttctgtggatgcatcttctatggacttgtgtgtataattcctaattagagggatctgccagcttttttttttaagatgctctaatctttttccctctgtggtgtctgtgtgctgtactgtgggccctctggagcagcagtattcactcagctcttttaggttctgagaagccctcagttatagattctgctgaatcctatcagtgcctggagtcaagtgagacagaaacttggactgcccactaaaattcaggaactttggatgcattttactctctctttccctcatgagagagagagtgctgagctgagtttctctctgtgtgctgtatcacaggtcctgaggagcatcagcccgccacccagctctttattattctgagctgccctcaggattttagaatatgccaggttccatcagtgctctgagatatgcaagacagctcccctgaaaagtcagaacactgaatgcatgctttactttctctttcccttctcagggagaagacaggagctgggaatttccccctgtttgaatggaactgtgctgctggatgggactatagggaaagtgccccagaaaagtgcccagctagttttacacttgcttggagcccaggaccctcttaactggtttcggcacttatcaccatgggaattggtccttgtattgttgttgagttggtatacctgtggagggtctggggattcctataacagcatcttgctgatgtcactacctctgttatctttttaagctatatatgcttttacaaattattttattgatttcctcttttgttgattataacacacatccttgacttattacctcaattaaatcaataattttaataattccaggcaacgctaagaccttgaatcattataccatttacttgtaccctactttttgttactgatatgcctttcaattatttatatgttctagacacacagtacattattatcattgttttgttaacacctatatatgtttctttctgggatcattttccttctgaagaaattaacatttcctttagtgtggcctgctggtaaagaaacctttacgtttttatatatctggaaatgtcttaattttactatcacttttgagaaacagttttgggtattgaatgaaagttatttttgccagcacttttaagatgacattccatggtcttcttttgagatgatggctgtcaagtttattgttcaattagtgtgtctttttttctgtctagctactttgtatacttactctgtttttcacttttaacagctttactatcatgtgcccagtgttaatttgctttgtttttaatctcgcttgcagttttcaaagcttcttatatctgtgggttgataatattttatcagtttaagagaagatttagcagtatgccttcaaatacggcttctacttcatattttctcttatattcttctgtgactataagtacatgtatgttaaatcttttcaccatattccttgtcttttatgtgccatttctgtttttaaatcactttttctctttgtttcataatccatgttttattctgacccatcttttactttaggaattttatcttgttattctaggccactgtcaaagtcattgattgaattcttaacttgaatcgtggcatttttccattttagaattttattttcctttttaaaaatatatttctaacttgggtactggctaatgtcaaaagaaactttcctcccacaaagttttcactcacttgatcttggattttaaaatcagatataacctgagagattatcatttttctccatttaataatgaatcaggccaggcatggtggctcatgcctataatcccaacacctgtgtgggccatgacaggaggattgcttgagcccaggagttcaagatgagcctgagcaatatagggagactccatctttacaaaaaatgaaaaaaattagctagatgtggtggtgcacacctgtggtcccagctacttgggaggctgaagttggaggatggcttgagcctgaggctgcaatgaactttgactgtaccactgcactccagcctcggtcagagtgagactctttgtcacccagttgtatagaatcaactataggtagaggcataaaaaagatgcctgagattgcatctcttgaatttagcttcattgtccctttctattaagtgagattatttgacatgaacattgatattcactatctcagggatatgttagaactattctcatattttctatccacagaggatatataatatggatattttagcacattcccttatagggcagttataccttcctctgtgactcattatacaggcagcgctaagatgtgtattatatgctcatggtatcctttcttactatccttataatagaataaattaatttttatacagaattaatttttgaagaatcaaatgacatatgtgcataaattatttatacatttttatacaattgcttcaacatttcctcttctctgcaatctggtatatctatataatttctatagataagagaagaaaaatatagcttattaaaattttattctgggttttgtaaggaataaaggacatttgtacccttatgaagattaaattttcttgtgttagtatatttctaaaggcttttagtgaattaaatggagacactttaatatactacacagttttaaatctaaatttttttctcaaggaagaacttctgtttacacaatgatgcttaaacatgactgaaatatctaaaggagaggttaactggatcagtcaagaaaataatctgtaacatttgattgaagaaaatagcttagaagaagattttttaaaatgttcttttcctgtggagtctcccatgaaattcagattggataatctatagttactgagaaaggaatattcaaaataagagttgatcactgtagcacaaatgcaagtgataatttaaaaagtaaatataatttaacagatatgaaagtgaatcaaaagtcaagagtcttgtttcctcctgaaatatctatataagtacatgagatattttttccagactgagaggagcatgtgaactgatattgttgatgactttttctccattgagtatatcttttaaaatactcagtatttatcataatactctgcagattacaatgtacacattgttaatactacattgttaatttgccttttaaatacttaatatttacttttttcaaaggttatctttgtgtattttgtataaaattctactataatttattccatagctttgtagttttacattatttactgttatataatagaaagtggctaacatcagctaatgctgttttctaaatatttattatcattttcttatgtttttaaccattgtgtattaaaatatttcaaaattatcagtatgaaaactattaggcaaatagtctgggaaattgatttgtgtttcaacgatccaaatattagtgaaaagtcatgataatagagatagtaaaaatcttataagggaactggtaaatatatctttaaagattgtatcagaaacaattctatgacaatatcttgtttctttacaagtttgaattccagaaatcaagtgaatttcctctgactttgcattttctggtaatttcttttttcttatcaagctatattttaaatgtaaaagtatccaacaatagaattgctaatctcttggtccctcttgtcttcacaggtaagggatattttgtaatatttaaggaattttatggagtatatatacaagcagaatgttagctatttcttcaatagaaaacttggtgatattttcttttgcccatatttattaagtgaagtttactaaattttctaggtcgtgttcaaatcataccatccagtaaacagttgggagattaaaaagtaattaaactaatataaagatagcctggttaataaaatgatattcttttcaacatgattatatttactggaacctaaacattttgtgaaatagtatgtcatatagacaatattaggattttgacttgttatgtaagtacaaaggtatgtattttacaatttttaataattgctttatcagtaatagcaacttgaagaaatgctatctagatgcttctaatttgaaaatagtgcaaagacgatttaccaaagtcgttctattatgcttttgatttctagaaagctgaaatatccccattacagtttttgagtcaatacaaaaagtagataggtgttatagataaagaaataggttttcatcgatttgaaaattagaactccgagaagaaactcaggtaagaatgccattaaaatagttttagttgtttttgaaaataacatcaacaaaatgtcactattaaacagtgaaattggaataaaaatttgttttatgagtaacacggagatagcatacaaacattccattgactaatacagaaaaaactcaaaagttttaattagatatgtttaaatagagatgagaaaagtcaaaactttaactcttaaaagttatttttatcagtttggaaatatataaactcctccctatataaaatacaccagcacaaatttctctagtaaggattggggtttcatgactttagatgtatttttctgtaatattttaatgacgcacttatattgacgcattttaagatagagtttaatgatatattttgactagagataagtgatttaaagaataagaatcatgtcattgaaagtgagaatacttgagaaatattgacgaatataagctaaataaagcaaaacaaaataaaacacttaccctttcatccacatgatgtcgctggacaccggaaggtttttctcccttcccagcctcaaaggaatacagtgagtagattttccttagacagaaaggaaaagaaccttccatttttggctgtgccaagaagctcagaaaggcgataatataaaaaatatatagttaattgggaattgaatttacaaaatacattgtgtggtgatgcaatagaaagctcataattggaacgagattgagatggtatattcccggagaggaagtctgggatcccggctcctgctgctctggcttctccttgcctactggaaggcagggagcggccagctccactactcgatcccggaggaagccaaacacggaaccttcgttggccgcatcgcgcaggacctagggctggagctggcggagctggtgccgcgcctgttccgggtggcgtccaagggccgcggggaccttctggaggtaaatctgcagaatggcattttgtttgtgaattctcggatcgaccgggaggagctgtgccggcggagggcggagtgcagcatccacctggaggtgatcgtggacaggccgctgcaggttttccatgtggaggtggcagtgaaggacatcaatgacaatccgcccaggttctccagacaagaacaaagattattcattttagagtcaagaatgccagattcgcggtttccgctagagggcgcgtcggatttggatattggagcaaatgcacaattgagatacaggttaaatccaaacgaatattttgacttagatgttaaaacaaatgaagaagaaacgaactttttagagctggttttgaggaaatccttagatagagaagaaacacaagaacaccgtttattagtgattgcaactgatggaggaaaacccgaactaacaggtacagttcagttgttgatcaatgtattggatgctaatgataacgccccagaatttgataaatccatttataatgtcagattgttggaaaatgcaccaagtgggacattagttattaaactgaacgcctcagatgcagatgagggcatcaataaggaaatagtgtatttctttagtaatcttgttcttgacgatgtaaagtccaaatttataattaattctaatactggtgaaataaaagttaacggggaactggattatgaagactataactcatatgaaattaatattgatgccatggataaaagtacattcccattatcaggacactgtaaagtagtagtgaaactcctggatgtgaatgataataccccagagatggccataaccacccttttcctgcctgtcaaagaggacgctccactcagcacggtcattgctctgatcagcgtgtctgaccgtgactcaggtgccaacgggcaggtgacctgctccctaatgccccacgttcccttcaagctggtgtccaccttcaagaattactactcgttggtgctggacagcgccctggaccgcgagagcgtgtcggtctatgagctggtggtgaccgcgcgggacgggggctcgccttcgctgtgggccaccgccagcgtgtctgtggaagtggccgacgtgaacgacaacgctccggcgttcgcgcagccccagtataccgtgttcgtgaaggagaacaacccgccaggctgccacatcttcacggtgtctgcacgggacgcggacgcgcaggagaacgccctggtgtcctactcgctggtggagcggcgggtgggcgagcgcccgctgtcgagttacgtttcggtgcacgcggagagcggcaaggtgtacgcgctgcagccgctggaccacgaggaagtggagctgctgcagttccaggtgagcgcgcgcgacgcgggcgtgccgcctctgggcagcaacgtgacgctgcaggtgttcgtgctggacgagaacgacaacgcgccggcgctgctggtgcctcgagtgggtggcaccggcggcgcagtgagcgagctggtgccgaggtcagtgggtgcgggccacgtggtggcgaaggtgcgcgcagtggaccctgattcgggctacaacgcttggctttcgtatgagctgcagccagcgcctggcagtgcgcgcatcccgttccgcgtggggctgtacacaggcgagatcagcacaacacgctctctggatgagaccgaagcaccgcgccaccgccttctggtgctggtgaaggaccatggagagcccccgctgacagccacagccacagtgctggtgtcgctggtggaaagtggccaggcgccgaaggcctcatcgcgggcgtcggcgggcgctgtgggtcccgaggctgccctggtggatgtcaacgtgtacctgatcatcgccatctgtgcggtgtccagcctgctggtgctcacgctgctgctgtacaccgcgctgcggtgctcggcgcagcccaccgaggccgtgtgcacacggggcaagcccactctgttgtgctccagcgcggtggggagctggtcgtactcgcagcagaggagacagagggtgtgctctggggaagctccacccaaaacagacctcatggccttcagtccaagccttcctcagggtcccacctctacagacaacgtgagttttctaatattaacatccatctttccctcccaattttcaaatattaaatgtcacattcacccactttttttgtatttaaaaattatgtcttagtacacaaatattgtggtacacaattattgcactaattcatgtattatatgctttttatgaggcttttctgctggggtaatagattcatcagctttctgtgatattaagtgtttttaaaataatattttatattagcatttgaattttgcatctctaaaaatgtaggataataattgtaagacatagtttggagtcattctcaaagtttcagtttatgactacatgaaaatttattttattttattgttattttttagagaccctttgttgcttagtctgcagtgatctgatcatagctcaccgaagcctgaaactcctgggctcaagtgatcctcctatctcagccgcccaagtagctggactacatgcacatgctaattaaagttttttttttttttttttttttattttctgtagagataggggtcttgctactttgcccaggctggtcttgaactcctggtttgaagccatgctcccgtctcagcctcccgaagtactaagattacaggattgagcaagagtgcctggcctataaaaatgttttaacaccacccttccaattttgcctttttgtttctattgaatttaaattaattattattttattacactaatttagtttgttttcaattgtatttttgcagcatatggtttatttcaactttgcctaagcagttcacctgtatacccatgatgaatttgataattgtaatttaaaaattatatttttcattttattgattttttgaataggaaacacatatacatggtttactgttctaaaggtgcaaaagaatacagttaaattttccctttcacctccttcatgaagccaaaacattctctggtatccttctagagatttttttcatatacaaataaacttccctacccccttaaaaaacatatgagtattgattttaatcttgcttttttcatttactaatgtatcttgatgatcatgaattatcattactgaagtagatttgtttttcttttatctggatctatggtgttccattgtgtaggtatgtgattggttatttttcccttaacattaacatttagtggaacaatgatttaattttctggaaatttgcatatttttcaatatatctaatatatattagatatataaatatctaaaatatctaatatatatctaatatattatatattttatataatatatataataaatatataataataatatatatcagatattttgatacagaattttgctcttgttgcccaaacgagtgcaatggtacaatcttggcctcccaggttcaagcgattctcctgccttatcttcccaagtagctgggattacaggcatgtgcccacacctggctaattttttgtatttactagagacggggtttcaccatgttggtcatggtggtctcgaactcctaatctcaggtgatttacccgcctcggcctcccaaagtgctgggattgcaggcatgagccatcgcgcctggcctaaattattatattgatgaggagtaactgtgaatctcctcagttgtgcaaattctactatattttggttgggaaattttactgcttgttgttacttttagattaaaaaaataaatataccatgatacaaactcccctcttgagttgtttacaaagagttgtttattaaagctgtatgtttgagactacgctagacaggtgtcctctccatctgaaataatgagaaccatttgtctactcttttgaggggaaaagtatggatttataggtagtaaatagtccacactttacatgataaaatgtgaattccctatttctgttgctttgcctgtttcttttattctcatatgcattcaattttataagtacccttctatcatgctatttatatattcctaatatcctgagctactttgaggaagtcctagaaattgagaaatagtttttgtcattctataaatctaaagttaacaatggtcacattttaaaaaatcaagttttgtgatataaactatttatatatctctttatatatcaagtctttatgtatattttgtgcagcttgtcttttttataggaacctcttgttttggggattgtttttggttaagaaattgaaccctttgtttgcccaaaataactgcaatagaaagtcagtgataagaactactaaatagatccaggttaattattttaagatagaatttcacatggaagaaaaggctttgtgtcacaatcatctgtgaggcattttactgtatatcagaattttggagtaaggtgaagatgatcatgtcatttgaaaagtcttattggtgactctatttttctcctttgaaggaggggtttaatcacttcaaatggataacattaaggttaaattaagggcgaagttgatatttggccctgacttttatatgaaggtaacatttttgcaagtaaattgtagacgtaattaaaaaaacccagctaaaacaaaggtggtattgagaaagaggaagagcaagtggtctatattgtcagaaaaataagattcatattggagagtaattgaaaataacctgcaaaaagttgattacctaacatgtgattacatattaggttactagaagtttctcaagtgtcttgcaatttctaggtttagtaaaattcaatgaaagctgtactcataaagataaatatgatagcatgtgaaagacagatggacttaggtggatgtggaataaggcaagccagggaaaaggagtaatttaaaaagtaatataggtgacatgggaaatgctcatgtcattaaaaatatgaatttaaaaatttgaatttggggattattaataattgctcatgccttgctatttaacaaactattttctaggagtcagcatgtataggtgaaagtgacaattagaaacatagaaagaagggatgcagatatggatttgtaaatacctcaataaaagtcttattcaaaacttggaagtgagtgagaacaattaaaggaaaggatatgggacagggttgaagttgagagagaaaaacgagatcatttaggaacagctgaagaatcaaaaacagcaaagcacaatgggtagaaattccactagaatttgaagtggtgaagtatatgaaaagaaaatattttaagcaagaatcctaatataagctgcagataaattaaatgtgataaagaatatgctctagaattttatcttccatcattacacagaagaaccttaagagcatctgatatttattgaacaaagaaagcatggacttcaataatctataaggctttaaaaattcaaccaaaatttgataattttaagttacattttttccctagagcactatataatagcatgtcctaggaaagacagatgtgggcaagtttcttttctaccaagagtgtagaatagtttacatttctgatttaaaaagcagttccgttaacacttaaatttgctgaactggttgatattaatgttgcaaatattggtagaaaagttgtttagctgtgaataattagatcccttactttaaattaataaaagaagtcgggataacactgaccgtgcaaattacaaacgtgaggagggtttactataaaagtagagaaaagaagatactgttttaaaaatatatggtatagcactgttacgtgaattgatttcttaccttttggagccgcatgatgtcgctgtctaccatgaagttatagctagccaacattcaaatttcttctattactgcatcattccctgactgttgaatgatggcggacgcagaagaaatggattaataaattccggaacatacagtattttatctttatgcggaagatcttctaatggaaataaaaccagaggtatttgacatggtgtttaccccggaggatagattgggaaagcaatgtctgctcctcccgcttctgctcctcgcagcctggaaggtggggagcggccagctccactactccgtacccgaggaggccaaacacggcaccttcgtgggccggatcgcgcaggacctggggctggagctggcggagctggtgccgcgcctgttcaggatggcctccaaagaccgcgaggaccttctggaggtaaatctgcagaatggcattttgtttgtgaattctcggatcgaccgcgaggagctgtgcgggcggagcgcggagtgcagcatccacctggaggtgatcgtggacaggccgctgcaggttttccatgtggacgtggaggtgagggacattaacgacaacccgcccttgttcccggtagaggaacaaagagtgctgatttacgaatctaggctgccagattctgtgtttccactggagggcgcgtccgatgcagatgttggctcaaattccatcttaacctataaactcagttctagcgaatacttcgggctagatgtgaaaataaacagtgatgacaataaacaaattgggctcttattaaagaaatccttggacagagaggaagctcctgcacacaacttattcctgacagccacagatgggggcaaacctgagctcacaggcactgttcagctgctggtcacagtgctggatgtgaatgataatgctcccactttcgaacagtctgaatacgaagtaagaatattcgaaaatgcagacaacggaacaacagttatcagactgaatgcttctgatcgggatgaaggagcgaatggggcaatttcatattcttttaatagccttgttgcagccatggttattgaccactttagcatagatcgaaatacgggagaaatagtgattcggggtaatttggattttgaacaagaaaacttatacaaaatcctcattgacgccacggacaaaggccatcctcccatggcgggtcattgcaccgttttagtgagaattttggataaaaatgataacgtccctgagatagcactgacttccttatccttgcctgtacgtgaagacgctcaatttggtactgtcatcgccctaattagcgtgaacgacctcgattcaggtgccaacgggcaggtgaactgctcgctgacgcctcacgtccctttcaagctggtgtccaccttcaagaattactactcgttggtgctggacagtgccctggaccgcgagagcgtgtcggcctatgagttggtggtaaccgcgcgggacgggggctcgccttcgctgtgggccaccgccagcttgtctgtggaggtggccgacatgaatgacaatgctccggcgttcgcgcagcccgagtacacagtgttcgtgaaggagaacaacccgccgggctgccacatcttcacggtgtctgcgcgagacgcggacgcgcaggagaacgcgctggtgtcctactcgctggtggagcggcgggtgggcgagcgcgcgttgtcgagctacatttcggtgcacgcggagagcggcaaggtgtacgcgctgcagccgctggaccacgaggagctagagctgctgcagtttcaggtgagcgcgcgcgacgcgggcgtgccgcctctgggcagcaacgtgacgctgcaggtgttcgtgctggacgagaacgacaacgcgccggcgctgctggcgcctcgggtgggtggtactggtggtgcagtgagcgagctggtgccgcggtcactgggtgcaggccaagtggtggcgaaggtgcgcgcagttgacgccgactcaggctacaacgcgtggctttcgtatgagctgcagcccccggcaagcagcgctcgcttcccgtttcgcgtggggctgtacacgggcgagatcagcaccactcgtgtcctggacgaagcggactctccgcgccaccggctgctggtgctggtgaaagaccacggtgagccggcgctgacagcgacggccacggttctggtgtcgctggtggagagtggccaggctccaaaggcgtcatcacgggcgtcggtgggcgccgcgggcccagaggcggcgctggtggatgtcaacgtgtacctgatcatcgccatctgcgcggtatccagcctgctggtcctcacgctactgctgtacacagcgctgcggtgctcggcgccacccaccgagggcgcgtgcacggcggacaagcccacgctggtgtgctccagcgcagtggggagctggtcgtactcgcagcagaggcggcagagggtgtgctccggggagggcccacccaagatggatctcatggcctttagccccagcctttcaccttgtcctattatgatgggtaaggcggagaatcaggatttaaatgaagatcatgatgccaaagtaagtgaattttcataattaacagttaatttttattttaaatttataattgttttcctcatatttgtcttctatatttctgtttttaatttttaattaattttacaaaattacatattttcattttattgtgtttcttattttaatctctttgcttctttaatattcataatttaagtgaaattagaaatcactgtccacaatctgcacctcagaatttttgtcttcaaaccaaaatattcttggatatgtcgttttctgttgcattttaattcagaatcatagtagcatttttttctgattaattatatgggattttcatttgtttgcctttgagctttaggataatttttttacatatactcttttttgatcatatattgaaatttgagcaccagtgtatcacttatgtttttacactttccatttcaatgtttttctgtcgacacttttattaagctaacgctttgattttatccattttgtgtaagaactctgatcatcatagtttttatctgtggttcccttttcagacttgtgattccgggaggcaatagtgttcatttattgtcccccttttaaaccattgaggaataaaggacaaaaacaatagttatcagcctgaatacttctggttgttatggttattgatttatttactaccgatctaaataatggaaaaatagtgattcaacagaatttagaccttgtgatcaagtaaatttatatgaaaactgcattcctctggcattgcggctctcttatttctgtttgaatttcacttgatggtcttctcttcatggagtctaaatctatttctttgtattagtgttttcattgtttctacacagtaatttaaactattcactattttgtatgtgtgtgtgtgtgtgtgacagggtcttgctctgtcacccatgctggagtacagtggtgcaataatggctcactgcaccctcgaatgcctgggctcaagtgattctctcacctcagcctctggagttactacacacgagcaccaccatgccccccaccttttttttttttttttttttttttaagagatggggtttctccatgttgcccaggctggtctcaaactactgggtgcaagtgatctgcccaccttggcctcccaaagtactaagattataggtgtgagccactatgcttggctagtcattatttctttgaatgaaaagcagcaaaaagtagtgattaagtgtgagttttggtgttatcctcccttgcctaaatttcatcgctaccaattttgttttgtggatggattgtttcacctctatttcagtttcttctgtaaagttggaatgataaacactagtttcaatgatagaattgtcataaagctttagtaagttgatattgtaaggcgcttataactgtgtttgccaaatagcaagtgcttaaaaaatttgctactagttttccgaagaggaaaagaaaaactttatgtcattttatgctaggaaactctcattacggattccatattgttttcattttacgtaaagattgaatttttgttattcatagtgaggccataattaccaatttaatctgagatgtctctaacattttaaatgccatgttctacattaaaagcaatttaaaatgtgtgtttcaaagttgaaaattgaattaagacttggacagtggaaaagttttatgaattcaaaagacatttaacctgctgagtcctcagtgatttcctggagttggttttgactttttgtgttgtccatgttcccaggaaatattagactacattaagcatgaatggtgtatttgcccacatttaaaagttgcttaagggccattagaggactgagttgtggtttgtgtttcctaatgtgagcattttccattcttgaaatggcagaaactggtagtggtattttctgttttctaaaagaagtacatgataatttttaagcgtgtaattaatattgcactaaaatttaaaaaaactaactctacatacttaagagtggcagaattgtctctgattatactgaagatcaccatttgtgtagctaatgatatctaacagcctcaaaacagcatactttcttaggaagtagagaactatagcgttgctagtgagtaaatgttttttaaaaagttcctaggagggtctttaagagtatcacactgtgcctgctgagaatcatcgaattaacaagacctggcttcaaatttaatagataaataaaggtaagtatcctacataaatacgatgatagtaaaagcaagaatattgtaagaggtgctagaaaggtacatcatagtgttattggaattggaaaaaaatctttgcctttttcccttgttgaaggagaccgtgaagagtcatgatgttttactggttataaaatggaaagagttttccctgggagaatatggagactaacaggtattcatgagaagagagtaacttaagtgagtatacagaaaattccaaatgtacctagaaatgaggaatagtccactttgggtaaagcacatggttcccataagagagagtgtgatataaagcaagaaaagtaatatgagaaaaaccttttgtataactttgagtactagacgagtaattttgacactcttcaaagtcatttgaaagctgtcaaaaagtgtgaagcaatacgaataaaaagtattaacggaagatgactgcaaggattaaatgaaggagaatgaaataggaatggacaggttacacaataagaagctactgcaatacaccaggagagcagcaattataaaaacttatttaggaaagcatctgaatacagacataattattttacatgccattgggaacattggagtgaaacattccagaaaacgaacacagtaaggtagatccaaaaaggatgaaatacctcaagacttgatcaaagggctgctgtatgtgagatggctgagcactgaaatttatctaataaaataaacttacattttaaaagaaataatacaaatcatatttgagattgtaaaaataggcatatattcataacacacaagtgttcgaaaggatagaatgaggaaacaaatataaaatgatgaactcctgaaacagtatatatagattctgctaaagcaaaaaattcagaatacttcctcctcaaaaagttcacatgatacaaattcttccccttcaaagattccccaaaccttctcttattttgttttcccaagagaagtgtctggatagttgctaatgtttcttgcctcctaaaaagaaaacacacacacacacaccgctttctaagtttctctttcatcaatcagtagattcttgagatcctgggtccctaaaagagtacaggatttttcttaacaagcgatactgaatcaagaatatgaagtttcctgggatctagatcaaaggaatttaaacttgcagttgtttaaattcatgttgtcacttaggtttctatctttatttaaaactgtgtgaaaaaaaagtttttctaaggcatgaggaagctacagttctggtaacactgagtattcaaaagccatcagtcgcctaagaatgcttctaacaatcatgagaaatgctattttaacctttaacaacaatgaagaaaaaaattcagagtttgaaataaaacttttcatctgattaatagtttgtaatggtttgtaattcttacttacatgatggccacatgatgtcgctctttaccgcaaattctttcgtaatcagcaaaaggaagtcattccttttcgcactggaaagacgctccactctctttcactctttggatgcacaacaatggccacacatcgagattgaaatgaagggataaaaacattcctataaattcgaaggcaagttttgctgactagaaaaacaagccaataatttgaaatggtgtgcccgaatggatacgacccagggggccgacatctactgctgtttattataattctagcagcttgggaggcagggagaggccagctccactactcggtccccgaggaggctaaacatggcaacttcgtgggccgcatcgcgcaggacctggggctggagctggcggagctggtgccgcgcctgttccgggcggtgtgcaaattccgtggggatcttctggaggtaaatctgcagaatggcattttgtttgtgaattctcggatcgaccgcgaggagctgtgcgggcggagcgcggagtgcagcatccacctggaggtgatcgtggaaaggccgctgcaggttttccatgtggacgtggaggtgaaggacattaacgacaaccctccggtgttcccagcgacacaaaggaatctgttcatcgcggaatccaggccgcttgactctcggtttccactagagggcgcgtccgatgcagatatcggggagaacgccctgctcacttacagactgagccccaatgagtatttcttcctggacgtgccaaccagcaaccagcaggtaaaacctcttggacttgtattacggaaacttttagacagagaagaaactccggagcttcatttattgctcacggccaccgatggaggcaaacccgagctgactggcaccgttcaattactcatcacggtactggacaacaatgacaatgccccagtgttcgacagaaccctgtatacggtgaaattaccagaaaacgtttctatcggaacgctggtgattcaccccaatgcctcagatttagacgaaggcttgaatggggatattatttactccttctccagtgatgtttctccagatataaaatccaagttccacatggaccccttaagtggggcaatcacagtgataggacatatggattttgaagaaagtagagcacacaagatcccagtcgaggctgtcgataaaggcttcccacccctggctggtcattgtacagttcttgtggaagttgtggatgtaaatgacaatgctccacagttgactctcacttccctgtctctccctattccagaggacgcccaaccaggtaccgtcatcacattgattagcgtgtttgaccgagattttggagtcaacggacaggttacctgctccctgacgccccgcgttcccttcaagttggtgtccaccttcaagaattactattcattggtgctggacagcgctctggaccgcgagagtgtgtccgcctatgagctggtggttaccgcgcgggacgggggctcgccttctctgtgggccactgctagcgtgtccgtggaggtggccgacgtgaacgacaacgccccggcgttcgcgcagcccgagtatacggtgttcgtgaaggagaacaacccgccgggctgccacatcttcactgtgtcggcgggggacgcggacgcgcagaagaacgcgctggtgtcctactcgctggtggagctgcgggtgggcgagcgcgcgctgtcgagctacgtgtcagtgcacgcggagagcggcaaggtgtacgcgctgcagccgttggaccacgaggagctggagctgttgcagttccaggtgagcgcgcgcgatgcgggcgtgccgcctctgggcagcaacgtgacgctgcaggtgttcgtgctggacgagaacgacaacgcgccggcactgctggcgcctcgggtgggtggcactggtggcgcagtgagagagcttgtgccgcggtctgtgggcgcgggccatgtggtggcgaaggtacgtgcagttgacgctgactcaggctacaacgcgtggctttcgtatgagttgcaaccggtggcggccggtgcgagcatcccgttccgcgtggggctgtacactggtgagatcagcacgacacgagccctagatgagacggacgcaccgcgccaccgccttctggtgcttgtgaaggaccacggggagccctcgctgacagccacagccaccgtgctggtgtcgctggtggaaagcggccaggcaccaaaggcgtcgtcgcgggcatcgttgggcattgcaggcccagagaccgagctggtggatgtcaacgtgtacctgatcatcgccatctgcgcggtgtccagtctgttggtgcttaccctgctgctgtacacggcgttgcggtgctcagcgccgtcctctgagggcgcatgtagtttggtaaagcccactctggtgtgctccagcgcggtggggagctggtcattctcccagcagaggcggcagagggtgtgctctggggagggcccacccaagacagacctcatggccttcagtcccagccttcctcagggtccatcctctacagacaatgtgagtcataaataatcttgtttccaacaattttaaaacaattagttcaattggtctccttaaattttctttcataatttcttttttagttgatagctttatgtataattattattttttaatgttatgctgtatttgcactaattatttggaagtacgtttaatatacacttttgttttgggatgcgtaatactatagatcaaaatctatggtttatgttggctactctccatttttggaggaggactttgctaactggagcaatggattcacctttcttctatagtgtatttacaaaatcaaatatttacatttccatattttgataatcaatacctataaatgttatagtaaacaaatttaatatatatgttacctaatattttattctatgtattgtcctcattttataaaatatagctgtgtcaaaatcatctgttcaattttgcctttttatctttagtctagaacttgaattttaagcatttcttttacatctatttatcttctttttatcatatttgtgtagcactgacttctttttaacttactttgttgagatgtatttgccatgttcatgaagaattaatatgaacaatttaaaatagtttaaatggcagtttaatagtattttttattttgttccttgtttgtataagaaatatattcacattcaaaatttcaaagagtgaaatctagtacgtagtaaaaaatctccttgcctcctcaaaccccaaaccatttactttacctttctgaatttctgaagcagtttactttttttgtatattcccaagattattattgccaaattatataaatatatttacaatcaccaaattgtaaatcgccaatatatatattttataatttgccccttccttccttccttcctttctttctttctttcttcctttttctttcattctttttcttttttctttcttctttcaagacacgctctcactccatcacccaggctgctgaaatgcagtggtgggattatagcccactgcaacctgaaagtcctgggctcacaggatcctcccatctcagcctctggagtagctgggaatacagtttgcatgtcattgtgcctggctaattttattttatttttgtagagacagggtggagtcttgtttcccaggctggtcttgaactcctggcttcaagcgatcctcctaccttggcctcccaaagtattgggattacagacacgaacaaccacacccagcctgcctttcatctttccttttttttaaaaaaagaagtgattacagtagaaacctacctttctgcactttttggttttccactttaagttatatatatatagtgtgtgtgtgtgtgtgtgtgtgtgtgtgtgtgtgtgtgtgtgtgtgtgtgtgtttgacagagttttactctgtcgccctctctggagtgcagtggtgcaatctcagctcactgcaaaatccgcctctctggtacaagcagttctcatgcctcagtctcccaagtagctgggattaaagacgccaacaaccaagccatgctaatttttttttttttttgtatttttagtagaaacagagtttcaccatgttgccccggctggtctcgaaatctgggactcaagtgatctgactgcctcagcctcccaatgtgctgggattacaggagtgagccaccgcatccggcctaaattatatattgggttttgtggcatattatttcattagcgcttattccttgtttttgattatttgctttcttatttttaaaagtatttgcatcttattttcttttatggatatatcatgatttattcatccagtactgtattagggacattaatgaaacaataaccgaattgtctagacttttaaaaattttttacaaataatttggttggtcaaaaaaatgatagttaacggggcatggtggcacacacctttaaccccaacatttcgggaggccgaggcaggaggattgcttcagtctagtagtttgagaccagcttgtgcatcttttgtagagactttgtaaaattagctatgcatggtgatgcatgtctgtagtttcagctactcaagaaactgaggtgggaggatcacttaagccagggaggtccaagctgcagttatcatgccactgaactccagcctaggtgacagagcaataccttgcctcaaaaataaaataaaatgaaataataaaataaaataaaataaaaacccagaactgacaattttcactgttcctaatattctaatatactttagtaaattattttaggatatgttactgttttcttttcaacgtgaataaggatagaggtatgcaaagtcaaaaacctgtctgataatcaatagaattatttaccattaagccataatatgtcattcacataagcagaccaagtttgctgctcttgttgaaagatattcagttttgtggaaaaatctataaatatctttgaccttcaaagatgtaactgtaatctgtttttattgctttgcttttatgcttacatgcatgtatatttaaaaccttcctagcatattattaaagttttaaatatcctatttatattgggaaatacctgaagttgataggggatcctccttagccacctaagctgtattcatcaattattatgatgatgatgatgattattatttttgagacagggtctcactctgtagcccagactgcagtgcagtggcacaatctgggcttactgcaatctctgcctcctgggctcaagtgatcttcctacctcagcctctcaagttgctgggactataggcacacaccaccatgcccaactaatttttgtattttttgtagagatggggtcttaccatgttgcccaggctggtctcaaactcctgagatatcgagaaatactattttctttacaaattgtttgctactatttagagtcaactacagagatttttttgggtaaataatgtgatgacaaatttaaatcatttcacagaaaatacccttatttgcctttcctatttaacctacgtttttggtaagaattttgtagaaatttggaggagctcttaattgcctactatgaaggcattcatgatgaatccatggagaatttacttttgaggtggactttgaaagatgaatagaattttgacagaaaaagatgaagtaatagaagaaaaaccttgaacaaagagtgtgccaagaaggagacaacatattttctgtaaaatatgactcctattggaaagtggttagccttagcactgagaagattggctcatggtcacgtagcgtatctcccagatggaagtctaatgtcttgacaattagtcaatagaaagataaacttgttgaagattttagtgaaatcgagtgaaagctgtactaataaggacagaaattatcacacgtgaaaggagagatgggatgtatacaaattttaaatatggtaggcaaaggaaaagaagtcataaaaatacatatgagtaaatgtggagaatcactatgctataaaaattgtgattttttaatgatttgggttttgggtgattattgattagatattcttttaactttggtcgactcattttctaggcaatgttagggtatacaggtaaaaatgtcaggtagaaaatgaaaatagggggttgcagatatggagttaagaatacttcaaataataggctagtttaaagccgtggaaatagaaacgttaaataaaaagttggggaaaaaagtttaaaggcataattctggtaaatactcactttttggagcagaagaaagatgaagaactaacaagccaatgatggcaatactgctagagtttggcatgtcagagaaatcataaaggaaaatgttttaagtgagaggctgaatttaacaagctatagagatatagagaaatagtgtaaagaatatgcacatacatttttattactttagtaaataaaacggttcaggcaatttgacatttattgaataaagaaaagcaaaaatttaacaataagaacacaagaagataaaatgtagaaaagttagaattatatgctcacctcagagtaatatataccagtgtttctggtgaccaaataaatattaatgcatttcttccacacgaaactatggaggacagtttacatttctgatatccatgacatacaggtcatacttaaatttattattaattgatacgatatttgaaatattgggaagaaattcctttccttatgaagaagaaatccctagctgaaactaatgtaaggagccagacagtatgaatgcctctgcaattgataaagttaaggatttactattaaattatgataaagaaatagaaagtgcatagaagaacccagatattgcggaagtaattcatgtaatcattaccttttgaagccacatgatgtcgctgtctaccaagaagttctggttggtcaatgttcaaagtcttttctctgacagcatctgtctctaaaggccgaacaacgggagatgcagcggaattggattaaaagactctgaaagtacagtcgttcatctttatattaagataatattttctgataggaaacgactatttaacatggattatcactggcgaggagagctgggatcctggcgactactactcttgcttctgctcctcgcagcctggaaggtggggagcggccagctccactactccgtccccgaggaggccaaacacggcaccttcgtgggccggatcgcgcaggacctggggctggagctggcggagctggtgccgcgcctgttccgggtggcgtccaaaagacaccgggaccttctggaggtaagtctgcagaatggcattttgtttgtgaattctcggatcgaccgcgaggagctgtgcgggcggagcgcggagtgcagcatccacctggaggtgatcgtggacaggccgctgcaggttttccatgtggacgtggaggtgaaggatgttaatgacaacccgccagtgttccgggtaaaagaccaaaagctgtttgtttcagaatccagaatgccagactctcggtttccgctagagggcgcgtccgatgcagatgttggagctaactccgtgttaacctacaggcttagctctcatgattacttcatgctagatgtgaattcaaagaacgatgagaataaactggttgagctcgtattaagaaaatccttggacagagaggacgctcctgcgcaccacttattcctgacagccacagatgggggcaaacctgagctcacaggcactgttcagctgctggtcacagtgctggatgtgaatgataatgctcccactttcgaacagtctgaatacgaagtaagaatattcgaaaacgcagacaacggaacaacagttatcaaactgaatgcttctgatccggatgaaggagccaatggggcaatttcatattcttttaatagccttgttgaaactatggttattgaccactttagcatagatcgaaatacgggagaaatagtgattcggggtaatttggattttgaacaagaaaacttatacaaaatcctcattgacgccacggacaaaggccatcctcccatggcgggtcattgcaccgttttagtgagaattttggataaaaatgataacgtccctgagatagcactgacttccttatccttgcctgtacgtgaagacgctcaatttggtactgtcatcgccctaattagcgtgaacgacctcgattcaggtgccaacgggcaggtgacctgctccctgatgccccatgtccccttcaagctggtgtccaccttcaagaattactactcgttggtgctggacagcgccctggaccgcgagagagtgtcggcctatgagttggtggtaaccgcgcgggacgggggctcgccttcgctgtgggccaccgccagcttgtctgtggaggtggccgacgtgaacgacaatgctccggcgttcgcgcagcccgagtacacggtgttcgtgaaggagaacaacccgccgggctgccacatcttcacggtgtctgcgcgagacgcggacgcgcaggagaacgcgctggtgtcctactcgcttgtggagcggcgggtgggcgagcgctcgctgtcgagctacatttcggtgcacacggagagcggcaaggtgtacgcgctgcagccgctggaccacgaggagctagagctgctgcagttccaggtgagcgcgcgcgacgcgggcgtgccgcctctgggcagcaacgtgacgctgcaggtgttcgtgctggacgagaatgacaacgcgccggcactgctggagcctcgggtgggtggcactggtggcgcagcgagcaagctggtgccgcggtctgtgggcgcgggccacgtggtagcgaaggtgcgcgcagtggacgccgactcgggctacaacgcgtggctttcgtatgagctgcagccagctgcaagcagccctcgcatcccgttccgcgtggggctgtacacgggcgagatcagcaccactcgtgtcctggacgaagcggactctccgcgccaccgtctgctggtcctggtgaaggatcatggtgaacctgcgctgaccgccacggccacggttctggtgtcgctggtggagagcggccaggctccaaaagcgtcatcgaggcagtcggctggcgttttgggtccggaagcggcgctggtggatgtcaacgtgtacctgatcatcgccatctgcgcggtatccagcctgctggtgctcacgctgctgctgtacactgcgctgcggtgctcagcactgcccactgagggcgggtgccgggcgggcaagcccactctggtgtgctccagtgcggtggggagctggtcatactcgcaacaacagccgcagagggtgtgctctggtgaggggccaccgaagacggacctcatggccttcagcccctgccttcctcctgatctgggatcagttgatgtaggcgaagagcaagatttaaatgttgatcatggcctcaaagtaagtccatttaaatttagaactcataaattctatttgtggaaattgtagttactttaaaagtgtttcagatttagtttttcaccgtattttatagtgaaaatttaaacattgtttagtttttagaaaccttttataattaattgaattttctcagtggcataatacagtattaatcattctccacaagttgggtctatcttgaaactcaagttatggttggatgatatccattttttactgaatatttattttggcctgccttacagccgtcttctctgaacaatactctaaggacgttcagggcattttgatctttggtgaaagtattcccccaaagcgtttattcttttgtccttaggcactgaactcttaatcttactccatatgctgtactttgaaatgcatgttttaaatatgttgtctttatatttacttttattcactttaagatctcggtttattcatcttatctgactttttagtgtctggtagtcacaaatatctttggtgtttcactattgccgttttaagcagtgtagtgataaaatacagaatgatagtgtttttcaaaatttgatagttttcatattcttcctaattttattataaactagttaaaaagtaaaatcaagagggaagagatttgtaatccttcttttaattcattatttagaccattttaccatttggagacatgttttttattctacatgatttttacagttgtattgtcgccaacttaacattttttgagcctctatgtttaggaaatgattactttattcttgcaagtatcttctaaactctaatcattcaaccctttgttcatgagttggaatattttcaataatattccacattaaagtgatatttaatatatgacttagaaaaatgttttcatcagaaaaactatacatgataatttcattcttgcaaaccaaacatataatttataaatccttattatacagaatatttgggattatcatggcccattagttcgtgtaaaaatatttagtattatgggataaatctttgaaaaatccaagatactttattttggtatctttcaacattttctttcttttatttcttcttgtctttttacacgtttgcttcttgtgactgttggacctgcctggatattaaatacccattagacttcgtgcatattgctttggagagaatggtagaaattgatggaagggaatgaacgatttctgggactctgaattcttacagtttgttattagtattgttttaaatcttttaatcacttatgaacaaataatgtaatcatttatgggcatattttagcccccttgtccaactgaaggtaacctcaaagcagcattgttttgtagtttattttacagttctcttaatgcctgtccatgtttagcattttatttgactatttgaacacattgtgtaaaagcgaattgttttcattttagtcctttaaaaaatatgattgttttcatttaagtccttttaaaaaatatgattatctttattatcctgtttgaataatatgtgttttcctttgtgaaagtaatatttcctatcctgtctatgtctacctggttctcaggtattactttaattactgaattctcctaaacatttaattgacttttacaaaatatcataaataggaggattctttccaccacctagcattgtatttggcaatttatcatttaagtcattttagttctgtttttcttcaactctctgatatttgaatttggggttgtgctttcacagtgagaaagtctaaacctatttcttgtacattaatacttttcactattctaattatggtgatgcttttagctattaagaatttctgggattgaaatgtgtcagaagttagttattaagtattgtggattctgaagctctctaaatcaagtcctccctttaccaatttttgtatgtgtagccattggtaaaggatttgttattcagttccttggcattatatgtatgcatgataaatgtgaattctactttatagatttatttgtatcaagtaagttaatagttataaattattaataataaactctggcaagtgataggtacataataaaatttagttattaccattcttaagagaaaagaagttagtgattgcagaaaggcaacctaaaatgtcagaaagtcgttatggccttccatattaatcttatttttgtgtaaaactatcttctgtaaagtcattttttagattaacctaggatgtttcaatattttgaatgttgtgtggtggaatgaaaaaaatctaaaagttattacgagtttaggaaagtcaagttaacaccacctatgtgggaaaacagttttttggaaaggttaaagtccttccaaggaatgtgtagactatcttactttgatagttgtatgtttcccatatttaaaagttgcctgagatcctgcagaggcctgagtaggcgtttgagttctttgtatgtatgagatctttccattaatagtatttttcttaaaaagaagtatacaataatgttttgatgatgatttaaagtcaatttatgttgtagttctatgaattaagtaaaccatttatgtagagtgttgtaaatagccttttaaagtgctttctcttttttcttttcttttctttctttctttttttttttttttttttgagacggagtctcgctctatctcccaggctggaatgcagtggcgcaatctcggctcactgcaacctctgcctcccgggttcaaatgattctccttcctcagcctcccaagtagctgggattacaggtgcatgccaccatgccctgctaattttttgtatttttagtagagtcggggtttcaccatgttagccaggatggtctcgatctcctgacctcctgatccgcccacttcggcctcctaaagtgctgggattacaggcatgagccaccgcgcccagcctaaaatgctttcttagcaagtagagaagattgtaataaccagtcttcattaaacattaaataggacccttacagatctctaacagcatatcatcatgtcaggaattattactgagccccagcccctggctttaaaatttgaggtcaaataaagaatatgagtcacacaatgcaaggcaagataatgtaacaggtacaagaggtaaatcagaatgacgttgaagttgaaagacaatcatttcctatttgaatttttgaagaaatacttgaaggggcatggtgtgtttcagtggttttaaaataagtaagttccccccgggagaatattgagaatgatagacatttcttggaaagagaaaacataaggaaagttgaagacacagaaagcatcaatatgacaagtagaaaagtccactttggttaaaacacacagtctgcagagaatgaaagcaggaaaaccaatgtaagaagatctcttgatttctgagtaataaactaaagggccatgagtgattaaggaatttggccactctttagaattaattgggagctatttaactaccttgagcaaaataaatcacgacttttgaaagaaggttgaacgggaagacaaactcagaagctcctgcagtaatcaaggacagaagcaattgttaaatgcacctcttaggctgttatcagtagaaatacgaaataaaagataaatatgcaaaaacattaatggcacaataaacactcacggttttgcctttagacttgagatacactaaaatctagatttaattaatcgacttggacgttggaataagatagtaaaactcacaacaaaactttgtagaacttagtcaggaaaagaatctcaagcatagctttaaaaacagaaattgccccgagtactaaggatgagcaataatgaaattaaaacatattgtaataacattacacaaactatattggagactacaaagaagagattattcatagattataaagcttggaaagaatcaaaacaacacatttctggaaacagattgtataaatgctacaaaagagaaaaatatattttctccccacgcaacacaagaccttaaagtcaattctcgcttttcttgcaatattttataccttttcaattcatagaattactcaagaaaactacctcagttggttgctactttttgttgattccttttaccagacatgactaagtttctttttcatcagtagatttctgggctcctatattcactagagattgcaactcctggatttctcttacactagaatcctatttcgagccatatgggagattctgaattccagaacaaaagaattttgtaatttaaaattcgtgattgctcaatggaatcattttaattgttacttcatttctgtcgttatttaaaacttaagtggagagttttctcagggataagaaaaccacaatcaaggtcatacaaaacttttagaggcagtcagtctgctaagaaggctccagcaagagaaacgggatcttctgtttcaacaatcattacttaagaaaaaattaagaaaatgaaataagttttgcagaataactgtgaaatttttattcatgaaatatgtacttacactttgggccacgtgatgtcactctttgccgcgatgttctctctgaatccagacaaatacagcccttttcccatgggaaagaggctcaattctttttcactctctctgtgctgaacgatggcgaacacagcagaatgggactgacgaaatcagatgatttcttctaatttggaggcaattttcactaattagaagaagactgagtatttgaaatgttatactcaagtcgaggagatccagagggtcagcctctactgctctcgcttctgatcctcgcaatgtgggtggtggggagcggccagctccactactccgtcccggaggaagccgaacacggcaccttcgtgggccgcatcgcgcaggacctggggctggagctggcggagctggtgccgcgcctgttccagttggattccaaaggccgcggggaccttctggaggtaaatctgcagaatggcattttgtttgtgaattctcggatcgaccgcgaggagctgtgcgggcggagcgcggagtgcagcatccacctggaggtgatcgtagacaggccgctgcaggttttccatgtggacgtggaggtgaaggacattaacgacaaccctccagtgttcccagcgacacaaaagaatctgttcatcgcggaatccaggccgcttgactctcggtttccactagagggcgcgtccgatgcagatatcggggagaacgccctgctcacttacagactgagccccaatgagtatttcttcctggacgtgccaaccagcaaccagcaggtaaaacctcttggacttgtattacggaaacttttagacagagaagaaactccggagcttcatttattgctcacggccaccgatggaggcaaacccgagctgactggcaccgttcaattactcatcacggtactggacaacaatgacaatgccccagtgttcgacagaaccctgtatacggtgaaattaccagaaaacgtttctatcggaacgctggtgattcaccccaatgcctcagatttagacgaaggcttgaatggggatattatttactccttctccagtgatgtttctccagatataaaatccaagttccacatggaccccttaagtggggcaatcacagtgataggacatatggattttgaagaaagtagagcacacaagatcccagtcgaggctgtcgataaaggcttcccacccctggctggtcattgtacacttcttgtggaagttgtggatgtaaatgacaatgctccacagttgactatcaaaacgctctcggttcctgtaaaagaggacgcacaactggggacagttattgccctgattagtgtgatcgacctagacgcagatgccaacgggcaggttacctgctccctgacgccccacgtccccttcaagctggtgtccacctacaagaattactactcgttggtgctggacagagctctggaccgcgagagtgtgtccgcctacgagctggtggttaccgcgcgggacgggggctcgccttcactgtgggccacggccagggtgtctgtggaggtggccgacgtgaacgacaacgcaccagcgttcgcgcagtccgagtacacggtgttcgtgaaggagaacaacccgccgggctgccacatcttcacggtgtctgcgcgggacgctgacgcgcaggagaacgccctggtgtcctactcgctggtggagcggcggttgggcgagcgctcgctgtcgagctacgtgtcagtgcacgcggagagcggcaaggtgtacgcgctgcagccgttggaccacgaggagctggagctgctacagttccaggtgagcgcgcgcgacgcgggcgtgccgcctctgggcagcaacgtgacgctgcaggtgttcgtgctggacgagaacgacaatgcgccggcgctgctgacacctcggatgaggggcactgacggcgcagtgagcgagatggtgctgcggtcggtgggcgccggcgtagtggtggggaaggtgcgcgcagtggacgccgactcgggctacaacgcgtggctttcatacgagctgcagccagaaacggccagcgcgagcatcccgttccgcgtggggctgtacacgggcgagatcagcacaacgcgtgccctggacgaaacggacgcaccgcgccagcgcctactggtgctggtgaaagaccacggggagccagcgctgacggccacggccactgtgctggtgtcgctggtggagagcggccaggcgccaaagtcatcgtcgcgggcgtcagtgggtgccacgggccccgaggtgacgctggtggatgtcaacgtgtacctgatcatcgccatctgcgcggtgtctagcctgttggttctcacgctgctgctgtacactgtgctgcggtgctcggcgatgcccaccgagggcgagtgcgcgcctggcaagccgacgctggtgtgttctagcgcggtggggagttggtcgtactcgcagcagaggaggcagagggtgtgctctggcgagggtaagcagaagaccgacctcatggccttcagcccgggcctttctccttgtgctggatctacagagcgaacgggagaaccctctgcttcctcagattcaactgggaaggtgggtttttctagcattttatttatttatataattttttttcttgaaagatattatcgattactcccaggggccgttcaaatagttttattcatttttctagaaatccagcagattttttttctgataaagtaaaccccttaacattggagccgactttgtcttgacttctagtgagaattataaactgtatattaaatagatattttttgggtgctgaatcaattttatttaaatttgtgattaaagtgacattgaatttctgatgctatgctgccataacacttgaaaaccaatttagttgttagtcattcattaaacattaacatcactatcatttatttattgctaaatgatgcatagtattttagtctacttgtattgtttataagaaacccaagcaaaaatatatagcaattgttaccttgttaagtttgtagttctctacatttctctggatggagactgtgaacatctgattgttcagcaaccttcagtatctattattttaataagaaagaaacttcccctaaactttagaaaacagttgctccactttaggaatcaaattatgtcaataaatgttataaacacagccttcatttcaacttatataaaatatgttttaaaatgcctgacaatgtagataattcaagaaatgttgactgaaattttgtctacacttagaacattttttgaaattcagtttacagaaattggagaaaatgctttttaaacaagtgtttcctttcttcaagaagatattctccttttaattgaaattttctccattcagtgataaaatgatcagccatgtgaagattcgaaacttcgagttcttttgaaattcagagtctgtaacttaaaacattacccttatgaatttagatgagaattcacttgttctgtcagtaatccataagacagaaatctgtttttttaaaaatatctttttctcctctcagctcatacataacacaaggcagaaatctggatatgagatttgcctctttaatgtcactacatgttatgtttcctgaattgtagtatgtgactttcaaaatggtggttttccacactctacctttagtgcaagctatttgtttgttttctaatttatagttttaaaaacttcgcttattgagtttttgttatgtggtttatatttttctttctctttcagctattttatttaatattgtgtcagatattttacaaggtatgacctaattaaaaactcagtagagaaagatcagaatggccttgagaatagagccacaaaaataactatgaaaatgccagtaacgtttatttaaaacaaaatattttaatttttaaattttcccttaaaacacacttttggaatatgctacaatattacatgttttttgtctttttatttttctgagacggagtcgttttctgccacccaggctggagtacagtggcatgatcttggctcactgcaacgtctgcctcctgggttcaagcaattctcctgcctcagcctcctgagtagctgggattataggcacatgccaccgcgcccagctaatttttgtatttttagtagagatggggtttcatcatgttggccaggttggtctcgaactcctgaccttgtgatgctcccacctcggcctcccaaagtgctgggattaaagctgtgagccactgtgccaaggcttttttattttttttttttgtcattttctttcaaaacttgagtggtctctgagctcctgtcattaaacctatctatatctgtctatcagcacaactcaccttgaatatagtcttatactttcaagtatctttgtctttgcacgtttttcaagtttcatgtgccatttaaacttggacccaggtatctgattatttgatgtgaatagagggatgctacagatgtcatttgtctcccgccctaagtcctccagtctccttagagctagtacttactaagcatttactatgtcatcaataatcataaaacgtatttttttttttgagtcagagtctcgctctgttgcccaggctggagtgcagtggtgccatcttggctcactccaagctccccctcccgtgttcacgccattctcctgcctcagcctcccgagtagctgggactacaggcgcctgccaccatgcccgcctaatttttttgtatttttagtagagatggggtttcaccgtgttagtcaggatggtctcgatctcctgacctcatgatcctcccgcctcagcctcccaaaatgctgggattacaggcgtgagccaccgcgcctggcctaaaatgtgttctttattattgacggctgtattgatgggattggtaatttagtccttcatattaatctctattctctctcagagtacaagctctcatcatatgcaaattctcagaagggctgtgaacaccttagtaataaatttatcttttgaggtcattagcaaacatgaactcacagggatccagagatggtaaaattcaaaacagcctgtcaagttcaaaacagagaggtgaaagcagaagagacactttcctattttgcctaataggtctccttatatgcatctgtagttaacattcctcaattcaagttagaatcatgaaacaataatgaagctcctcctatgtctcttttcaagttgtaattactatataggaaaaactaagttgtcacccaatatcttagacactttgagagcaaagggggtgctgtaaataagtatacaagatcacagacctaaattgagcctgttccagacaaattggggcctatggtcaacctatccttagacctgctaacgcattagcattagcagcacctaagtcctcattgaatgttctggttcaaggctccacctcagaaattctgaaatgggtagtaagagcaaattttcattttaaagcacacctgagatgattctcatacaaccgaaattttagatccatagccctatttgatacttgacagtgcaagtttctgtaatttaaaaagatgtggtggcctgacacctgcaatcccaacattttgggaggccaaggtgggagggtcccttccttgagcccagcagtttgagaccaatgtagtgagactcatctctgccaaaaaaaaaaaattagccgggcatggtggcacacatctctagtcccaattactcaggaggctgaggcgagagaatcgcttgagcctgggacattgaggctgcagtgaactgtgatggcacaactgcatttcagcccgggagacagcaagattctgtctcaaaaaaaaaaaaaaaaagagtagtttaactactccctactttttattcaatattggacatctacattgggatatttatgttatcacttggtataaaatgtacattagtagaaattgagtttagtttttattattttgtgcgtggagatgattgatcaatggcaaacttattttacgctccagatagctaaaacaaacgttgatattttgatacataactcattacattttaattcagggtttataaaaaagtaatctctaaaatcagaatttgaatgaattttgatgcaagaggcattccagaggagtagagaagtatagaaacagaatttagtaggacacataaactgatggattaagtgacacccatttctgtcagttttcttattcataaatattgttgctctgtcattcagattttaataaaaaaagtttaaagtaattgacacatttaaaaatattctttagaaaagtcaaaacatcattaaataaaataaattaacccttgcataagaccaatatgtctgttgttaagttttcctttcttggaaagacagaaaactcaagtttttttcagcagcacagatatattacattttcattcctgaatatttgatttcaagaactttgagagagaaaaaaatatttttactgcaagtggtgatgaaaaacttcactgacattgataaaattactagatatatttcagaactgtgtcttttgggcatttgaaaagcgtaaatataacagggttgaaagcatttgcctctgaaagcagaaataataaatttcttaattactttattcagaattataattaagattctttttgcccgtgtaagatattataaaatgaaacttcttgtataaaggatttttctgtaatagtacttttctgttttcttaaatacagaaaccaccactctcagcctgtgcagtagcaataattaaggcattctataggtaataattttgcctgatgagccaaatttggtattgagcctcatgaaaacaaatgtggccaaattgaggcctgagaatagtttccatttatgaagcactcattctccttaaggtactattgcaagcacttactatattataattcactcaaccaccgtattactattaggccaaagttataaaattggaacatgagggagggagaggttaaacgattttcccaagtcatgtggctagtgagtaggataataggaatctaaatggagaaatgtctgatgttgaagctaatgatctctaaattctagtgatgactagatcttcggagttataaacacctcacagatagttgatgcttgacattagtgtctaaataaaccttattaaatctcaaaataatgagaaagagaagtaagttaagtgtcagaacttaaatggaactaaagttgtcatttaataaaatattagtatactcagtagtatgcaaatattaagggcattttgaaattcggctattgataatcatgtggttagggaagaaatcactactctgagagtctacatttaagaaaacattgcacgtgggatcaacatttattgttattaactataaagagacgtaatgtgaggctttgaaagtccatagacataaaaatacgtaaaaaaagaattaacatatgaatgaaagaaaagttgtgaactcatggaatcgtacttacacctaaagccaccggatgtcgctgtcgtccacaaaatagctttttagaacaaaggcatcagccagtttctcaaggactaggaagtagcgtcattctgagatctcagccatttcgataaaaaatagatataagaaataggacagaaaatgtcagatcgtatgtgcgttctagaccgctgattcgtcgatttgtaaaacaagagaaggataagatggtttccagatgtagctgcctgggggtccagtgtctgctgctctcgcttcttctcctcgcagcctgggaggtggggagcggccagctccactactcagtctacgaggaggccagacacggcaccttcgtgggccgcatcgcgcaggacctggggctggagctggcggagctggtgcagcgcctgttccgggtggcgtccaaaagacacggggaccttctggaggtaaatctgcagaatggcattttgtttgtgaattctcggattgaccgcgaggagctgtgcgggcggagcgtggagtgcagcatccacctggaggtgatcgtggacaggccgctgcaggttttccatgtggacgtggaagtgaaggacattaacgacaacccgcccaggttctccgtaacagaacaaaagctctcaatacctgaatccagactgcttgactctcgatttccactagaaggcgcatctgatgcggatgttggagagaacgcattgcttacttacaaactcagtccaaatgagtattttgttcttgatattataaacaaaaaagacaaagacaaattcccagtgcttgttctgcggaagctgctggatcgtgaagaaaatcctcagctaaagttgttgttgacagcaactgatggaggcaaacctgaatttaccggatctgtttctctgctgatcctggtgttagatgccaatgataacgcccctatctttgacagaccggtttatgaagttaagatgtatgaaaatcaagtgaaccaaacattagtaatacggctcaacgcttctgattcggatgaaggaataaacaaggaaatgatgtattcatttagctctttggtcccacccacgataagaaggaaattttggataaacgaaaggacgggagaaataaaagtaaatgatgctattgactttgaggacagtaacacttatgaaattcatgtagatgttacagataagggaaacccacctatggttggtcactgcacggtcctagtggaactactggatgaaaatgataattcacctgaggtgattgtcacttctctgtctctcccagtgaaagaagatgctcaagtgggcaccgtcattgccctaatcagcgtttctgaccatgattcaggagccaacggacaggtcacctgctctctgacgcctcacgttccgttcaagctggtgtccacctacaagaattactactcattggtgctggacagcgctctggaccgcgagagggtgtcggcctatgagctggtggtgaccgcgcgggacgggggctcgcctccgctgtgggccacggccagcgtgtctgtggaggtggccgacgtgaacgacaacgcgcctgcgttcgcgcagtccgagtacacggtgttcgtgaaggagaacaacccgccaggctgccacatcttcacggtgtctgcgtgggacgcggacgcgcaggagaacgccctggtgtcctactctctggtggagcggcggttgggcgagcgctcgctgtcgagctacgtgtcggtgcacgcggagagcggcaaggtgtacgcgctgcagccgctggaccacgaggagctggagctgctacagttccaggtgagcgcgcgcgatgggggcgtgccgcctctgggcagcaacttgacgctgcaggtgttcgtgctggacgagaacgacaacgctcccgcgctgctggcgtctcccgctggcagcgcgggcggtgcagtcagtgagctggtgctgcggtcggtggttgcgggtcacgtggtggctaaggtgcgcgcagtggacgctgactctggatacaacgcgtggctgtcgtatgaattgcagtcggcggcggttggtgcacgcatcccgtttcgcgtggggctgtacacgggcgagatcagtacgacgcgcgctctggatgagactgactcgccacgccagcgcctactggtgctggtgaaggaccatggcgagccgtcgctgacggccacggccactgtgcttgtgtcgcttgtggagggcagccaggcacccaaggcctcgtcgcgggcttcagtgggcgtggcgcccgaggtggccctggtggatgtcaacgtgtacctgatcatcgccatctgcgcggtgtccagcttgctggtgctcacgctgctgctgtacactgcactgaggtgctcggcggcgcccaccgagggcgcatgtgggccggtgaagcccacgctggtgtgctctagcgcggtggggagctggtcttactcgcagcagaggcggcagagggtgtgttctggggagggcctgcccaaggcggacctcatggccttcagccccagccttccaccatgcccaatggtagatgtggacggggaagatcagtctattggaggggaccactctaggaaggtgggttattacgttttcattttccttttgtgctttatgaataatattttctcttaccgcattttctcaaatatgtatcagaatatttcatttttgtctacattccatttatgcttgaatatttctagtgatacctttgtaatataatttattccaggagttttaaaatttttttatcctacccagtgtgtcagcctttgattggtacttaaatttttttaaataacaatttattctgaatacactaatattttccaatacaaatatgtgatataggttgcagttctgacgatttactttcataatcacttttcgttacaaatatttgtgagattagtacttcatgttatttcatttccaatctaaattttgatttgattgtatttgcattaccaaaaaattccactgatctatatctcttcagtgaaaatgtgttttcctccatgtgtagaatatgtgtagcgtaccacagcttatactgccatagtagatttcaatgttcagtgattacagctttttctcaatagtgcagtaagtaggtgggcagttcattggtaaaaatttcttaatcttagcaattaagttaaatgctttgaactttaaaaacgttttccatttttattttagttgtagtggtacctgtgtcagtgtgtattattcacttagcagaagaaaatgtatgtttcttttatttacataattttatccagtagctcttcattatctgctcctttatcagcattaggcattgcttatgatattcaggtattagctctttcactttaaggaaggagtcatgcttatgtttaataatgaagagaatttgaacactttttacttttgagactgaaaatactttagtatgaattaatattaaaagtttgaggagaaaataaaattaatgttttctactgatctgatatattgtatagtttaatagcttctctagtcatcttaaacagggttgggttagatgatatagactcagaaatgaaagctaacttagttgcagagtgacaaaactacactatcaattgtgttttcctgaaattggttgttacctgatacccatgatttcatttttaaaaaaaatttattaattctagtgttaccaaacaccaatgccatgaatttgtcatcttgcctatggctcttagcaattacttttttctttcctttctctttgagtatggagattgaatttgttactcagtacgtgcttcacaaatagcttcaaataaaattaaaattattgttcaagtttaggaacaccaaaaaaaaattgtggcaagaatttaagcatggcattctttcagtgttaatactctccatgccctgtctccagctcttagaaattatagatgctaagttaatgcagagtttagaagtgtatttgttattttatcaaataggtttatgaaatatatacttccccctctgatattttgaaaaaaaatcttccttaatgtcttatattataagtaatataaaaaacttagtaaaaactcatatcaattgtaaaagtctcaggtatacaagtgcattaatctctccatcaatactaacttaaggccaggcatggtggctcacacctgtaatcccagcattttgagaggccaaggtgggaggatggtttgaggccaggagttcaagaccaacctgggcgacatagggatatcttgtactgtgtgtgtgtgtatatatatgtatatatgtgtatatatatatgtatatatatatgatgggctctccttacatatatatctatatatgtacttatgtatatataagccaggcatggtggtacatgcctttagtccctactgtagtgctacttgggagggtgaggtgggaggacggcttgagcctgggaagttgaggctgcagtgacccatgattgtgccactgcactccagcctggatgacaaagtgagaccctatttcaaaaattgaaaaaagcaaaagcaatagtaacaccattatcctgcaaatatgatctttttcatattaattcacgtgataatacagttggtgcagtagtactttatttaggatgtctacatacaagataaaactcttcatggaattctgatttgtaagacaaacccacctttgaagaggtactgatcatacacaagaaggtataggaaaggagttggaagctcacaaagagaaacataaacatatgcaggaatcaggaacgaagaagataagtgaaataatatgaaatcaaatgcacttatgttttgagcgacaggatattgttgttctccatgaaaagtttttttggtttttttgttttttattttttatttttttgagacggagtctcgctctgttgcccaggctggagtgcagtggcacgatctcggctcactgcaagctccgcctcccaggttcacgctattctcctgcctcagcctccggagtagctgggactacaggtgcccgccaacacgccaggctaattttttgtatttttagtagagacgaggtttcaccgtgttagccaggatggtctagatctcctgacctcgtgatccaccggcctcggcttcccaaagtgctggccgagtgccaccgcacccggccgaaaggtattttttttaacagaagaaaatcagattattcctagatcagaaagaagctccattgttcctgtactttaaaaactacaaacacccattaagaccacttggaacctcaggaacaaggaccaaaaggtctcagaggaactaagtctttctagtcatgaaatattgttttactaaccaaaagagaggcataattttagctgctagacaaagtggccaggaatcccggagcctacagcactggcttctgctccttgaattttgtgaagcgggaaaggaccagttccactacaccatcctggaagaggccaaggacggcacatagcgtcttcgcggtccctattgcgcaggacctgggtctggagcttgtggagctgataccgcgcctgtttcagttggattccaaaagccgcagaaaccttctggaggtaaatctgcagaatggcatttttgtgagttctctgatagacctcgaggagctgtgtgggaggatctcggagtgcagcatccacctggaagtgatcgtggacaagctgctacaggttttccatgtggaggtgaaagtgaagaacaataaagacaacctgccagtgttctcagcaacacaaaagaatctgtttctgaaacgagagctcttgattatcgtgtttcactagagggtgtctgtgatgccgacgtcggggccaatgctctgatgacttacatactgtgccgcaatgattatttttccctggaaataccaagagcaggtaaaaccacttgaaggtgtattttaaaaattctttcagataggtaagtcacttcagagctactcttggtgctcaaagcaactgatgggggcgaagctgagctgacaggcaccaaagcattatatatcacagcgctggatgtaaatgatgatgcccagtgtttgacaaaggagtctatcatgtgaaattactggaaaatgcaagagaaggtacactggttattagacttaaccccttggattttgacgagggttcaaaccgtcacattgtttctttgcaactgatgtctcccctaacatagaagccctttttcgcatagattcagacagtggataaataaatgtaaagataggttttgaggaaactaaataatgaaagattcaaatacaggcagttgacacaggcaattccccaatgtttgatcactgcacagacttgatagaagtcttggacatcaatgatagtgttccagagttagcagtaagtcactatcattccctgtacaggaggacgctccactgggtaccgtcatagccctaatcagtgtaattgaccctaacttcagtgccaagggacagacgacccgcaccctgactcctcacgtctcttcaagctggtgtctaccttcaaaaggcgctgcccagaaactattcgttggtactccacagcgccctggaccaagagagcaaatctatccattgttggtaatcgctcggaatggggactcgctttcattgttggccacagccatcgggtccgtggaagtggccgaacagtgaaccacaatgccctggcgttccagcagcccgagtacatggtgttcgtgaaaggtaacaacccgcggggctgccacgacttcacagtgtccgcgcgggaccgggacgcgcaggagaacgtgctggtgtcctactcgttgatggaacagcgggtgggcgagtgcgcgctgtctagctatgtgtgggtgcacgcggagagcggcaagaggtacgcgttgcagccactggactacgaggagctggagctgctgcagttctaggtgagagcgcgcgacgcgggcatgccgcctctgagcagcaatgtgacgctgccaggtattagtgctggaacgacaactttgtctgcgctgctggcgccttgggtgggctggcggcgctgtgagtgagctggtgcggtattcagtggatgcaggccacttggtggcgaaggtgcgcacggtggactccagctatgacgcctggttgtcgcaacagctgcatctgtcagctggcagcacccgttccacgtggggctctgcacgggcgagatcagcacgacgagtaccctggacgaggcgaaagctacgcgccaccgcctgctggtgctggtgaaggaccactgcgagctggcgctgactgccaccgtcaccgtggtggcgtcgctggcggagagcagccaagcgaggaaggtcccatcgcgggctttggcgggcgtcgaggtccgggaggcagcgctggtggatgtcaacgtgtacctgatcatcgccatctgcgtggtgtccagcctgttagtgctcacgttgctgctgtacacgacgctgcggtgcttggcgcagctcaccgagagctcgtgcatgccgggcaagcccacgctggtgtaccgcagcgtagtgggatctggtcttactcgcagcaaaggagattttactctggagagtcgcctcccaaggtcaacattacggcttttagtcctagtgttctcccatggttcagattttggagatggacttcaataggaaatttttgagaatataagtactgtaatcctggaaagtatttcattcctattaatgtccctcatagtgacattgataatgttcaccaagttattaatttgattgctttatttattttgcttttgctttttcttttgagatgctttatttaaagtacactggggccgggtgcggtagctcatgcctatttgtaatcccggcactttgggaagccgaggcgggcggatcactcgaggccaggagtttgagaccagcctggccaacatggtgaaactccatctctactaaagatataaaaaaattagctgggtgtggtggtgcgcacctgtaatcccagctactcaggaggctgaggcacaagaattgcttgaacctaggaggcagaggttgcggtgagcctagattaggccactgcactacagcctgggagacagggtgaaactctgtcttaaaaaaaaaagtacattggaagtctagccatcttaatcactttttactacagtcaccatgaacattctttaggaatattcttcagttgataagtataatgataatagtaataatgaattagactgagtggctgtttcctgtaaatgagaaagttaaatcttaccggaaggatcatgatgaataatgatccttatgagaaggtcaaatcttctcaattttgaagcaagttctttattcctattcattttcttattctgatttgtgtcctccattccttattgtttttatgtattcaaaaataccatgacaatatttaatatcataattatttgagtttaaaacatgtttaaatgtttatctttctataatcgataagtttatctctcacaaatggtgatgagcagggttgaggcagcttcgtccacaaacaattttgtttcttcatgatcaatatccatcttttttgagatgttgattgcagtgggtggaattttagccttgcctttaaaggtgattttacttcttaatttttgtcttcaatcttcttataatttcattttaggtcattgtcttcacaatcttcaactacttcagatagccaacaactttgttcttttttaaaaagaaaacaaaacaaaacaatgtcagctctacttaattacctgttgacttaattgctgctgtcctccagtttaagttgttgagctcttctactattttgggaagatttctttgagcaccgattatactcatttttctttcatttttggtacctggctgtatgaaaatattttagggtaggaaaattcacacttatttgggctttaagtataagagagtcttcccatacatgatgaagggtgataccattgtctgtgttcattaagctgcatggtcttcagaatggcattgctgagcttggcagggtgtctcaggcctgtaatcccagcattttgggaagccgagggaggaggatcgcttgagaccaggagtttgagaccagcctcggcaacatagtgagacccccatctctaccaaaaaatgtcattgtttttaataacttaagtataagaaccatgggatattaataaaggcacttccacttgacaattgtggtgttaattataccttagaatttaacattgtatacttttgatatatttgatgcaaaatattttttgccttcacaccatattaatgtgaattgctttctttaaagggatcccagagaacacgtatttatagctgtaaggatgtgtatcaaattatatgtaaaattactttgctctttttggctctaattacaaatgagatggcctttaattctgtgtaaagaaatagtatatttacatattgcaggataaccatgttataggtagggtaaagttaatataaatgctgaaaaggaattagtagtgtctacctagaaaaataacttctgagaagatgatttctatgaagataaacattaaggaaatcttcagaaaagggaaaaccctgtcctactttatggtgctggaattctcttcatccatagctataggacaagagccaatattgatcagtaactcatgataataaatcaccattgtttgagcagtttattaatatatttgttagacatcatgaagggacttaaatacattatttcatttaatacttataacaatttctaaagtacatatgactgttccaatttgaaagataaaataagagaagctgagatgtgtatctattttatccagtgccagtacatggtggagatattattcaaatgtgtatctttcaggcttcagactcattcttttatccactataatgtagagctttctttagtaagtcatttctctgctcaaacatggtctcggctaggaaaatcaagcacaaattgtgtacaggcaaatctttctttctgttgtgcttagaagaaacttcatgattgtcttcatcattaattttgtacaatgtgtgattgagatggcactaagtttttttatgttaagtgatttttttcttgtaagagttcgtgatcatcattatcatttgttttaatcaatgccacactgagataggtattttggttatgtaattgttaagtaattaagagttgccttataagaactacgtatctgttgtttggaagtgatataagtaagaatcgtttaacatgtaagaaaagtcagaaaactgtggtttccaatatccttgtggaacacctaaactaaatactatataccaaaaatgacacccttctttctttactgtgaataaagacagtgtttgggacaagtatagatgttgatattattatttcagggaccctgaacttggccaaaggattcaagaaatgtttacaatattgcatacttcaataacaattttaaagacatagattcccatgaaaatcttcaaatgtgtgtaggtctttcagtcttcttcagtcttattgttggctgggaagctcataacaactgacaaatgatttgtgaccaaataactgtttttacttgactaagccatgatagagcagaattagcatcacggaataaatcctataattttgttaatacagtggttggataatgtaattctaatctgttggttttggagaacctcctggggttctgacaacggtgtcaaaatttatttatgtgttttcaagaaataatagcactaggtctgttagaatatcagtggatgacgtgcactagtaagacattaaactatgcactctaatacttatatgactaacaggacatacaggcagattgtatgtcctgactgatatagtaaaagtcaggcacaaagttccttaatcttcaattgattttacaaaatcagttaacaataactgtattgaaatgacttcttggtattagcctatacccagatattaggctgatcctcaaagatgagttcaaagggcgcataatctcttcactaggggctggttgagatggtgacatctgaaatatcacagccaaaatgcaaaagatgggtcattgattcatacactatatcaaactcttttatgacttggcgtttgttcagtactactttatatattcacaaaatactgtattgttggaaattaacacctaaattaacatattgttttaattcaaatatgtgatattatcatttttccagagtaaaccttctaaggttcatttccctacctcgcaagactccacattccatgtaacatcttcatccccaattcccataataaggtgattgaggatctgttgtttccttttgttcaaaataaacctgatgtgcttcaaatatcatgttgaatatactgtcatctggtctaatgttatgttttgattagaggctactatgattgattattttacagatgcgtaatggaattaacggttataaaagttgatatgtctcctttaattttttaatacagaattttgcatttacctgaattagagttctagtgttatgacaacattgggaaaagagtaaatatgaaaaaagtagaacaaaatctcaaattaatagttgaatatatatataaaatattagcatacacatatgataactttttcatatgcccttgcagtatttttagattggagataaaccatcaaaactatagaacaaaatatttaagctagagtgatatttattctaaatcactttctactctaaaattttgttgcatcttctttttttcctcctaaatcctaagggtatatgaaaagacaaagaaaattcaagcaagttacaacttcaggcaaagaaaactctcataagcaattcctgtattttacttagcattttctatgaaattccatttccacaagcactaaggtaatttaccatttagttgaattgtttgattaattttctatgttttaagcacaatatcaggtacttacagaaggtataattaaaaatcacttcccttgttttccatgaacttctgctcccaaacccaaaattctttcaacaagaaacaaactattttcatgaatataactgaattagattaaggaaaccaatgttggtgacttggaaataccaatatggcacaaagatgttcagggtgattttatttattttataaaatgataataaaatttattttatagttgaaaagcctatttctgtcatatcattgattctgttacataaagtgctaaattttgatatctcatattatgctactatggcttacattagaaataatatatgtcaaataaaaactcatctagatcaatagacttttcctttgtggattcttttttaaaactaccaagtttgagaatatgaatatatttgtttttcatattgttctgcaatgaatataaagtcacttataatcagaaagcaattaaatgtaaataacagtaaagaatgagaactatagaaaatagatatgaaaatgcaagcccacagagatgagaatagatcatgtggaacataaacactaaagagctgcttttataaaacttcaattttttctttgagttccctagcagccaaagtaacaagggagactgaaagtaaaacaattcaaatttgatagtatttttatatgaggaacaacactttcaggaaatgtttaaccctagtttttcatgaggccaccttaacaactgaattctctttctctctcactctgtgtataagtattttagataagtaaaagaacaatgttataatgttaagtcaaacatagacacaataatttaaatttgatgttaatcgagaaatacaatgccatttccatatatatttagtttcaatatgacttataatctgaatattccataaataagcacgttggaaatatttgggggaagaaacccaaaacacgtgaaattctgtggtggtaaatgcagtgcacagtactcacagttttaggcgcaaggtgtcgctctttacttggtggaaagttcatttaaaggttggtctgaacagtgaggcactcccatacaaaggaactccatcataccggatgccaccgtttaaggatcctttgaaacttcttaagaattcaacgagatttttaacctgaaactgaagaatctggtactgtaagtgtaaagaagcttattttggaagccaatttcgtatgcgatgtttggttttcagagaaggggattgggcaccccacgactacagctctggcttctcctcctcgaattctgggaggtggggagcggccagctccactactccgtctcggaggaggccaaacacggcaccttcgtgggccgcatcgcgcaggacctggggctggagctggcggagctggtgcagcgcctgttccgggtggcgtccaaaacacatggggaccttctggaggtaaatctgcagaatggcattttgtttgtgaattctcggatcgaccgcgaggagctgtgcgggcagagcgcggagtgcagcatccacctggaggtgatcgtggacaggccgctgcaggttttccatgtgaacgtggaggtgaaggacattaacgacaacccgccggtgttctcgctcagagaacaaaagctgctgattgcggaatctaagcaatcggactcgcgttttccactagagggagcttctgatgctgacattgaagagaatgctctattgacctacaggctaagtaaaaatgagtatttttctttagattcaccaacaaatggtaagcagattaaaagactgtcacttattttaaagaagtctctggatagagagaaaactccggaacttaatttgctgctaacagctacagacgggggaaaaccagagcttactggcaccgttcggctgttagtccaagtcttggatgtcaacgacaatgatccagagtttgataaatcagaatataaggtgagccttatggaaaatgctgctaaagaaactcttgtgctcaaactaaacgccacagaccgagacgaaggagtcaatggagaggtaacatactccttaatgtcaattaagcccaatggaagacacttatttacactagatcaaaataatggagaagtgagggtcaatggaactttagattatgaagaaaacaagttttataaaattgaagtacaggctacagataaggggactcccccaatggcaggtcactgtacagtctgggtggaaatcttggacaccaacgataactctcctgaagtcgccgtgacttccttgtccctcccagtacgagaggacgctcagcccagcacggtcattgccctgatcagcgtgtctgaccgtgactcaggtgtcaacggacaggtgacctgctcgctgacgccccacgttcccttcaagctggtgtccaccttcaagaattactactcgttggtgctggacagcgccctggaccgcgagaacgtgtgggcctatgaactggtggtgactgcgcgggatgggggttcgccttctctgtgggccacggccagggtatccgtggaggtggccgacgtgaacgacaatgcgcctgcgttcgcacagcccgagtacaccgtgttcgtgaaggagaacaacccaccaggctgccacatcttcacagtgtcggcgcgggacgcggacgcgcaggagaacgcgctggtgtcctactcgctggtggagcggcggttgggcgaccgcgcgctgtcgagctacgtgtcggtgcacgcggagagcggcaaggtgtacgcgctgcagccgttggaccacgaggagctggagctgctacagttccaggtgagcgcgcgcgatgcgggcgtgccgcctctgagcagcaacgtgacgctgcaggtgttcgtgctggacgagaacgacaacgcgccggcactgctggcgactcaggctggcagcgcgggaggcgcagttaacaagctagtaccgcggtcggtgggtgcgggccacgtggtggcgaaggtgcgcgcagtggatgcggactcaggctacaacgcgtggctttcatatgaattgcagccggcggcgggcggctcgcgcatcccgttccgcgtggggctgtacacgggcgagataagcacaacgcgtgccctggacgaggcagactcgccgcgccaccgacttctagtactggtgaaggatcacggtgagccggcgctgacggccacggccaccgtgctggtgtcgttggtggagagcggacaggcgccaaaggcctcttcccggactttggcgggcgccgcgagcccagaggctgcgctggtggatgtcaacgtgtacctgatcatcgccatctgcgtggtgtccagcctcctggtactcacgctgctgctgtatacggcgctgtggtggtcggcaacgcccactgagggcgcgtgcgcgccggggaagcccacgctggtgtgctcccgcgcggtggggagctggtcatactcgcagcagaggcggcagagggtgtgctctgaggagggcccacctaagacggacctcatggccttcagccccagtcttcctctaggtctgaataaagaggaggaaggggaaagacaggagccagggtcaaatcaccccggacaggtgagttttctacagattccacctatcaggaagtgtatgtgaaattatttaaaatccagttttttttcacggattttttaagggaaagttttatgaataaccagtgttttgaatattgttttagataacaatgtctgttcataaaataccaaatgatacacatcttcagtcttttaatcatatgaataatctggcttctttaaccaataaatgtcctatttctcttaatatttggttagcaaatcctaaaagaaatgagatgcaagagtgactcttctgtagtcacttgagtagaaataattactattttcactaaagtacccatgccccttcatctctaaacttcaattatgaccataataactatggattatttaaatttgctcctctttgtcttttagcagagttttgccttgatatttccacattgttagatcaactggctttgtttttctaaagggaggaggtcttcctatgatgtccaggttggactgcagtggctatttacaggtgacctgtagcctggaactgctaagctcaaagaattctcccacttcagcctccagagtagctgggaatgcagtgccactgcacttagtccattggctttcctaacttcaggcttgtatcaaagctagaatactccattagtatgacatgatttacttttcttttttttttttacagtgttaaacgttcatcataaattcattatatatgaaacaatctttacttttgtctttattcctgtgataatacttgttttcatattgtttgaagaaaaaagttaagccttgcattcttatatgctgctttatggaaataatatgactaaaattctacatgttcttgccaggcaaagtggttcaggcctgtaatcccagctatttgggaggctgaggcaggagaattgcttgagcccaagagttcgaggcctgcctggacaacatagcgagatcctgtctctataaaaaattaaaaaattagccagacctagtggtgcatgcctgtagtcccagtttcttgggaggctgacatgagaggatcccctgaacccaggggttcagggctgcagtgacctatcatcgtgagacccccatctgaaaaaataattttttttgcctgttcttgattttgttccatgaaaaggcaagagatttgtcaactattggatactcaaacaaaatggcatgatttatgattccaaaggaaactaggtaaataaaattattcaaattatctaaacttgctaaagacatgcatatagggctatattatctataatatatgctagttggcattcttccataagtttttcagattcatctagcagagaaaaaattaaatatattaatgtgagtacctactgacaattatcagtttcattcatctcactttgtaactgctctatcttgtaatgccttatctctaatgtttttgaaattttctttccacgtagtatcatcccatctgaagatttgagcaaagatcatttacttctgagtcattcttcatatttagttattcttactacacgtagagtggtggtattacagactttcttgagaatcatatctagctatttcccccccgtatagaggcataacataccatttggcacaatattcaaagagtctatgctgaagcctattcatagactttagatcgagagcttttgtatcataatattcattggctaaaaacattctttaagtattaaagagaaggcaacaatataaaaatataaaatatttcagactcaaaagtgattaaaccatcataccacttatgaaactttataaatataataaaggtgaatattagatagggcatacattactcatctccagatgaaatttttggaataactgaagatcttttaaagacttgggaatgttttcagtacaggttaaaattttgtaaattattattttatatcacataaataacaaatttgcattttagataattcaaattacttggactgatttctgcaaagttgtgtcttttatacttaatgccaagattgcattctatggtataaaattataatttcaatttattttctagtttggttgtttaagtattaagctaaacttagatgttcctattggcttaacaatttgtttaggtcaaagagtatgtgagaactacataacacactattattatttgtttctttttgagatagagtcttgctctatcacccaggctggtgtgcagtggcgcaatctcagctcactgcaatctccacctcccatgttcaagcaattctcctgcctcagctttccgagaagctgggactacaggcatgcaccaccactcctggctaatttttgtatttttagtagagatgggttttcaccatgttggccaggctggtcttgaactcctgacctcaggtgatctgcctgcctcagcctcccaaagtgctgggattacaggtgtaagtcactgagcccagcctattttttaaaattaaagttccttagcatgtatggtacattgaccacttttgaaaatgaaaaataggaaagaaacttggtgatgatattagacaatttaaataattagcctgatgacatcaaaattcaaatatgtttttaattacttaacgttttatagtttatttaagttatcttatacttgtagagccattcttggttactctttcctggtgttgtaaaggtgtcatatttcagttgcctttattattatatgcagtaggaatgaatggcaacaaattattggtttaaagattttgacttgagtattaatagacttacaaaatctatgtgtacttgttcacaatgagttgtaggatcttatctgtttttttctcttaaagctgatcttgaattaatgaataaactcatgaaaggtcttttgatgcccccttgcataacagtcaccattctgattttctgaagagaagcatgtcctaactactaaatgacctgtaggggaagatttagagaaaaagcaaaaggttgatatcaagttcacattctcttgactttagtcaatgagattaggctccaaaaccctttaagagatctttcgcattttagtgctccattgttgctttgggatagtgtgaaatttggaggcttcaactaaacattttacattaaagtgctttacttttgctagagtaaaactttccagaatctattcctgagatttgttttaacatgttatggaaatgagagcagttatgtgaaaagttatcacattcaagcatcaaggaaccaaacaataacgctctccatatttatgatgaattctaactttcatcagatttatgaataagacaatttatataaatgaaatattgtttggtattagacatattttagtttcttatcctttgttaaatacaaattcctaactttctctaaaatcttacgatggagtgcttgtgaaggttaaaagttattgaaacagcggaattgtaagctatataaggggaggggtgctgtatattattctgtatatcattttccatgataaagtgtaggttctggcctactgtatttgaaagatttctactttgaagcagaaaacatttttaagctacagcgtaataaaattgttgatgttttgttactaatatcatgtatattaactaaacccgcatttataaatgatccgtgaaaaataacccaaagtcgaaacattagaattaagagtgacccaggaagtggctaaaccgaaaagaacctcaggatctttcttgtacttacataatcagtcacatgatgtcgctctacactcagaaggtgaaacaggaaaatttttttctccgcacccacattccaatcattcacggaataggatcgactccataatgactgtgatgctggaaaaaatttactaaatatgtacttacagaaaagggtgactgctcataaaatacctcaggcaagcgatcccttaaaactgattgtcccaactcagaggccctcattttctgcaatggtgattatcggaccaagaggcccgggatcccagcgtctgctgctctcgcttctgctccttgcagcctgggaggtggggagcggccagctccactactccgtctacgaggaggccaaacacggcaccttcgtgggccgcatcgctcaggacctggggctggagctggcggagctggtgccgcgcctgttccgggtggcgtccaaaagacacggggaccttctggaggtaaatctgcagaatggcattttgtttgtgaattctcggatcgaccgcgagaagctgtgcgggcggagcgcggagtgcagtatccacctggaggtgatcgtggacaggccgctgcaggttttccatgtggacgtggaggtgaaggacattaacgacaacccgccggtgttcagagaaagggaacaaaaggtacctgtttctgaatctgcgcctctggactctcattttcctctagagggcgcttctgatgcggatatcggcgtaaactctcttttgacctatgcgttaagtctaaatgagaattttgagcttaaaataaaaacaaaaaaagataaaagtatattgcctgaattagttcttcggaagttattggacagagagcaaacgccaaaactcaatttattgctgatggtaatcgatggcggtaaaccagaactaacagggtctgtccagattcaaataaccgtcctggatgtgaatgacaatggtccggcgtttgataagcccagctataaagtagtgttgtctgaaaatgtccaaaacgacacaagagtgatccaactaaatgcttccgatccagacgaaggacttaatggagaaatttcctatgggatcaaaatgattttgccagtgagtgagaaatgtatgttttcaataaatccagacacaggtgaaattagaatttatggtgaactggattttgaagagaataatgcctatgaaattcaggttaacgccattgataaagggattccttccatggcaggtcacagcatggtcctggtggaagttctggacgtgaatgacaatgtccctgaagtaatggttacttcactgtcgctccctgtgcaagaggatgctcaggtgggtaccgtcattgccctgattagcgtgtcggatcgtgactctggagccaatggacaggtcatctgctcactgacacctcatgttcccttcaagctggtgtccacctacaagaattactactcgttggtgctggacagcgccctggaccgcgagagcgtgtcggcctatgagctggtggtgactgcgcgggatgggggctcgccttcgctgtgggccacggctagagtgtccgtggaggtggccgacgtgaacgacaatgcgcctgcgttcgcgcagcccgagtacacagtgttcgtgaaggagaacaacccgccgggctgccacatcttcacggtgtcggcatgggacgcggacgcgcagaagaacgcgctggtgtcctactcgctggtggagcggcgggtgggcgagcacgcactgtcgagctacgtgtcggtgcacgcggagagcggcaaggtgtacgcgctgcagccgctagaccacgaggagctggagctgctgcagttccaggtgagcgcgcgcgacgccggcgtgccgcctctgggcagcaacgtgacgctgcaggtgttcgtgctggacgagaacgacaacgcgccggcactgctggcgactccggctggcagcgcaggaggcgcagttagcgagttggtaccgcggtcggtgggtgcgggccacgtggtggcgaaagtgcgcgcggtggacgctgactccggctataacgcttggctgtcctacgagttgcaaccggcggcggtcggcgcgcacatcccgttccacgtggggctgtacactggcgagatcagcacgacacgcatcctggatgaggcggacgctccgcgccaccgcctgctggtgctggtgaaggaccacggtgagcccgcgctgacgtccacggccacggtgctggtgtcgctggtggagaacggccaggccccaaagacgtcgtcgcgggcctcagtgggcgctgtggatcccgaagcggctctggtggatattaacgtgtacctcatcatcgccatctgtgcggtgtccagcctgctggtgctcacgctgctgctgtacactgcgctgcgttgctcagcgccgcccaccgtgagccggtgcgcgccgggcaagcccacgctggtgtgctccagcgccgtggggagttggtcttactcgcagcagaggaggcagagggtgtgctctgcagagagcccgcccaagacggacctcatggccttcagcccaagccttcagctgtctcgagaagattgtttaaatcctcccagtgaagtaagttattaatattatttagatatatttgtttccttgaagaacttccgtttaggttataactacattctctcatttttctttatgattctatcctttaaactatcgaatgtctcatctttcttggtcattcttactcattttgaacttttatgtatttgtctaacattaatgaaggaaatatgtaggtacaatggaggccatggagcaccacacttaatatttttctttttctataatattttatatgactgatgaaccttgaaaaaaacagtatattagattaaaaagtggccagatgtttgataacttaaaaatttaatttgttcataatttcaagattacaggtaagttgcaagaatggtacaaagagttcctagatcccattaatggattctttaactcttcctcacgtgcttaggcttttaaaatagccttcttgatcactattctaatttcagtacaatctagacattttcacattatattccaggtattatcacaataatataaatgatatgtctgacatatgatgaatgattttcttcattgctcacaaaatatcttctttatttcaagtaggaatagatactgtactattcttatttacatgaaatataataaaatcatttctcaatttaaaaatatttaaccatctgtacgatacagtacagttggtaaccaactgtggctcaaaccagtttcagatgatcccaaacttatcatagtataccactgccctgtgcctattaccaagtgaatcttctaatgtgcattttacatattttaactttctatttctacaaaaatatccagaggcttctctttaaccagggaataaagtcttacataccccagcctggtagtaaaggcattaaaatttccagccttatatctactttcttacatatctttagtttaggatctggaatatagtatatgttcaatcactttttaaaaacatatgggggtcttgctatgttgcacaggctggactagaacttctgggttcaactgatcctccatttcagcctttcaagtagctgagactacaggcaggctccaccactcccagcttcaatcaataattttaaataaatatatggtattgaaatgtattacctggacattcccctctatcttagaaatgagagtatgccctagaaatcagataatgttttattgaagagtgtcttgaaagatagacaacattttaccaagaaagtgttaagagagataagtaggaacaactgcacagtatatggtgtaattgaaggattagagcaggggagattgtgaaggcaggaaagctatttcttttttaataaattaggtatcaagtaatggagacttaaattatggcagtagaaatgaattgaaaaagacatatacaagaggcactggcaaagtagaagcagccagataatgacagactcaatacaaatgataagagaaaaacaaaagtagaagttgactctcacttttttagtttgttcagctgagaagatgacattgccattaaccaacctgcagaacaaggttggagaaacagtttgtgtgtatttgagcaggtagggaatggagatgaacatttaagaaaatgttactttgaagtcctaagagaataccgttgtgattggaaatatgggtctggatctcagaagagattattgatatagattttgggaacaactcctttagagaaaaaaataatccatgaaagaataaaattgccaagacagacattgaaaagtgaaaaacaatgtgtccaggtacttaggtgggtaagtgtgtcgcttcctgtggctgctataacaaacgaacacaaactgggtgctgtaaaacagcaaaagtttattatttctcagtattggagaccagaagtccaaaatcaaggtgttgtcaaggctatactctctttggaggccccagggaagaatctggtttttgtttcttccagtttctattggctgttggtgttccctggcttgtggctgtaccactcccatctcagccttctcagctttcatggtcacattgcctcctcctctccatgtctctctctatgtgttggttttacaaaggtacatgtgattgtatttagggcccatctggataatccaggataaactcctttcaagatccttaacttaatcatattattcaccatataaagtaaaatccacaagttccagggattaagatgtgggcataactttttggggaccacaattcaacctattatagtaggcttaaaatcatagaaggatagacaacaggaagctgaaataaagctcaaagtgcaatatatcaagtatatgttagaagttaaacatgaagggaaaaagataaacagaagaggttttccaccagaagtagaacatttaaattagtgtatgtgcgtgtgtgtatgtatacatattttagttaaagaagtttgactatcttcatagtgtgagtgaaagaaacaagtaaaaaataagatactaaaaataagacaggcagcaggtgaatttagatgaaaaccatgagagaatagaaaataatttttaagagcatatggttgaccttaaaagcgggaacagtttttccttacaactagtagaaaatgaaaacagataatataaggaaaaatgacacaagaagagagcaattgaatttctgtttggtcacatctctcaatgtgtgaatcatctgaaagtgaactgatggaaatgaggttgagaatttgagaagagaggaaagagaatatggaagaatctctgtaagcaagagggaggagttaattatcaattcacttgagagcccaactgaggtaaaggtgagagtaaatttgaagagaatagtcatggttaagtgacaatgttgagcagcttaataggaagcatagagaaaatggattgtcagtgtaactgcgtgttggaggctaaaaagaatgttagaggagtaatataaataggtgaatgactctagagtgtctggaagggcatattttaaatggttgactatgtagtctaattatgtgaagaggtaaataaagaaatgtagggccagatagaaagaattagaagagaaatactatgttagtaaaagtaatggagcaggagaggatgatgagggtaagagaataccaaatactctgcctaaattttcagaggagagcagagctatggaaataaacccaacagtcatttcctatagagttgtgcacagaacaggccagataattattggagctatgatatatttttcattacaccatttggcctgggattttgtggcttggtagagatagttataacaatagataaaagtaagatcctcttcctcttttccttgctaaagatatgttaacatctttgtctagctgttgtttcttggaaaattaaagtcaatttaaatgacggcaaggttttactcagtgatgatgaagtaagatggagagagaaaatggaaactttaacctcctggttaaattctatttaaccaggacgccgattcgggctacaatgcgtggctttcgtatgaattgcagccggcggcggtaagttaaattctattaaatcaataggatattagttccaggcatattttataaaaacagaatccaaaaccttagagcattgttgtggctaaattattgtgtttatgcacatacacacactcacatacaaaatcccacacatattgactgaacactttcttttgaatataaatatcttatctacatctcaagtcacattgagggaaatttattaatatgatgtgcttattcaaaatctgatatatcagttaccaatatttttcaccttcaccgattttattcttatgtgattgttatgtttccttttggagtcaatggctgttgtgtgaggaggtcttgaaaaatattacaggaagaggacagtaccacaaaaacctacatgactatgcagaactaccgatcaattgtcccaaaacgagtgtcgaatattctttgtcttaaagttctgcatggaattcttacacatggaaaaataaatttgtggcaaaatgaaactcatcaaccaattgtcagctaatataaaatgttgagcagaatgcagtgatttgctgtttctgggaaggtaaacatttaatcttcaattacatatttgcagtgaaaatgtcaggaaatgcaaggggcaaaaaaatactacatcaatggaaaatatgaagactgagtcatacttacacttacacgttcatgcgcatggtgtcgctcttcactgagaacgtttccgcgaagaaagccgccgtttctttcttcctgcagaaaatatagcagaaagcggaatacctcttgcgaatccttccgcactaggaagccataaaaattgggccttgagagacagtttgaggtaaggcgttgtatatattgcagatagctctgaggtttttggagtgtaccatgctgtcttcctggcaaggaggcccaagaccgcggcaactactgctctggcttctgatcctcgcagcctgggagacgggtagtggccagctccactactccgtccccgaggaagcaaaacacggcaccttcgtgggccgcatcgctcaggacctggggctggagctggcggagctggtgccgcgcctgttccgggtggcgtccaaaagacacggggaccttctggaggtaaatctgcagaatggcattttgtttgtgaattctcggatcgaccgcgaggagctgtgtgggcggagcgcggagtgcagcatccacctggaggtgatcgtggacaggcctctgcaggttttccatgtggaggtgaaggtgagggacattaacgacaacccgcccatattccctgaaagcaagaaacgaataatcattgcagaatctagacctccggaaactcgatttccactagatggcgcatccgatgcagatattggagtaaactcggcattgacctaccgactggatcccaacgattatttcactttggacgcacaaaacagtcttgagcaaatgtcttcattatcacttgtactgaggaaaacactggacagagaggaaattcaggaacatagtttattactgacagccagtgatggaggtaaacccgagctgactggcacagttcagctgctcatcacgattctggacgtgaatgacaacgccccggaattttaccaatccgtttataaagtgacggtgttagagaacgccttcaatggaacattagtgatcaagctaaatgccacagatcctgatgatggtacaaatggagatatagtttactcatttagaaggcctgtatggcctgcagtggtatatgcatttaccataaatccgaacaatggagaaattaggacaaaaggcaaactagatttcgaagaaaagaaattatatgaaatatccgtggaggcagttgacaaaggaaatattccaatggcgggtcattgtacccttttggtggaagtactagatgtaaatgataacgccccagaggttaccatcacttctttgtcactccccatcagagaagacactcagcctagcgccattattgccctaatcagtgtgtccgatcgtgactctggctcaaatggacaggtcacctgcaccttgacgccgcatgtccccttcaagctggtgtccacctacaagaactactactcattagtgctggacagcgccctggaccgcgagagcgtatcagcctatgaactggtggtgaccgcgcgggacgggggctcgccttcgctgtgggccacggccagcgtgtcggtgggggtggccgacgtgaacgacaacgcgccggcgttcgcgcagcccgagtacacggtgttcgtgaaggaaaacaatccgccgggctgccacatcttcacggtgtctgctcaggacgcggacgcacaggagaacgcgctggtctcctactcgctggtggagcggcgggtgggcgagcgtgcgctgtcgagctacgtgtcggtgcacgcggagagcggcaaggtgtacgcgctgcagccgttggaccacgaggagctggagctgttgcagttccaggtgagcgcgcgcgactctggcgtgccgcctctgggcagcaacgtgacgctgcaggtgttcgtgctggacgagaacgacaacgctccggcgctgctgacgcccggggctggcagcgcgggaggcacagtgagcgagctgatgccgcggtcggtgggtgcaggccacgtggtggcgaaggtgcgcgcggtggacgccgattcgggctacaatgcgtggctttcgtatgaattgcagctggcggcggtcggcgcgcgcatcccgttccgcgtggggctgtacactggcgagatcagcacgacgcgccctctggacgaggtggacgcgccgcaccaccgccttctggtgctggtgaaggaccacggtgagcccgcgctgacggccacggcaacggtgctgttgtcgctggtggagagcggccaagcgccacaggcttcgtcgagggcgtcggcaggcgctgtgggtccagaagcggcgctggtggatgtcaatgtttacttgatcattgccatctgcgcggtgtccagcctgttggtgctcacgttgctgctgtatactgcgctgcggtgctcggcaccgcccaccgagggcgcgtgcgcgccgggcaagcccactctagtgtgctccagcgcggcagggagttggtcgtactcgcagcagaggcggccgagggtgtgctctggggagggcccgcataagacggacctcatggccttcagtcccagccttcctccttgtctgggttctgcagagggaacaggccagagggaggaggactcagaatgcttgaaagaggtaagcttatattttaaaaaattgtcttagtaaacactttagccttccttgcagttgtttgtttaagacatctttcctgccaatttcaaattattctttactttaattttaattttgctagttgttatcgaatttaacaactctgctgtggacattatgtgttggattatccttcagagtgaaatcttaactcacaaaccataatgaaatgtgcaaaacaagaatattttgtttctgttgtattcttaatagttctaagtatttatcttgcaattgagcatttacaaaaaattcctcacgttgtgagaacttaaacatttagaaaatgtttgttttaatgaggctaatcgtaatcttaaatttaaaaaatttttagtttaatgtatacatatacccacaagatattattttaaagagccccataacttttcacataaatgctttttttaagtgcacttttctttctttctttttttaaactgttttgattgtctctacttttttgtcctctaggcacatcagtgttcccctctcatatatcccatgaaaaatatcttgtgattctgctttcaattttttatttgcattcagataattactcatacatatatatatacatatatagagagagacctggtaggctttttgttattatttcttttccaaagtttgaagggatttccaaaaggtactggtgactgaaagtaccttttggcagtccctgcaaatctaatggttttaatagctgtgtagtattccacagtgtaagtgtgcaattatatattatttacctaatgatgggcaatcactttgtgtcaagtgttctgttatcttcatgaaccatgctgtgctatcatttcatatatttcccaaaatattggtgttatttctacgaaattgattgtcagatgtggaattgatgcatcaaagatattaataattttaattataaaatatgtcactggattgccttccaagtattttggaaccaaccagttatgagcactctttctatctcaagaagcaatagtggttttactttctgctaatgtgatctctgtgaaatgatatttcactgttactttaattttaaattcctgtatagtattagtgaatttgagcatattgtcatatgtattttgttgatttgtatttgatcttctttgatttatccattaagttatttgcctacttttctattgaaaaaaaatttttagtttcagtttggaaaagttctctgtaccttatagatattaactgtttatctattttttgacatttttaattaaaatttttattttgagataattatagattcgcatgtggttgaaagaaatagtaaagggagatgctatgtattcttcactaagttttccccaatagtaacatcttacaaaagcgtagggccataccacaacctggatattgacattgatacagtaaagaagtaacatagttccgtaacaaccagattcttgatatcacctttttatagccacatctgcttccctgcctaatgctggcaagcagtaatctgttctccatttctctaattttgttacttttacttcagaaataaataaaagtatctctatttatagataaaattttttaaaattatttttatatttatttattttttattacactttaagttctgggatacatgtgcagaacgtgcaggtttgttacataggtgtacatgccatggtgtgcttatctattatctgcatcacaaatatgttttcctcctatattatttctattcatttgtttgtactaattttgtcatatataaatgtttttaaaatgtatgaattaaaatatatctttttccttttatggattttaaggtctgcatattcagttagaaaggtcttcccagctgggcacggtggctcacgcctgtaatcccagcactttgggaggccaaggtgggcggatcaggagatcaggagtccgagaccagcctggccaacatggtgaaaccctgtctctactaaaaatacaaaaattagcgaggcatggtggcacgcgcctgtaatcccagctacttgggaggctgaagcaagagaattgcttgaacccgggaggtggaggttgcagtgagatgagatcatgctactgtactccagctctgggtgacagagcaagacttcgtcttgaaaaaaaaaaaaaaaaaaaagaaaggtcttcccaactcctatattgaacattcattaattaaatgcatttaataaatacttattgagtgttctctatgtgccaggcatgttctacacattagacatttagcaacgaaatttattattttgtaaatccaaatttccagttggtatcactttcctactgcctgaaaaatttctttaatattttttatagtgcatatgttctggcaacaaattcactcagcttttgtctgagaaatatctttatctctttttttttttttgagacggagtctcactctgtcgcccaggctggagtacagtggcgtgatctcggctcactgcaagctccacctcccgggttcacgccattctcctgcctcagcctcccgagtagctgagactaccggcgcccgccaccacgccctgctaattttttgtatttttagtagagatggggtttcatcttgttagccaggatagtctcgaactcctgacctcgtgatccacctggctcggcctcccaaagtgctgggattacaggtgtgagccaccgcgcccggctctttatctcatttttatttttgaaaaagtattttcactgggcatagttgacagttttttaaaagatataattcagttgtcttctggcttgcatagtttctaataagatgtttgcttttttatatatgagtcttcctctccccacccctcatggttactgttaaaacttttctttttatcctgacttttgcagattgattgtgatgtgctttagtatggttttctttatgttagtctgttggggtttgttgatattcttggatctgtggatttatcattttcatcaaattcaggaaaaaatcaaccatacttcttctaatagttttttctttccttccatcctttctgagactccagtaacacatatgttacaatgacacaggtcattgaagcgttctttatttttgtccatttctttctctgtgcctcattttgaatatcttttattgacatattttccaagttcactaatttttccttttgtagtatcatatctgttaatcctaaacagtgtattcttcatttcagagaccatatttatttcttatctgtataagattctttttgtctcttttaaaatttattttacatgtctccaccgaatagtcatctttttatctatatgtttgagcatattagtacatgtataatagatgttttaactttcttgtctgctaatttcaacatttttgtccttagtttgcttcttttaatctatcttcttctatggatatattttcttgctgttttgcatgactggtaatctctaataagatgctagacattgtgaattttacattgtcggatgctggattttgtgtgtgtgtgcatgtgtgtgcgtgttcctttaaagcagtagttcttgataagaaacagttttgtcccctctaccccctacccaggagataatttggcaatgcctggatacatttttggttattacaactagggaattgctactggcatctaataatggagctctgagatgctgctaaacaccatccaattgctgccaaacatcctaccgtgcacaggacagccgcccaacaataaagaattagctcaaaatgtcagtagttccactgttgagaaactctgctttaaagagtcttggacttagttctgacgtgaagttaagttgctcagtaccaatttattcctttcaaggcttcattttaagatttgttagtacacattcagagcagcttttagtgtagcactaattcggccttctattacagcaatactttcctgaggacaccacctaatgccctgtgcattaagaggtctctcttctctgattggtaggaatgtgaaatatttccagccctttgtgagctctaggaattattctacccacttttttttttaattttgaagggatagcctgatctggggaggttgatcagtgatctgtgatctgtgatcacatcactccactgcagcctggtgacagagtgagaccatgtctcaacataaaaattaaaacattagaattgaggtttaatgttatcaaatattttatctgcatcttttgagggaggtataaattttttctttggcaatgttaatgtgttgaatttatgatttatgattttcttatggcaaaccaacctctacttccttggataaccgtaatttgattataatttataatccttttaatatactacttattttgttaaattttcaaaacaattttttcatctttattccaggtgatactgatatgtcctagtttttcttcctaatttcttctttgttaagtattcaagttataaataagaatctagcataacttgaatacttaacaaagaagaatagtctttgaaaacttccagaaaattttctgtttcctgtaaaagtttgtataatctttgaattacttcttatttgattggagaactcactgttgaagttatctgtatcaggattttgattggtgggaatatttctgattactgactcaattttaatagtataaggaccattcagagtttaatttactcgagtcagttacgtagataatattttttcaggtattttcctgtttaatctaaattttcagttatatgctcatactttctacagaatctatagtgatatttccctttccattcttgatattatttttgcttcctgtctaatttacttttcttcagaattctgctttctgatttttgtttttgctttgaaatatttttatattaattatactgattcatttctcttcttttcatttgtgtttgcaggagatgtcctcttcccagccttttattttaaaccttttagtattatgggcatattccacaagttctttgctactgtctcactgagtagcagagtctaatttttctttccttgaactttgactggtcttaatattggaagtaacattctgggatttatgaagtcaggtcataagaagtcttacagtatgctttggtctctgagaatatttgttttgggggaagcctgccaccatgtaagaattctgactaccttgagattgtcatactgtaaagaagctcaagctggacttgtgagaagccaaatggatagaaaaattactatccagtctccagttgtcttagctttccaagcttaggtgccagaaaaatgtagaaggcttcaggtgactgtagtgtgttggagctggctcttttactggcttatgagaactgataatgcaaatttattcccaactctggattcaatgatgtcactttggtagcttgaaattggccatggtaggagtatttctgccacagaaataggcaaatgctacaaaacagagttttttgtttttcttttttcccagagacctagttgttaagcatttaccagtacactactgcacctgattgcaagcaagaaccactcagttgagtcagaaccaggagaggtaatattaagttgttttaagatattaggtagttgggatggtttactatatagcaatggataacctgaacaagtactctttcttagataatctataaattttaacttgaatatttatttagtttatatttacaatacctagtgatatctttaggcacaaatatttcaattttttgtgcgttatttttgtctcaccatttttatgtctctatttccttcctttgttgatcttcttttgaaatgactgagtactttttattgttccatttccttctgtattatttggaagcccttttccgaatagctagtgcttaccctagaaaattaagcatgtatccttgatatatcaaaatcaaaagttaactgaaacccttcctccttctgggaaatgcagggaccttacatttttaaaatctttttaatcccttttgacttatatactatttctgtcatgctttaaaaatattttaaaaccccataagatattagtattattttatacaatcaacattgttttaaatgtacttacatatttaccagttttgtttctcttccttacttcttgcccctctgacctttcatcagggattattgtctttccatgttagaataatttgagagtttcctttagtccaaagatgctggtgaggaatgatttcaggttttgtttttctgaaaatgtctttatttcatcataattattgaaaagcattttttctgagggtataatcttaggtgtgacccccacagcacatagtaaatattattccagtgtctactggtttccattgttgctgtcaagaatttagctgtcaatctaaatgtcattcctttaaaggtattctgtttattttcctttggctgcttttcagattttctgtgtgtctgatattttgcagttttaccatgctgtgtctttataatcatcctgttctggattcagtaggattttttttaatttttaatttttccgtaagttattgggggtacaggtggtatttgattacatgagtaagttctttggtggtgatttgtgagattttggtgcatccatcacctgagcagtatacattgcaccatatttgcaatcttttatccctcgccaccccccactcttgcccccaagtccccaacgtccattgtataggatttttgaatttgtgaattaatgcctttacatcactttgagcatatcctcagctataatgttctccaatgttgcttctgttccattgtatttctatagtattattttagtactctaattaaacatattttaatcttattactctatcccatctatttctaccttttattttaacaccttttgctctttgggctttattgtggatagttcacccaccttaaagtttaataattctctcttcttgctgttgtctgaatttgtacccccaaattcatgtgttgaaaattcaatcccttatacaacagtgttgggaggtggggaatttcaggaaatgtttagattatgagggatctgccctcatgaataaattaacggcactgtaaaaggacttgatggaaggagcctgtccctctcttatgcttttggctctgtcatgtgacgatgcagcaagaagatcttcaccagatgctggtgccttgatcttggacttcccctaggctccagaattgtgagaagtaaatttccgttctcataaattactcagtctgtggcattctgttatagcagcacaaatggtctaagatacttttatttattctttttcaaatttattgttactttgtataatttctagtttcctctcgaaactttcaagcttggcatttatatctggaacacaataagctcatggttttagcgtctatttctgatatgtccagtaactgggatcctcatgggtctattcctgtggtgtgttttaaaattgtatctttatggtgttttgtctccacataaacctggttatctttgattttgtgctgaaagttgtattaaacacttcttcctggaaataatttggggcttataacattttctttctccagaatggattttaattgacttttgccaggcatcttggggcactagcaatcatgggtaatcttaatctatttcaagcttcaggtattctagataaaacctcattatctaaaatttacatgtattctttaagtacggttattcagtttcctagccaaacatgagagattgtttaagaagttccaccatgactggtagactcaggattctgacttttgtttctctagtccttggagactgtcaaaagtatatctcagtattcattcacctatttttttccttttatttccagttggtacataataattgtacatatttataggatacagagtgacattttgatacatatatacaatgtataataataaaatcagggtaattagcatattcataatctcaaacatttaccatttttgcatggtgaacatttaaaatccactcttctagcttcttgaaaatatgtaagaaattatagttaaccatatttatcctacagtgctacagtgctgcaaaacaccacaacccattcctcctgtgtagctataatttcgtatccattaaccaacctttccccatcctccttttccttcacccttcccagcctctgataagcacaatactacttccatgagctcaataaaattttgtagctgccgtataagtgagaacatgtatttatttttctgtgcctgacttatttcacttaacatatgccctccaggctcagccatactgccatgaataacaggatttcattcttttttatggctggataatattccgttgtgcatatacaccacattttctttatccactcatctgttgatggatattgaggttgattccacatagtagctattgtgaatagtgctgcagtaagtatgggaggtgcaggtatcactttgacatactggtttccttttctttggataaatgcccaatagtggaattgctggatgatatggtagttctatttgtagttttttgagggactcccatactgttttccttagtggcagtgctaatttacatgcccaccaacagcatttatgggacagtggctcatgcctgtaatcccagcacttagggaggcagaggcaggaagatcgcttgaagccaggagttcaagaccagcctgggcaacatagcaagaccctgttcttcacaaaaaagaaaaaaaaagcagttgtagaactcctttaagtatttcttgtaggacttatctagttgtagtgtacttcctcagtttttgcttgtttgggaaatactttatttctccttcatttctgaagtatagctctgcttggtatagtatttttggctgatagttttaaaaaatttcagcactttggatatatcatctcattctatcctagcctgtaaagcttctgctgagaaatctgctgttagtctgatgggaattttcttataggtgacttgtcacttttcttttaccgtttttagaattccctccttgtcttgagtctggtaccgtagactactcagccatcctgatgccctacctcttgtatagaaacaacccagatccaaagtggccagaaagttactttaccttctgaatttgtggtctttttcagaatctctacctgttaattctgcatgactttattagtcattagatacttttataattttaaaatatctccaattgtatggttggttcaaattaccagttctgcatactggtaatgtaagtcctctgttgaattgatttttaaatacatttattttattccagtatcttctagctcctggtgttgcagatgagaagtttcaaataacttgaaataattcccttctatgtaattatccctgattttgactttctttccatagttatatattttttctatgctattatattctcattttaaagatgttgaatgacaatgtaattttcttttctttacaagtggtagcttatttacaagtatttttgaagtttattttcctggaaagttttcttaaattatagattttagtatttcttctgttttattacttcagatttcttcttcaatggctccaattatatttgtattagatattctttgcttttcttttgtagctaacactcctaaatcctacctagctcttttttaaaaaatattttactttttattcttgttttcatcttatagttttctttaggcattatccatagtgtttatatgctgttatgtgccttctggtttagtgtttacttctgaaaaaattattttccttttttttaatattttactgagttttctcatctctcttttcaaagcttttcttctccaatcatatcattactgagtctctctaattctgatttgtgtattcttgcatagcttttcattattttctaaaaatgtttaagttgttttcaaatattacgtagcaatttgtggaattttttttcttgtgtgtatttatttcctttagtgtaattatttgtcctctcctttaaaaataattttatatcagatttgcccataatccttttcttatgctcatttttatatgaaaagtgctcccccataattttagaagaaacagaccaggataattttcctatctttgttgctctatagatttctattcagctattgtcatgaaatgataaaaatataattttttaatgtcttactttgtgacatcctttaccctttttacttggacctttttcctttgtttaattgtcccccacccacaccattctgcttcatatggactcaattcctatcagttcctcctcagtataggggtttttgctacaagaagacatttgttagttgacaagttcatagggctaagacaggtttagcacaatccaatctatttgtagtcccttctgctaagttttgaatttgcttttatttctaatattttactgagttttctcatctctcttttcaaagctttcttttttttcttactcagggataattgaattaggaccttcgatttccccccttccacccatgactattgttctcaaattgttttactatgctttccagtgagtacttattggcactttttggagttcttcaattctcaacaccatcaaaagccccataaccttcttttgcttcctcctgagactcttttcatgtgcttattggtcatttctttatcctcttcggagaaatacctattcagaacttttgcccaatttttaattggtttattcgtttttcaattgttgagttgtaagagttctttatatattctagatgcaattactttattagatatataatttgcaaagattttctcattgagggtgttgtcttttcacattcttttttagctcccacttataagtgagaacatgtagtatttggttttctgtttctatattaattcacttgggataatggcctgcacctccattcaatgggctgcaaagggcatgatctttttctttctttatggctgcatagtattcaatgacgtatatgtacaatactgtattgtattgtattgtatttttttcagacaaagtctcactcttgtaccccaggctggagtgcaatggcgcgatctcggctcactgcaacctccgcgtcccgggctcaacaattatcctgcctcagcctcccgagtagctgggattacaggtgcctgtcaccaggcctagctaatttttgtattttaagtagagacagggtttctccatgttggccaggctggtctcgaactcctgacctcaggtgatccgcctgcctcggcctcccaacatgctgggattacaggcgtgagccactgtgcctggccaatgtactgcattttatttatccagtgcaccattgatgggcatttaggattattctctgtctttgctattgtgaatagtgccatgatgaacatacacatacatgtgtctttatagtagaatgacttatattcctttggttatgtacacagttatgggatttgctggcttgaatggtaagttctttgagaaatcttcaaactgctttccacagtggctaaactaatttatattcccgccagcagtgtataagcattcccttttctctgcaacctcaccagcatctgttatttttgactttttagtaatagccattctgactggtgtgactgcaacctccacctcctgggttcaagcggttctcctgcctcagcctcctgagtagctgggactgtgcaggcacacaccacaaagcccagctatttttcttttttttttttgtattttaagtagagatggggttttgacgtgttggccaggctggtctcgaactcctggtcttaagtgatccacctgccttggcctcccaaagtgctagtattacaggcatgagtcactgtgcccggccctttgcccattttttgatgaggttgtttgttttttgcttgttaatttgtttaagttccttatagattctggatattagacctttgttggatgcatagtttgctgatattttctcccatcctgtaggttgtctgtttactctgttcatagttgtttttattttttaattttatgggtacataataagtgtacatatttatggggtatatgagacattttgatacaagcatgcaatgcacaataatcacatcatggaaaatggaatggccattcccttaaacatttattctttgcacaaacaaaccagttatgctcttttagttatttttaaatatacaactaaattatttagaccatagtcaccctattctgctgtcaaatactatgtcttattcattttttctattttttatcctcattaaaaatctccactttctgtccacaccccactaaactttctagcctttgttaaccattcttctactgtctatctccatgggttcaaaaaatatatttttttattatactttaagttttagggtacatgtgcacaatgtgcaggttagttacatatgtatacatgtgccatgctggtgtgctgcacccattaactcgtcatttagcattaggtatatctcctaaagctatccctcccccctccccccaccccacaactgtccccagagtgtgatgttcccttccccttcctgtgtccatgtgttctcattgttcaattcccatctatgagtgagaacatgcagtgtttggttttttgtccttgcgatagtttactgagaatgatgatttccaatttcaaccatgtccctacaaaggacatgaactcatcattttttatggctgcatagtcttccatggtgtatatgtgccacattttcttaatccagtctgtcattgttggacatttgggttggttccaagtctttactattgtgtatagtgccacaataaacatacgtgtgcatgtgtctttatagcagcatgatttatagtcctttgggcatatacccagtaatgggatggctgggtcaaatagtatttctagttctagatccctgaggaatcgccacactgacttccacaatggttgaactagtttagagtcccaccaacagtgtaaaagtgttcctatttctccacatcctctccagcacctgttgtttcctgactttttaatgattgccattctaactggtgtgagatggtatctcattgtggttttgatttgcgtttctctgatggccagtgatgattagcattttttcatgtgtcttttggctgcataaatgtcttcttttgagaagtgtctgttcatatcctttgcccactttttgatggggttgtttgtttttttcttgtaaatttgtttgagttcattgtagattctggatattagccctttgtcagatgagtaggttgcgaaaattttctcccattttgtaggttgcctgttcacgctgatggtggtttcttttgctgtgcagaagctctttagtttaattagatcccatttgtcaattttggcttttgttgccattgcttttggtgttttagacatgaagtccttgcccatgcctaagttctgaatggtaatgcctaggttttcttctagggtttttatggttttgggtctaacgtttaagtctttaatccatcttgaattaatttttgtataaggtgtaaggaagggatccagtttcagctttctacatacggctagccagttttcccagcaccatttattaaatagggaatcctttccccattgcttgtttttctcaggtttgtcaaagatcagatagttgtagatatgcggcgttatttctgagggctctgttctgttccatttatctatgtctctgttttggtaccagtgccatgctgttttggttactgtagccttgtagtatagtttgaagtcaggtagcataatgcctccagctttgttcttttggcttaggattgacttggtgttgcgggctgttttttggttccatatgaactttaaagtagttttttccaattctgtgaagaaagtcattggtagcttgatggggatggcattgaatctgtaaattaccttgggcagtatggccattttcacgatactgattcttcctacccatgagcatggaatgttcttccatttctttgtatcctcttttatttcattgagcagtggtttgtagttctccttgaagaggtccttcacgtcccttgtaagttggattcctaagtattttattctctttgaagcagttgtgaatgggagttcactcatgatttggctctctgtttgtctgttattggtgtataagaatgcttgtgatttttgtacattgattttgtatcctgagactttgctgaagttgcttatcagcttaaggagattttgggctgagataatggggttttctagatatacaatcatgtcttctgcaaacagggacaatttgacttcctcttttcctaattgaataccctttatttccttctcctgcctaattgccctggccagaacttccaacactatgttgaataggagtggtgagagagggcatccctgtcttgtggcagttttcaaagggaatacttccagtttttgcccattcagtatgatattggctgtgggtttgtcatagatagctcttattattttgagatatgtcccatcaatacctaatttattgagagtttttagcatgaagggttgttgaattttgtcaaaggtcttttctgcatctattgagataatcatgtggtttttgtctttggttctgtttatatgctggattacatttattgatttgcatatattgcatcccagggatgaagcccacttgatcatggtggataagctttttgatgtgctgctggattcggtttgccagtattttattgaggacttttgcatcaatgttcatcaaggatattggtctaaaattctcttatttggttgtgtctctgcccggctttggtatcaggatgatgctggcctcataaaatgagttagggaggattccctctttttctattgattggaatagtttcagaaggaatggtaccagttcctccttttacctctggtataattcggctgtgaatccaatattttgttttgtttttcctttttgagacaggtcttgctgtgtcacccaggctggagtgcagtggtattaacagaactcagtgcagccttgacatcctgggctcaagcaatcctcctgcctcagcctcctgaatagctgggaccacaggcatgtgctgccatgcccagctacttttttgattttttttgtagagatgaggtctcactttgttacccagtttggccttgaattcctgggctcaagtgatcctttaacctcagcctccaaaagtgctgcagttacaagcatgcgccaccatacctggccttgttttgatttttaggtaccacaaataagtaagaacatacgatatttgtctttctgtgcctggtttatgtcacttataatgacatccagtttcatccaggttgttgcaaatgactggatcttgttttttttatggctgaatagtactccattgtgtatatgtaccacactttcttttctgtttttttagacagtctcacttttgtcgcccaggctggagtaccgtggcgcaatcttggctcaccgcaacctctgcctcctgggttcaagcgattctcctgcctcagcctcccaagtagctgggattataggcacgtgccaccacggccggctaattttttatttttagtagacacggagtttctccatgttggtcagactggtctcaaattcccagcctcaggtgatctgcccacctcggctttccaaagtgctgggattacaggcgtgagccacggcaccggcccattttctttacccgttcatctgatgatggacatgtagattgcttccaaatcttggctattgtgaacactgctgcaatgaacaatgggagtgcagttatctcttcaatatactgatttccgttcttttggaaagaaaggaaatcctacctagcagtgggatttctggatcacttggtagctctatttttggctttttgaggaaactccaaactgttctccatagtgcttgtactaatttacattcccaccaacaatgtacaaagtttccctttttttcacctctccagcattttttattgcctgtcatttggataaaagccattttaactgtggtaagatgatatctcattgtagttttgatttgcatttctctgattatcagtgatgttgagtatcttttcctatacctgtttgctattagtatgtcttcttttgagaaacatctattcaactcttttgcccattttaaaattagattattagatttttttttctatagagttgtttgagctccttctacattctggttattcatcacttgttagatgggtagattgtaaatattttctctcaatctgtgggttgtctcttcactttgttgattgtttgcttttctgtgcagaaggtttttaagttgatgtgatcccatatatccatttttttcctttggttccctgtgattgtggggtattactcaagaaatttttgcccagactgatgttccggagagtttccccaatgttttcttgtagtcgttttatagtttgatgtcttagatttaagtctttaatccattttaattcaatatttgtatatggtgagagataggggtctagtttcattcctctgcatatggatatctagtttcccagcacagactgtcttttctcgagtttatgttcttggcaccttcatcgaaaatgagttcattatagatatgtggatttgttttttggttctctattctgttccattcatctatgtgtctgtttttatgccagtgccatgatgttttggttactatatctctatggtataatttgaagtcaggtaatgtgattcttccggttttgttctttttgctcaagatacctttaggtattatgggtattttgtagttctatatacattttcagattgtcttttctatttctgtgaagaatgtccatggtattttgacagggattgcattgaatttgtagattactttgggtagtatgaacatttttacaatattgattcttccagtccataaacatgcaatatctttccatttttttgtgtcctcttcaatttctttcatcagcattttatatttttcattgtggagatctttcacttctttggttaattcctaggtatatttagttttattcgtggctatcgtaaatgggattactttttaatttcattttcagattgttcactgttgggacatatagaaatactactaatttttgtatgttgattttgtatcctgcaactttactgaatttattgttttaatagttttttggagtctttagatttttttaaaactgagattatatcatctgcaaacaaggataatttgatttcttcctttctaatttggatgtcctttatgtcttctctctctctctctttcttttttttttttttttttgagatgaggacttgctttgttgcccaggctggtctcgaactcctgggctcaagcaatcctcctgcctcagcctcccaaagtgctgggattacaggtgtaactcacttcgcctggcctaggaagccctttatttctttctcttgtctaattgctctagctaagagtactatgttgaatactatgttgaataacagtggtgaaagtgggcatccttgtcatattctagatcctagagaaaaggctttgagtttttgcctgctcagtatgatactagctgtgagtctgtcatatatggtttttattatgttgaggtatgttccttctatacccagatttttgagggtttttaagatttcaatagttttgggaaacaggtcgttttcagttacatgggtaagttatttagtggtgatttctgagattttggtgcacctgtcacccaagcagtgtacaccgtacctaatatgtgtagtcttttatctttcactcccctcccacccttccctccaagtcccccaaatccattatatcattcttatgtctttgcattctcatagcttagctctcacttgtatgtgagaatatacaatatttggttttcgatttctgagttacttcacttagaaaaatggcgtccaggtccacccaagctgctgcaaaagctattattttatttagtttatggctgagtagtattgcatggtgtatatataccacattttctttatccacttgttggctgatgggcatttaggttggttccatatttttgcaattgtgaattgtgctgctatcaacatggcttgcacatgtgtctttttcatgtaatgacttcttttcctttgggtagatacctgatagtggcattgctggatcaaataatagctctacttctaaatctttaagaaatctccaaactgttttccatagtggttgtgctggtttacattcccaccaatagtataaaagagtgtccttttcaccacattcatgccaacatctattactttttgatttttaaattatagtaattcttgcaggagtgaggtagtgtctcattgtgcattaggaaatttagtatacaataaagacagcatttttattgaggaaaggatgcattttaaaaaacaagtttttcaaaaatatagggaggattgtggttacttctagaaacagtagtgcagtcaggaaaaattcagcacaatatgtatcagtggaattcatctgatcaaacttaaaatattattccttgcattatagttctgagcaggtaccatagataatagttctattgtgttgttcactttaaactagagcaagaaacttttctaataagtggaattgggagctgtctagctggtgttggcctgataaatgcttaatacacatgaatgtgcatgcatatgtatgcatataccatatacatatattataaatttaactgatataaaagatgtttggtaaatagtttaaaatagtaataaaatatacaattctccctattatcaattattacagaatgtttcccttgatttttgctgaacttttctatccataaactatctatggttgtaattgacaagtatagttctcacatgaatgtctgttggtattttcatttatcttaacaaataatatagagtaaaatgacaaagacattgaatcttgacctgtttgtcaatgatgtgacttccttgctgcattggataatacctcttaaatactggaaaattatttgttgatttttggtctattcacaatgtaacagctacaaatatgatacactttaaaaaataatggtataatttaactttttaatttttttatttcaatgggtttttggggaacagtatttggttacatgaataactactttagtggtcattgctgagattttggtgcacccatcacccgagcagtatacattgcacccagtttgtagtcttttattcctcacccccttcccaccctttccccctaagtccccaaagtccattgtattatacttatgcctttgcatcctcatagcttagctcccacttatgaatgagaacatgtggtgtttggttttccattcctgagtttcttcacttagaataatggtctccagttccatccaggttgctgagaatgccattatttcattcctttttatggctgagtagtattccatggtgtattatatatataatacatatattttatatatatgtatattacaatttctttatacacttgttgattggtggctatttggtctgattccaaatttttacaattgtgaattgtgctgctataaacttgtgtgttcaagtatctttttcatataatgacttttttttcctctgggtagacacccagtagtgggactgctggatcaaatagtagttttacttttagttctttaaggaatctccacactgttttccatagtggttgtactagtttacattcccaccagcagtgtaaaattgttcccttttcaccacattctggccaacatctattatttttttattatgaccatttttgcaagaataagatggtatcacattattgttttaatttgcattttcctgataattagtgatgttgagcatttttttatatgtttcatatcttcttctgagaattgtctgtttatgtccttagctcactttttgatgggatttgtttttcttactgatttgtttgacttccttgtaggttctggatattagtcctttgtctgatgcagaatttgtgactattttctcccactctgtgggttgtctgtttactttgctaattcttttctatgcagaagctttttagtttaattaggtcccatttatttatttttgttgtagttgcactttcttttgggttctcagtcatgaattgtttgcctaagccaatgtctagaagagtttttctgctgttatattttagaattttcatggtttcaggttttagatttaagtctttgatccatcttgagttgatttttgtgtaaggtgagagatgaggatccagtttcattcttccacatgaggcttggcagttatcccagtaccatttcttgaataaggtgtcctttccacactttgtgtttgtatgctttgttgaagatcagttggctgtaagtatttgactatatttctggttctctgttctgtttcataggtctgtgtgcctatttttataccagtaccatgctggtttgataactacagccttttagtataatttaaagtcaggtaatgtgatgccttcagatttcttctttttgttttgtattgccttggggatgtgggctcttttttggttccatatgaactttaggattgtgtttttctagtcatgtgaagaatgataatgatattttgctgggaattgcattgaatctatagattgcttttgacagtatggtcagtttcacagtattgattcctgtcatccattaacatggaacatattccatttgtttgtgtcatttatgatttccttcagcagtgttttgtagttttccttgtagagatctttcacctccttggttaagtatattccgaagtgtattagtcagggttctctagagggacagaattaataggctagatgtgtatataaaggggagtttattaaggagtattaactcacacaatcacaaggcccaacaataggccatctgcaagctgaggagcaaggaatccaatctgagtcccaaagctgaagaacttggaatccgatgttcaaggggaggaagatccagcatgggagaaagatgtaggctgggaggctaagccagtctaatctctccacgttcttctgtctgcttttattctggctgcactggcagctgattagatcgcacccacccagactgagagtaagtgtgtctttcccagtccactgacacaaatgttagtctcctttgataacaccctcacagacacacccaggaacaatactttgcatccttcaatccaatcaagttgacactcagtattaaccatcacaagtcctccccttgtcaacttgaacccatacacacctcctgaaattatagataatcttcaaattaagacaataataaggtcataattattcccaacatgatacaactatccttcatacaaccaagaatgcaccaattcccaacccaaatgctattacataaagttaacatttaaattttcatatgaagtcaataaatcttatgtcacatgataaacaagaaaggaaataaaatgaagatattttcttagtacaaatgtataaatgcacaaacatgtttttaacaaagaaggaggaaatactcacgacaattaaaatcctcatttctgcaactggttgtgtggttcatagctggtattgatgactaccttcctctactactcattctgtattccctttgccttcagcaagcacctcagcaggtagtggttttttcctggtgtagtgacccaaaccttcattcctgaaggatctgggccatttgtagtcctgcctggattgtgctgttgtagtttcccattgacacagggcatggtaatactaagagacaccctaagggatcttgtgtattccatgcatactcttccttacctccactgtggagtagtagactgatttcatcttgagagtctgggtcagtcaccccagccaacactgtaacttccttcttagattgttggtttaaaggtaggaggagcccaaaaagtgtcccggtgtcaatcttaatttccagtttaatggaatcgtggttgtgtcttctggtggcagcattcctccctctggaactaagacctctaggccagcagaacataatgtcacagggacagtaagcaaaaattttactagtgggtcactaggggtgatggtaagtggtgccacttccacttccaccccttgattcctggacctgtgaattccggctatgggagaaacagtaccatatattggatgctgattcagagcatacacaaccttctggagaattttgccccagccctgcaaagtattgtcacctagttgacattgtaattgtgacttcaaaaggccattccatcattctatcaatccagctgcttcaggatgatggggaacatgtaaagaccagtgaattccatatgcatgagcccgctgctgcacttctttagtcgtaaagtgagtgccttggtcaaaggcaatgctgtgtggaataccacgatggtggataaggcattctgtgagtccacagatggtaatcttggcagaagcaatgtgtgcaggataggcaaacccatatccagagtaagtgtctattccagtgaggacaaatcgctgccctttctatgatggaagaggtccaatataatcaacttgccaccaggtagctggctgatcaccctgaggaatggtgccatatcaagggctcagtgttggtctctgctgctggcaaattgggcactcagcagtggctgtagccaggtcagccttggtgagtggaagtccctgttgctgagcccatgtgtaacctccatccctgccaccatggccactttgttcatgggcccattgggtgatgacaggggtggctggggaaagaggctaagtggtgtccacagaacgagtcatcctatccacttgtttattaaaatcctcctctgctgaggccagccgttggtgagcactcacatgggatacaaatatcttcacagtttttgaccactcagagaggtccattcacataccttttccccaaatttctttgtcaccaattttccaatcatgcttcttccaagtccttaaccatccagccaaaccactggctacagcccattaatcagtatataattgcacatccggccatttctccttcatgaaaagtgcacaaccaggtgcactgattgaagttctgtccactgggaagatttcccttcactgctgtccttcaggtatgtcctaggaaggggctgtagtgctgcagctgtccactttcaggtggtggacatatcatgcagaaccatctgtgaaccagtccttagtcttctcttcctcatcaactgatcatagggaactccccatgaggccattgttgcaagctggggaagagaaggaagggcggcaggagtggagaccatgggaatttgagccactacctcatgtaacttacttgtgccttcaggacctgctcgagcccgatcacatatataccacttccatttgatgatggaatgctgctgtgcgcaccccactttatggctagatggatcagaaagcacccagttcatgataggcagttcaggttgcttggtgacttgatgacccatagtcaaatgttcagtttccaccaaagcccagtaataggccaagagctgtctctcaaaaggagagtagttagctgcagaagatggaagggccttgctccaaaatccttgaggtctccactgtgattcacttatgggggcctgccaaaggctccaaatagcatccctatctgccactgacacctcaagcaccattggatctgctgggtcatatggctcgagaaacagagcaacttgcacacagcctggacgtgttgtagagtcttctcctgttctgtactacattaaaaagtgagagccttttgggttactcgataaatgggctggagtaacatacccaaatgaggaatgtgttgcctccaaaatccaatagtcccaaataagcctctttcgtggttgtaggaggggccaaatgcagcaacttatccttcaccttagaaggaatatcttgataggccccactccactggacccctagaaattttactgaggtagaaggttcctgaattttagtcatttattttccatactctggcatgcaaatgtctcaccaataagcccagtgtgtttgctacttctcactcactgggtccaatcagcaaaatgtcatcaaggtaatgaaccagtgtgatatcttatggaagggaaaatcaatcaagttctctccaaacaagattatgacacaaagccggagagttgatatacccctgaggtaggatggtaaagatatattgctggccttgctgactgaaggcaaattgcttctggtgggccttatggacaggaatggagaaaaaggcatttgccaaatcaatggttgcataccaggtaccaagagatgtgttaatttgttcaagcaatgaaaccacatctagtacagcagctgcaattgcagttaccatttggttaaacttatgataatccactgtcattctccaagatccatctgtcttcttcacaggctaaataggagagctgaacggggatgtggtgggaatcacaacccctgcacattttgagtccttgatggtggcactaatctctgcaacccatccagagatgtgatatgttttttgatttactatttttctaggtagaggcagctctaattggtcttcctattttgtcttttccatcataatagccctcactctaccagtcagggagccaatgtgggggttctgctagctgctaagtatacctatgccaattatgcattctggcactggggaaatgaccacaggatgagtccagggacccactggacccactctaagtcagacttcagctaaaactccataagcccctactttaactggaggaccaccaggacgttttcggtcccctggagtcaacgtcagcttagagacactgttcagtagtccctgaaatggcaatcatttccctttccccaatcacagttactctggtaaaaagccgtaggtctccatggggaaggatgggagaaagactaacagcataaattgttgtcagtgtcatccttgtatccctgggataaatcccacttggtcataataagtgatcttttaacagcgtaaattgttgtcaaggggaaccagcctccccttcatttaagggattctaggtctgtaaactggtttaagtctggaaattgattgaggggaaattgatcctctgtttttataattcaaattagtcttttgtccacttgacctggaagttttctgcttatataaattaaataagaatgcaataggcttcctatcattttcacttctaggaacaccatgattaatcaacagatgccagagatctacatgagtcagactattgtgattgctgctttgcctctgctgtccattatggtagctatgcccaccttgcctttgacagttgactggcccctgccacctcgagatccaattattcccattgcatttaagttttgtagttgagtgactgtggttcctactgtaaaatctggcatacagagaagagcaatcacaaagctcttcaaggatgcaggtactcccctcacaaatctattttgcaaagtattagtcaaggatatattttctggatcctcccagctgggatgagtaggtctaaactgactaatccactccaccatcccaatctccctaaaccttttgatcccttcctctacattaaaccaagggagatcaggcatttccagcttgctcacagtgggccatcttttaatccatatttcagctaaccaagcacataaattatcagaacctttttaaactccccaagctgcaacattaaatgcagaatccctgcttagtgggcccaaatcaataaattcagcctgatccaatgccttggatctatgttccatccaccattatcccacacccttaatatccattcctatgcctgtcctccagatttttgcttatataaataagaaagctcaagcagttcttttcgagtgtagcacacctcctcatgggttatactctgaacctcacccctagggccctcctgggactttagtctagttataggtctagaagcaaacaggggtggtggggggtgggtcctgaggagaatcaacattatcttgcctggcaactgcctcaggggaagccatcactgttgcctcaggcagtgcagggtttttctcctcagacaaatgtggaaaggctgatggcagtgtgggttggggaggacatgttgccactactggggatgagaaagctgtttcttctggcaaaaaaagtttcatcagaatttataatctcagtgtccccagcttcatcagggtccttttacatatccccattccaagtttcaggatcccattcttttccaatcaatgccctcatttcaacagtagacacctggcaaggctgtgcatgcacctttcattgcaggtcagccactggtatgataagaacttgtgtccaatttcccgcaatttcagctctttctctacaggagataagactctcactcagggcaatcttagcaggtttgaggttcagtatctgcttctgaagctaggaattagaatccctaagttcatcattttctttcatcactttgtccagtgaacttaggaggaaccaaccaacttcattatgttccttagttccccacatatggtcaaaggtattacatatagagttactaaactccttgcctctcacgaaccgtgcatcaggagtgtcaaatgaatttattttgtgtaactctgtaaacagttcgtgccaaggactatcagtgttctccatactattagaagtacagtccttagcatttttgggtctaatcatattaagcagccttctccagaaaccccaaaaccaatgaaagaactccatccttaatagtctgttcttctggaaccactcctgggaccaaaatctgtattagtcagagctctctagaggacagaactaataggatagatgtatatataaaggggaggttactaaggagtattaactcacatgatcacaaggtcccacaataggccatctgcaagctgaggagcaagcaagccaatccaagtcccaaagctgaagaacttggagtccaatgttcaagggcaggaagcattcagcacaggagaaagatgtaggctgggaggctaagtcagtctaatctctccatgttcttctgcctgtttttattctggctgtgctggcagctgattagattgtgcccacccagattgagggtagatctgcctttcccagtccactgactcaaatgttaatctcctttgatgacaccctcacagatatacccaggaacaatactttgcctcctgtaatccagtcaagttgaccctcagtattaaccagtacactaagtatttttttttttttttgcagctgttgtaaaagggattgagttcttaatttgattctcagcttggttattattggtgtatagcagtgttgctgatttgtgtgcattgattttgtatcctggaactttactgaattcatttatcagatctaggagctttttggatgaatctttagggttttcagagtacatgatcatattgtcagcaaacagcaacagttttaacttcctcttttccaatttggatgccctttatttcttcctcttgtctgattactctggatgagactttcagtactatgttgaatagaagtggtgaaaatgggcatccttgacttattccaggtctcagggggaatgctttcaacttttctccattcaatatgatgttggctgtgggtctgtcatagatggcttttattactttgaggtatgtcccttctatgccaattttcttgagggtttttatcataaagggattttgaattttattaaatgctttttcagcatcaattgaaatgatatatggtttttggtcttcattctgttgatatgatgtatcatattgattgatttgtgtatgttgaatcatccttgtatccctgggataaatcccacttggtcttttaactgtattgttgaattcagtttgctagtattttgttgaggatttttgcatcaatattcatcagatatattggcctggagttttattttattttgatgtgtcattgtttggtatcaggataatactggcctcatagaatcagtttggaagttaacccctcctctactttttggaatagtttgagtaggattggtattagttcttctttaaatgtttggtagaatttggcagtgaagccaatgggtcccaggctttactttgctgggagactttttgttacaactttgatctaattacttgttattggtctgtttaggttttaatttcttcatagatcaaccttggtaagttgtatgtgtctaggaatttatccatttcctctagatttttaaatttattggcatatagtggctcatcatagccactaatgatcctttgaattcctgcagtatcagttgtaatgcctcctttttcagctccgattttatttacttgggtcttctctctttttttcttcattagtctgtttaaaactttgtcaattttatttatcttttcaaaagattgactttttgttttgttgatctcttgtattttcatcatttcaaatatatttctgctttgatctttattattttctctactaattttggattcagtttgctgctgcttttctagttctttaagatgtatagttaggttatttaaaatgaggttttcattcttttccaatgtaggcaattacagctacaaatttccctctaatagtactccttttgttgtatctcataggttttggcatgttgtgtttccattatcatttgtttgaatcaaattttcaatttccttttaaatttctttattgacccactggtcattcaggagcatattgtttaatttccatgtgttcatgtagtttccaaaattccccttttttatttctaattttacttcattgtggtcagagaagaatcttgatatgatatcatttttaaaaaaatattttaggacttgtattgtgactagcatatggtctatctttgagaatgatccacgtgctgagaagaatgtgtattctgcagctgttggatgaaatgctccataactatctattaggtcaatttgttctatagtgcagattaagtctgatgtttctttgttgagtttttgtctgtcagttctgtccaatacggaaagtggggtgttgaattctccacctattattgtattgtgatctctatctctcttttagctctaatactatttgctttttatatctgggtgcttcaatggtgggtgcatatatatttataattgttatatcctcttgctgaattgaccccattatcattgtacaaagaccttctttgtctctttttggagtttttgtcttgagatctattttatctgttataagtgtagttacccctgctcctgttttgtttccattagcaaggaatatcttttcccatgtctttattttccagtctatgtgtatcttcataggtgaagtgtttcttgtgggcaacagatcattgggtcatgttttttcatccattcagccactttatttctttttattggagagtttagtccatttacattcaataatttcatttaagtaggaacttcctcctgccattttgtaatttgttttctcgtggtttcatggtcatctctcccttctttccatcttctttttcatgaaaataattttctctggtggtatgatttaatttcttgttttttattttttgtgtatccattgtatgtttttccatttgaggttacatgaggtttatgacttatcttatgacccattattttaaactgatggcaacttaacagactgcataaacaaaaaacaaacacacaaaaggaagactaataaaagttctacactttaactgtatcctcctgcttttaactttgtgttgtttctctgtgtcttattgtactatgttgtgaaaagttgtcttttttttttttttttttctgagtcagagtcttgctctgctaccaggctggagtgcagtggcctgatcttggctcactgcaacttctgcctcctgggttcaagcgattctcctgccttagcctactgagtagctgggactatgggcacgcaccaccacaacacccacctaatttttatatttttagtagagacggggtttcaccatgttggccaggatagtctcgatctcttgacctagtgatccgcccatcttggcctcccaaagtgctgggattacaggcatgagccaccatgcctggccaggttgttattatttttgaccagttcatcatttactctttctacttaagataagtttacataccacaattacagtgttataatattctgtgtttttctgtatgcctattcttaccagtaagtgtctcggcattgaagagctaggtatttcttatagtctttgcagtctgggcttgtttatccctgtccttcttgagaaggttttccagaaggtttttatttgaaggagcttgggcctcaatcccaataatactgtggtttttgcagactagtagaggtaccatcttggaggtcttgaataagatccagaatgattatctggattgccaggcaaaagcacttgttcttttcccttactttctgtcaaacagtctctttctgtctctctctctctctctctctctctctctcaaggtgctgggccatcttgaactaggggtatggtgatgcaagcactcctgtggcccccactttggattgtgctgggtcagacctatagccagcacagccctgggtcttgtccaaggcctgctgtaaccactacctgactaccacctatgttcactcaaggccctagggctctaagatcagcagggggtgacaccagccaagtttgcatccttccctttagggtagcaagttccccctggccctgggcaggcccagagatgctacttgggagtcagggattggagtcaaaatacttagaaatttgcctgatattttatttgactacggctaagctggcactcaaaccacaagacaaagtctttcccattcttccctcccctttccacaggcagaggtgcctctccctgtggccagtactaccactggtccacagggaatctgcctggccactgctgatgttcacttaaagcttaagggctgttcagttgtgttgtggtgaatgctgccaggcctgggactcttcaaggaagtgggcacccctctgccctggggaagatccaaatatgctttccaggagccaaagcctggacttggggaccccaagagcatgcttgttgctctactccacgtggccaaactggtaccaaaggtgcaagacaaagtcccctttactttttcctctgtttctgtcaaacagaaggagtctttcactgtagccaccacaactaggaatgtgctggatcacacctgaagtcagcacatctcagaacctaaggcccacagtatactacctggatatcactgctggttatttggtgcccaagggctctttagtcagcaggtgattaatcttgccaagactgggtccttcccaccaaggcaatgggttttctatttgtccagggtgtgtctagaaatgtcatccatgagctagggcctggaatgcgggcctcatgactctactcaatgccctatcctactgtggctgagctggtatccaagatgcaagacaaagtcctctttactcttttctctcctctccttaagcagaaggaaggagtgacttttgttgctgcaagcttcactgcctgggattaggggaggggtggcacaagcactcccttagctgccccagctgatgacttcctaggtcatgtgccacccctatccctctggttctgagcccagcccagcactaggagttacctaggaattgcaatccttgtgtcctagactgtctttcaagtttacctagaacctcagagcacttaagcatatagtggtgaggcttgctgagttctgactgctgggatgagtgattcgcctctggccaggcctgttccaaaatctcccttcatgtgcagctgctggctgagtccagcacagtgttgttccctgctacgacagcaccgagtttaatgtaaagttccccagttgctgtgctttacttcctccaagtgcgcagactccccacgttgctcagctgctgctgggggatatgggaggggtgatggtggtgatcccagagtgtctctccaaccctcttcaatgcctcttttagtgatacgttgttaaatctaggtactacgattgctcacctgatgtttggtttttgtaatgacgcttttccgtgtgcagatagttgttacaatttggtgttcatgtggcgggggaggggggggatggtgtaggcttctgttccactatcttgctccacctcaatagtctgatgtgcagaagctctttagtttaattaggccccatttgccaatttttgtttttgctgcaagagcgtttggcatctttgtcatgaaatctttgccagggcctatgcccagaatgatattttctaggttttattctacggtttgtatagttttaggttttacatttaactctttaatccatctcaggctgatttttgttcatgctgaaaggaaggggtccagttttcagtcttctgcatatggttagctagttatcccagcaatattgagtaggaagtcctttctccattgcttgtttttgttgaagatcagataattgtaggtgtgcagctttatttctgggttctctaacctgtcccattggtctatgtgtctgtttttgtattagtaccatgttgttttggttactgtagccttgcagtatagttgaagttgggtagtgtgatgtccttcttgttctttttgcttaggattgctttgactatttgggctcttttttttttccatatgaatgttaggatagtttgtttttctaattctatgaaaaataatattggtagtttgataggaacatcattgaatctgtgaattgctttggacagtatggttatcttaacaatgttgtttcttcctacccatgagcgtggaaggtctttccatttgttttatcatctctgatttctttcagtagtgttttataattctttttatagagatctttcacatccttgattagccatattcctaggtattttctttttgtgtatgtctattgtaaatggcattgtgttcttgatttggccctcagcttggatgttgttggtgtacagaaatgctgatttttgtacattgattttgtatgctgaaactttgctggaggttttatcagatgtaggagctttttggcagagaatatagggttttctaggtataaaattatattgtctgctaagagagataggttgacttcctctctgcctatttggatgccttttatttctttctcttgcctgatttctctggccaggacttccagtaggatgttgaataggagtggtgacagtgggcatccttgtcttattccaagtctcaaggggaatgctttggatggtaccaatccttttaaacttattgaggattgttttagataatgttccatgtgcaattgagaagaatgtatattatgctgctattggctatatgttctatagatgttgctatgatatgaatgtttgtgttccccaaattcataaattgaaacctaattctcatgttgatggtatgaagaggtgagacctttcaaacataattaagtcatgagggcagagccctcatgaatgggattggtgcccttataaaagaggcccagagaggtgccttgcctctttcaccatgtgaggacacagcaaaaatgtgacatccatgaaccaaaaagtggccccctccccagacactaaatctgctggtgcctgaatcatgaactttcaagcctctagaacagtgaaaaataaatctctcttgtttattaactacacagcatatggcattttgttataatatcctgaacagactaagacagatatcgtttaggttagttggtttttagtgttgttcacatctttcatttcctagtgatcttctgcctagttgttgtccattattggaagtggagtattaaagtctccagttatgactattgaattgtctatttctcccttcatttctgccagtttttgcttcatgtgttttggggctctattattagatgcaagtatgtttttagttgctatatcttcctgattggtccttttgtcattataaaatgtccttcttgatttctagtaacactttttgtcttgtctgttttgtctgatattagtgtagtcactccagctatcttgtggttgctgtttgtacaatatatgttttcccattcttttactttcaatctgtttgtatctttgaatctaaaagtgtctcctgcagacaacacatagttggatgttgttttcctaaaaactctagactgacaattctgccttttgattgggttctttaatgtattcacatgatgttactattgatatatttggatttatgtttgttattttactcctttttctatatgttttaattctctttttttcctatacttttcatttactgatttatattaagtgaatattttagaatgtaacatggtaatttttaaaataaattttaaactgtatcttttgagttattttcacagtagtttctctagagtttaccatatatattttagcttattggtatctgcttcagatttatattaacttaattctagtgagatataaatatgttacttctagatagctttatttctcttctgccttttgtattactgttacacatattacatcttgtggtggattgaattgtgggcctcaaaaatatatgtccacatagtaacctttggaacctgtgacctcatttggaaataagtctttgaagacataattatattagagatttggggatgaaattaccctaaattttcaggtgggggctaattccagtgaaaagtttgttttgttttttaaataagagatagaagatggaaaacagacacagaggaaaaggccatgcgaagatggagacagagattggagtgatgtcaacagccaccaacacctggaaaaggcagaaacagattctccgtagagcctctaaagggagtgcaaccttgccaacatcttgagttttaattctcctctccaaacctgggagaaaaactgtcttaagcaacccagtgtgtagtaatttgtcacagcagccacagaaaaccaatgcacatttatagtattatatacccaacaatacatcgctataataattattactttatgtaatcttatattttttagaggcactaagagaaaaaaggagaaaattatatatttatggcatttcttatttgtcattgctagttctattcatttattcttgtggattcatattaccatctggtgtctttttttaatcagatacagctgttctcccacacacctcttttatactgtaattgacaaatttgttatatttctgtatgtttttggtccaacaatagagttctacatactgttttatgcaattcgttagactcaggttttctatttcaccttcgaagtgtggcccttaggccaggagcagtggctcacgcctgtaatcccagcactttgggaggccgaggcggatggatcacaaggtcaagagattgagaccatccttgccaacatggtgaaaccccatctctactaaaaatacaaacattagcttggcatggtggtgtgcgcctgcagtcccagctactcaggaggctgaggcaggagaattgcttacacctgggaggtggaggttgcagggaaccaagatcacgccactgcactccagcctggcgacggagcaagaccaaatctaaaaaaaaaaaaaaaaacaaacaaactgtggcccttagaacttaaagtcatattttggttctcaaatcagttccaagagtaggtgatctagccctttcattctaaacactacacatgtagtactagagtataatattgtatttgcttattttttcagagtcagggtcttgctatgttttctagactggggtgcagtggggcaatcatagctcactctaaccttgaactcttgggctcaagagaatcctcctgcctcagtctcctaagtagctaggactacaggtgcacaccactacacccagctaatgcattttttttttaacacacataaagcacagttttttcacaatagattgacaacgataattcacgtcttttttgctagatgatattaagccacagatcaaaaagtcctagacttttatacttacttgaaaaaaacctcaaatttgctgaatgccattgtattaagagctaatctgtctggtccaatcacataatatatttgcctatattcaagtttcatatttctacatatttgataaacattcacactagattttcctctgtgctgcagacaaaaattttcttcaatggtgtctgaaaagggaggcctgcaaccactaccaaaccactctacctgagattagtttattagatagtgcctaacctgaaataaaaatctgctgatagaacattctgcaaaaaaagctctattatgttatagtagagctcatactatattatggtttcaaaggtaataagaaaaatatcatcagatcatcattatggtagctattttaagggaacttaataaaaatttaacagttatcatcaaacactggccacctcaattttaaacagtaaacacacgaattactcccataaaaattataagcataacaggacacttcttggctactattcaatactgacttggatgttctagataacacaagataagatacatgtgtgaatatctatacacatatagacatatttatagatgtgtgtgtatatatacagtatatatataagattttagaaaggaggataaatatatattacatgataaaacttatagtcaatataattttacacttgtaaaatcccagaaaaccaaaggaaaaaatagaactaaaaaagagttcaatgaaatgattagtttaaaaaaataaatataaaaaatgtaattttcccacataccttcaaaatgtagcaatcccactaagcaaaaagtggtatttctaccaactatagataaatgaaaattcacctttaaatgtctcttatcctccatgaaactcatcaaaaacaacaaaaagtacagcagacaaaaaaaaagtcttatctttaatgaaactttgtaaaacatttgaacctcaaccatgatgtgtatgaagataagttactaagtgccatgaagattggaccaagatatgaaaatgctaggagaggatacctttcactgaagatcttggaaagggttggtatattggtattttctagagtagtgattctcactgagatgcaaaaccaaagactccttgttttggattaaaaagatctaggtacagaggctgagggcagaactctctcattatcctatttgtcaacacaaaataggagagaaggcaggactaaatctgagagtgagcagatgcaccattatttcaagattgaacctaaggatgtggcaaggtaaggagaaaagtcaggatgacaagttgccctgtagccgccagttctcatcagttgaagatatattaaaactatggtacacataagccactccatcaaacagtaaatatggctatactgcaagcagtaaaaaagtgaacaggctctgcttccatacagtcaagaacaaaaagaaacacttgacaaggttgagaaaaataaatggaaaaaaataaagaatttaaaagaactggagagaaaactgtagctttggaatacagaaaaaggagatacagcatactgctaatagatgtcctcaaagagaccaaatacatagacaaggggaaaaaatccaaagacatcattcaagaaaaaattttgagatacaaataaacttcagacttttacttccagcaatggaaatccagtttgtcttcagccagtggcatatctcagacaataggcaagccatgagaatggttgttggactgcagtttcggactctattactacatgtatagtatttagaataaaagagctaggtctcctcatgtcagcacttatttgaccaatgggagtatgattttaagtttttagggtcacactttgaaggtggaatataaaaaaaattatagaaagataaatttttgttcagatgcatctactgcagcaatttgggaggctaaggtgaaaggatcgtttgagcccagaagtttgagaccagctgggcaacatagtgagaccttgtctctacaaaaaattaaaaattagctgggcgtgggggcgcttggcctagaagttcaaggacagtttgggcaacatagtgggaccctatctttataaaatatttttaaaaattagttgggcatggtggtgtgtgcctataatcctggctacttgggaggctggggtgggaggatcacctgagcccagagaggtaggggctgcagtgagccatcttcacaccactgcactccagcctggatgatgaagtgagattctgtcccaaaaaaaggacaaaatgaaatatcagcaatgaaaggtcctgctaaagagaaggtttgttaattcataattttaatgtttatctggtcatcttatccaaaaggcaaaaatctttagcctcccttatctttgggatatcgttctctcttaaatgttgctttctcacaaatcccaatttacttgaataagaatgcaatgttatgccaaaagttagggaggcatatggtgggacaaatcctactgggtggatggtttcttcattcttttcacaaatgaaatcttctgaaaatagacgtcagtggcagtttaaatagagaaatgggaaaaagggaagccaaaaatctgagaagcgtgtgaaagaggaggagtttctgtgaagatttcccatactgttctctgtatgcatttttccttttttcctcacgccctaatctatacccacacatactatccctctaggtgcagctcagaattcctaaacctggtataattggaggcatggctgcagacctaaaagttcggtacatctttacagttgtatttcatctgtttaaggcagaaagaataaattttcattccaaagcagttagcttgcttagcagcattaatttaaaatgaagaaatgcacatcctaatctctggcactgaagcagaaaattagttttggtttagaaatttggtgaagaataagttcaatttttatgggctgttttgcatcctggtgagatctaatgaggtctgtacttgtgactacctaataggctgacatgtttcctcctttaattttatctgagacttggtgtcaatgattttttggtttcttaattcaaaaaggcaaactagccaaggggtatttactacttatattgccttatatcacagtgtgccctttctagttccctagaagagataacgaatgggtttgtgtgtttagggaggtaactggtttttagtggaacactggcattatcaatcccactcttagtgttaaaaagagaatgcccgagctacccctctccccaccattttaatcagcaatttttaaatgttttcaaatattatagaaatatgcaggctgatgccaggtgcggtggcatggggctcacacctgtaatcccagcactttgggaggccgaggcaggccaatcacttgaggtcaggagttcgagaccagcttgtgcaacatggcgaaacctcacctctaataaaaatacaaaaattaaccgagcatggtggtgcgcgcttgtagtcctagctacttaggaggctgaggcaagagaatcgcttgaacctgggagggggaggttgcagggagctcagatcgtgccactgcactccagcctgggtgacagagcaagaacctgtctcaaaaaaaaaaataaaataaaataaaataaaataaaataaaataaaaagttaaaaaaaaaatgcaaggtgagtgcagtggctcatgtctgtaatcctagcactttaggaggctgagataagatgggaggatcgcttgagcccagaagtttgagaccagactgggcaacaaagcaacacgctcatctggaaaggaaggaaggaaggaaggaaggagggaaggaaggaaggaaaaaaaatttcaaacatacacaaaagttgagagaattgtgtaattgaccccaatgtaccatcacccagcttcaataattatcgatacttttaggcaggtttctaccagaaaatatgtcctggaaactttaattcttgatctgtgttcagattttgcctttcaaatgtttcattattggggctttggacatattgcacctgtattaaaagaaggatttgagtgaggaatttagtgcttcatagtcaatagtcaatgagtctccttttggctcgcctccttcttagggaaaggaactggttgtagggtgttaggcagaatttgggtgtatctgttgtggctcagagatgtttctcatagaactgatcactgtcccaatatccacgcaaaagaccaaattaaaagcgaggagaaatacctaatgtaaatgacaagttaatgggtgcagcacaccaacatggcgcatgtatacatatgtaacaaacctgcacgttgtgcacatgtaccctagaacttaaagtataataataataataataataataataataataataaagcgagggtgggtatctagcctattcttatcctgcctcatggtgttttctaaatatttacagaaagaaaatttacagagtagtttcctggtcaaactctaatgagtatctcagtactttcccctccacttctcacgtcttctttggggacgggtcgtcaagtctttgagtttctagttattgctattgactggtttataacctcctctttcacccagatcgtcaagggccgtttgcaaagcactcccaagtagagcctcttggagaaggagaaactgctatcacgcaaaaaaaaagccttgagctcgctggctccgctgcctcgaaaagccagagtccggaggcagtttgatgcggacactattccccaaccttcttcccctccttgtcgtctctattgccctcttggcagctcctgggatacaagagggtgcaggacagacttcaacccgcagcaggatccagcgcggaaagctctgcagcaggatccagcgcggaaagccccccgcagcacttctttcggggggctcctgtttccttaagcctagaaggtgtggtcgctcacgttcaccgtcccgcctctcgccgcctccgctcggcagctccacgctgagtcccgccctctccgccggagaggtgcgccggggtcagagcgccgggacccgacgcgcggctcccaaagggcggcaggaagagcccagctgggctcagccacagttatcagcaatctgcgggcagaggatgtggaggttaagatctgggcagcctcagggcgttgtcctagaaaacaccgtttaaggagagaagtgttagtgtctcggggcgtctcccaggctccgccctgcgcccgcagccagcgtggtggtcgagaccccagcccgctgctactggagacagcacctctcgcgcccgggcgggcggcctcgtctctgcacccctaggcggcgctgcgctcctcaacacccggccggctccgctttcccagacggctgcccagcctccagcctagcaagcccggctcccagctggccagccccggcaatgccggcgttcgggaggcgcaacgtcggcggtcgctgagtatccagcccgcagcagtgacggccggcaggagcgtgctcttccccgcggctcgtgctctccaggagtccggagcatggtcctgggtcaccgttggtgtagcgtgttggtggaacgtggacgcctagagggaggatggtgggctgtggggtggcagttttatgtttgtgggtttcctgcggcgctgcagcgggacagctcgagtactcagtgccggaggagacggagcggggcgtagccgtaggcaatctctccgcggacttgaggctgccagcggccgctatgtcctcgcggaactttcgcttcctttccagccaccgcgagctctacttcggggtggatctacccagcggcaatttggtggtcagagagccggcggaccgcgaacagctgtgcagggccaaagctgcctgcgtcttgacctacgacctggtgctcgaggacccgctggagctgcacaagattcggattcacgtcctggacaccaatgacaactcacctctctttcctgccggcgacgtgcagctgcacatccccgagttcctgacgcccggagcccgctttactctcccgaatgcccaagatgacgacgagggaagcaatgggatactaagctacagcctaagccccagtcagcactttcgcctggacatgggatcgcgggttgacggcagcgaatacccggagttggtgttggagaaagcactggatcgcgaacagcgcgccacccacctgctggtgcttacagctcgggacggcgggctacctgcccgctcaggagacgcacaagtcaccatcattgtggtggacacaaatgacaacgcgcctgtatttgagcgctccgtataccgcaccaaggttccagagactgcacccaatgggactgtgttattccgagttcaagccttggatccagatgaagggtccaatggggaagtccagtactccctaagcaacagcacgcaagcagagctgcgacaccgctttcacgtgcaccctaaaagtggggaggtgcaagtagctgcttcactaggtccgcctgaaacgctcttggaggcatacattgaggcgagggacgaaggtgtctttggtttagctagcaccgctaaactgctggtggaggtgactgacgtgaacgatcatgcccccgaactggacttcctgactctttcgaacccagtacctgaggacgctgcccctggcacagtgattgctctctttagtgtaaaggatgaagacctcgattctaatggtagggtcatttgtggcatgtctagtgcaggcccttttcagctgacggcttcctttgacaactactacagcctgctgattgatgggcccctggaccgggagcagatcagtgaataccaagtcctgatcacggcctcagatagtggctcacccccacttagcacccgaaggacaatcactgtgtcagttgctgatgtgaatgacaatacaccaaactttcctcaaccccagcaggaacttttcgttgctgaaaacaatggccctggggcctctctaggccgagtgtttgcccaggaccccgacctggggaagaatggccttgtctcttatgagctgttggatgttatctctgaagggccatcagcctctagcttgctggcagtggaatcatccagtggggccatcactgccaaaacttcctttgactttgagcagctcagggggtttcatttccaagtagaaggccgggatggtggcattcctcccagaagtgcaacagtgactataaacttgtttgtggtagataggaatgacaattatccggttatcttgtttcccttgcccagaaatggttctgtcccagtggaaattgtgccccgctctgccaggactggacacttggtcacaaaagtggtagcagaggatgctgacagtggttctaatgcctggctttcctaccacatctcccgggcgtctgactctagtctctttagaatttcagccaatataggtgagctccgtactgctcgcttagttcttcccactgatgcagttaagcagagggtggtggtagtggttcgggaccatggagacccaccactttcctcctctgtcactctgggtgtgctgttgagcaactctgtccctcagttacttccagactttgaagatgtctgggaaccaggagggcagctttctgcccagaacttgtatttagtaattgccttggcttgtatttcctttttatttctggggtgcttacttttcttcgtgtgtaccaagttgcaccagagcccaggctgttgcgctcagagctgctgtcgctctacagaggatctgaggtatggaagtaagatggtttcaaatccttgcatgacatcagccaccatagatgtcactacagttgagagactttctcagacttatctctatcgggcctctctgggacttggttctgataataacagtttgctgttgcgtggggagtacaatgctgccgacctgcgaaatcttgccactggggtaggactgaatttgccaatatcctgtattcagattcggaataggaaaggggatcacgctaatgtcaatgccatggtaagcaaattttatggaatttgattcctttggcccggagatggctgctagctgtgttttgaaatatttcttagacaagcctttcacaacatttcatcaattgaactaaacactccttcttagcacttcctgtgccaagaaatctggaagtatagaagtattagaagattgccctaggcctcaagggacttatagtttatttttgagaaacaagggcaaaaattaaaacctatttaagaacaataaaagtaatatgacataaaggtctaaaattaaaaataaaataccaaaatattttataagcaacagatgtgtaaggcactctaatatttaaagtgaagaatgaaaaatatgtaagagtctgctttatatgaatataatatggaaggtgaaacatttacttaaactattgcaatgcattattaaaagatgacgataaccacaaaagatgtaaaaataaattacaatgggggttaaaagaagggagaaagggaacataagagaacatttgagtgaggaggaaggagtcagagaaggctttgtgatagagatcacagatttagttggatctttaatacgatataccatttaataaaaaacagtgtattctctagcctatacttttaatgaataccattttggtgaaggtgtcttctttgggaatgacaccctaaaacatagctgatagctccatagcagtgttttgtaactgctttggagtttttgcttacacaaaaactgtaagcctctctcataacatctatttatactgataggagatcatattgttggatataggacttgacaaccttttgttttgtgtttctattgataatattttacaaagaggaaagatgagtaatttttatgtcagaaatatttatgtgttcaaaggtgcacttaccatccaaagtccattcaacttggatttaatttcttttattttaggggacaaatacacttaacaaataagtaaatatcatatttgagagtaatgtatctaatgaaagttaagtgattcaaatatttcaatttatctgttagtggcccttggcatttcaaaacttcttttttttttttgagacaggggtctcactatgttgcccaggctggtctcaaactcctagcctcaagtgatcctcccacctaggcctcccaaagtgctgggattacaggcatgagccactgcagctggccctcaaacttcttgagtgcagttaggacaacattttgaagcaattctacggtattactttttgacttctcatagaaatcctagatgcaagagaaggaggtgtgtagaaattaaggaaggaaaatgaagcattccttgttttactattctaggcaataaggggaaaagtggcttgtaagttattcttcctcaagtaatgatgttaactgcaaataaaataaatttacatatgttaaaattttctgtacttaatattttcacaatataatagaatccagcatataagatatgcttagtaaatgctgactgaatgaataaatatgtgcatatatgaattggatggtaacactgttcaacacagagggaaaaactttaacttacttttctactttagatgtgtatatgtggttaacagtttaaaggtcactttcaaatgtactgtttcaatgattattttcttcctcatgacctacactaataacataacagaggaattttctgattgtagagctagcaagaaaaacttcaatgctgtgtctgggactaagtatgagtccagttctacagatgacaaaggaattaataggtatgcacatcattacattgtgatatttgcagtggatactatttaatagaatctcagttaattttagggaaggaaattggtgcactacaatgctagtatttcaggtatcagagcacttaatatgtgaacacttttcctaccaagaaatttcactatttatttcttttattttcattgctttctgtaacaaaaagagaggagaataccagtaatggctgtaaagtttgggagtgaggaattttttttagaaacacattttcactagactagaaaggaaacataagtaagcgataggaaggctgatgaatctagaagttagaaggaaaattagctatttaaaaggaaaaatataggaatgacagaggaaaaaacaacccttcaaaccaaatttttaaacatatatgaatgattaacaaaataatagagatatactgttcatatgtgcaggaatattgtaccatcccattcattcagttgaacagtctttttccatcattgttgatattttgctttttaggtagctcattggtctgctaataattgttgtgggctggatatttccttataaataaatgaattgtgattcataaaaccatgaataaaataacttctataaatatggggtatttgtaattcacaaaggcatttgttatttacttcttcctgttcaattacctattgatctgatcttaattctttagaaaagaattcttgtcatagtatcctgaatgccttaataacaacaggattctagaaataaaatatttattgctttcattttatttcaaatcatttgaaaagcatgacatttaacaatgattataatgtgtgtctgagtcttacagaatcatgttgatgcatatgtgtttatattttgctcaaattctaagttctttcattttagtttacggtaagtttacagtatatattaacatagcctgtaatactaaaaattatcagtttaagaaattcaggaaaacatggtttttatctctgtatttccaattgataatatttaagatataaacaaaattgattcactgattgtataacaattagacaatgtgtacctcatgtccatttttttctgttaatattcttgatgggcaatttaaattttttagaatggtatctaagagggtacctctgagatataaatttctacttattaaaaactgcattgacaatttttaaaggtataaatatattaatgtagcaaaaatgcatgaaacacttaccatacaactggccttattaaatttccacatgaaagttatacatagtttcaacataccaatgttatattagtgtattgttcacctggaattaaagcatcttcttttttgccagggtatataggaaataggatatctcctctttgcaatgtcatttgttaacagtagtagaatgtttgtggcattcaaggtgctttatttaacatacattccacaagtagactttcccatagggtaattagatgttttgtatatctattttgactttgaagctgataaccacactaaaaaactttagaatgatgaaactaaggaagtttgcatgacatatgaaatatattcaaattaaaaaactcatatagacaacacaataatattgtataatatagaccctcaaatcagtaaaaaggaaagaaaaagaacattataatttgagtggacataagagaaaagcaataccttggaaacatataagtgggaaagtattgacaatgtgtctcataatgttaatgacttattgtcttttgttgtcttcaatattttcagttagagggaaacaataatatttcaacaactaaattaacttagctaggttggaatgaaggtggactaaattgctgaaaggtttttacaatgctcaaatgcatgtcatatgaatatcggaaatattaacacttggcagaacttcaagtgaatatggattacagtccaggatcctgactaaagtattatgggaagtaaggaatttgttggtaaaggttgttcttaagaaacaaagctaaataataaaggtagatagccactcattttgttcccaattttaattgatggcataagataatggttcaggatataaataaattacatgtctgttatattgcatttatgaaaaagaaaggactataaacacaaaaggttattatatattcatttggaacttgttttggaatctggaaataaatatgcaatctcgtattctcctgtgctgtagagaaagataaacactttatttctaacccatcccaaattccttggctgttcctagagccatctggttaccatctacagatattctgtgttcataggggcactctaatgacataccttcaaaatatactctgaattcaaacacattatggttattctttagaattgttaagcaaagactacagctgttttgtttaaactcaaaataatgttaatataaaataaaaaccaattaagaagtcttaatagtgggtttttaggttgatttgtctttttcttttcttattaggttaggctggccctgttaaacaagttggaaatcctgtctctctctctgtctctctcacattttttttcctattcctcggacacatttactgagattggtgatacagctttcttaaatatttggtagaattcactagtgaagctctctgtacctacagttttctttgtaggaaaattttaattgagatcaaatttctttgtatttttattgctcctatttcattcctgtacctttaattttttcagatatatgttagttttatctgtacttttgaatattttggcataaagttgtttataatgtcctgttgtgactttttttcacatctgcaggatctgtagtgatgtttcccttttcaatcctggtgttagtgtcacctctcatttttcttgactagacttggaagtagtttattaatgatattagtctttccaaggctaacttttggtgttttgggttcgctttgttgtatgtttgctttctattttattaattttcatactttattaatttatttccttccttatatgtttatatttcagtgtgcaacagaagtactctaaacatacttttcatttctatttcctcacacaaaatgtttaaaagatttgtacttaattgtggagatttatcaaaattaataataatcagtgcttcatcaagggcattcttactggtatttttcttactgcaaatgtccaatcatgaatgtaataaccaccagtacagtgtggagccactgctttgactccttctgtggttctatggtggccagctttacccaccaatgcttttgcattatcaatgcaagtgtaaatatagtgaaaaatgcaaataatgttttaacattattttgaaaattatattcacctcataaacacccaaagggtccatagaccacacttcgagagctaccgttctaattctatcatttcttcttttttttaattaattgtaacatttctgtaatgggtcttcaactatttgattagcctgaggtacagttcacacaggaaaggcaggataaatgtttgattcttcccctttgtttagcagtattcaaaacaatgaattgattcctggccatcttacaaaaaggaccaaggccttttttaggtgtcattatgaactcattgacttaaacatatttgatatggcccaatccatgtcaattatctttttaatgatcaaattatgctaactttggcaagttgggaactgttcagctttgctcctgagtctttgtgagtgtgtttgtgtatcttgttttaaaccttttattttggaataattatggattcacataaagttacaaaactagtatagagagatcccatgtgcttgtcacccacttttccccagtgataacaccctgaatccttttcatgtgagtcttaatagtcttttgaatgcttccttgatttctggtattacaagatgttcagattatcttgtacatttcctttcccagaatcagccatttttcaaagagctttcacttatttttagtgaaagatgatacttagagatataatctcaacaacaggtgtgcttattgctgctgggtcagttgctgtttctaggtatcttcagctactgagctaagggatgtctattttttaaaagataaaatacatcacatgtttatactaatctaataaagttcagcactccgaggtttttacttaacttcatcaatcttacattcctatttctcccatacgtcaaatcccagttttcattaacgtcaacagaattactcatttgttatcccacgggactcaaacaatggacttagaaaacaatttcagcactacagaaataatatgatactgtagcagtttaagtttttgtcattcttttcatttataaggcacatccttacaaatgcccagtaggcatgtacagtcaaattattgtgttttaaagtatcttggaaaagttcctctctgtgtagttaagccaccagctagatacagagctaggcttttttcaagtcgctttcaaatttagggcttgctttttaaattttaattttcttttataattatgtgaaatatttacatggctccaaaataaacttataaaacaaaatatatttagagaagtctagtatctattattccatacaatacacattcttccccactttgagttttttcacttaaaaatataaacgagattatttcatagtagtatagtatttacacatattccatactgcttaatggtgtcttttgattagcaattaatgagctccaatttatcaatattatcttttttttttttttttgagacagattctcattctgttgcccaggctggagtaaagtggtacaatcttggctcactgcaatctctgcctcccgggttcaagcgattctcccacctcagcctcccgagtagcggggattacaggcacccaccaccacacccggctaatttttatacttttagtagagacagggtttcaccatgttggccaggctggtctcgaactcctgaccttaagtgatctgcccgccttggcctcctaaagtgctgggattagaggcctaaaccaccacgcccagccaaagttgtcttttttatttagtattctttctatccttttaaagaaaacatatcctgcttcaagtcatgaagatatattcctgtgttttcttctataacattgctatccaatagaactttctgacatgctataaattttctctatctgcatatatggaatgtgtagctactgagcacttgaaatgtggctagtgaaactgggctactcaatttttaatgttactaattttaattaatttaagcttaaataaccacatctgtttagtggttgctgtagttctggaagctttcttgttttaacttgcacatttagatcttaaattacctgaaattgcttttgaatatagtgcaatgtagaagtcaagatttatattttccacttgtaaatccagttagattgcctactttcctcgctgctactgtgcagtgctacctttgtcataagcaacgtgactttatatattctgtttctggactgtctattctgtttcattggtcaacttgtctattcttgtgccaatacattctgtgttaaatatagtaacttttcatttgtattgatatctaattgtgtaagttctctcactttgttattctgcttcaagattaacttagctatttttggccctttgcatttctatataaattgtagattcagcttctcagtttctattttaaaaaaccctgctttgattttaattggcactatattgaatctgtagaaaatatggggtatattgaaaatatcttattttgatctttattgaatctataaaaatatgaagcttgttaacattgacaatattgagacagacaaccgattaacaaggtatattcttccatttatcttttttttttttttttgagacggagtctcgctctgtcgcccaggctggagtgcagtggcgcagtctcggctcactgcaagctccgcctcccgggttcatgccattctcctgcctcagcctcccgagtagctgggactacaggcgcccgccaccatgcccggctaattttttgtattttttgtagagacggggtttcaccgtgttagccaggatggtctcgatctcctgacctcgtgattcacccgcttcggcctcccaaagtgctgggattacaggcgtgagccaccgcgcccggcttcttccatttattttattattttatcttaatgtttatgtgtgtgtatgtgtatataggggtattgcacaacttttattagatagctgatattttaatgctattttaaaagtttaattttataatacaaaaattagctggacatgttggcacatacccgtaatcccagctactcaggaggctgaggcaggagaattgcttgaacctgcgaggcagaggttgcagtgagctgggatcgcgtcactgcactctagcctgggcaacagagtgatactccatctaaaaagaaaaagaaaggcagggcatggtggctcacgcctgtaatcccagcactttgggaggctgaggcaggcggatcacgaggtcaggagatcaagaccatcctggctaacacggtgaaaccccgtctctactaaaaatacaaaaaattagtcgggcgtggtggcgggcgtatgtagtcccagctactcgggaagctgaggcaggagaatggcatgaacctggaaggcggaacttggagtgagccgagatcgcgccactgcactccagcctgggcgacagagtgagactccgtctcaaaaaaaaaaaaaaaagtttaatttgataattggcttttgttgaaagtatatagaaataatactgattttatgttaactttgtatccaatgttcttgctaaatagtaaaatctcatatttttatattttgggttttctacatatactgtcatgctattcccaaataatgttagttttattattgtattttttactttctctctttttttaaaaaaatagagatagagtctcactacattgcccaggctagtctggagctcctgggctcaagcaatcctcccacgccagcctcccaaagtgctgggattacaggcataggccaccatgcctggtcttttaaaaactttctaatcacatagttttcttgctttctgtcattgcctatgaaattcagtataaaattgaatagaagtaatgttaatggataatcttgtcttattcctggtctcagagaggaagtttttaaatatttaatatgaaatacattgtttgattgggtttatttgcaaaaatcctttatcagatttattaagttccctttgttttttaatttattatgttttttaaaaatcatgaataggcattgaatttatcacatattttctgttattgaatggataatatggatttttatccttttattaatagcatgcattatattggttgatttgttaatgataaaccaatcttgcattcttggaataaactcaggttgcttatgatgtataatccttctttatatcattagacttagtttcctaacattttctttacagtttttaaatatatgtttatgatagaaacgcgtttctacagaaaaaaataattatttttaaaggcatagttattgggtactagacttagtacctgaatgatgaaataatcggtaccacaaacccctgtgacatgagtttgcgttataacaaacctgcccatgtacccctgaacttaaaagttaagaagcaacacacacacacacagatgcgcacacacacacacgcacaagaaattggcttttaactttccattcttataatgctctagtcggagtttggcatcaaggctatcctggctttatatagtaagttaagaagtgttacttttcttttacttattcggaagagttgtcttagtccatttgggctgctatatcaaaatagcataaactgggtggcttaaaaacaatagaaatttatttttcacaattctggaagctggaaagttgatgatcaaggtcctggcagatttgtgtctggtaatggcccactccctggttcataaaacagaatgtcaccttcttgctgtctcttcaccttctggaaggagcaaggtagctctctggaacctcttttatgagagctgtgccctcgtgatctaatcatctctacaaaagccctacctcctaatatcataatcttaggggttagcatttcaacttatgattgcaaaggaggagggaacacaaacattcagatcatagcaagtttgtgtaaatcagcatttttttcttccataagcatttgaagaattaagagtgaaatttataggcctagaattctcttcatgagaatgttaattataaattcaatgtctataacattaatagttatagaattatacagagcctctatttcttgttgtattagtttggttaatcaaaatggaaaattttaacataccttgctcaaaaacagaacaaggagacaaaagaaaatcaataagggtactgaaaacttcaataacaggaataaccaacttgtatgtatgtgtgtgttgctggacattatcatttgtgagatacatttatattgttgtgtgtagctgtgtatcattcattgtcattatatagtatttcagggtgtgaatggtcaatttctataaatgttctgcatgttcaagaaaaagcagtattctgacattgcttgttgttgtgttctgtatatgtccattaggtcatctttgctagttgtgttgttcaaatattctgcattcttttttattctttttgtttgcttattttatcagttactgagaaaattatgttaaagtgttccacgatgaatagtgaattgtttctccttggattttgtcaattttttgtgtcatatgttttaaggctattttattttattagattcttaaccaaatataaatatgtgatatctttctgctaaattgaaacttttagcgttatgtattatttacctctatttctgctagtgataaactattatagtttttgtttgcctgaaatgtcattcttgatagatatttttacatgggtgtaaaattcaagattggcatttatttcattttggtacattaaagttacctcctcaatatcttctgggttccactgttgtctcattgtgctgcttcatcagtaatttattatctttcttccaattttactaattttgtcttcttgtgtgtccaacatgctattaaaagtattccttgagttgttaattttggttattgtgtttttcattttaaaaattataattattactgatcaagtctgccatgatattttttataggtttctgttccctgcaattttttttttcaagacaagtcttgctccgtcgctcaggcgtgatcatagctcactgcaatcttgaattcctgggctcaagtgattctcctaccttggctcccaaagtgttgggatttcaggcatgagccgctgctcctggctcctgcaaatattcttaagcttgtcatttatttatttaaatatattaaatcttcatctgataattccagagtctgaagtctgcaagtgtatacctgctgtgtgctgtttcagctggacagctccatatttttatgtgtgccaacttttatttgacttttgatggtccatatcctgaaaatgatatttgccaggatatcctgagatcttggatggaaatacctttcttcacgatagatttttatacaccttccagtgagtgaatactactgctagtaaaccactttaaatcaagttcaagacttgaagctccttggctacttagactacgtattctcagataaaaatatgcaggatatctggtatctagttacaagtttataggattaaattttcctttcctattttccttctggcctttttggtgccaagtcaaattccccagcagttttctgggctggagagtaggtgggtttagttttcacatactattactggaaagattagtcctttgaagttccagcttaatgtagtttggaggccccataagactccccatcttgaacatcctgcttctttttttttctttcttcctttctttcttcctttctttctttctttctttctttctttctttctttctttctctttctttctttctttccttccttcctttctctttctttctttctttctttttcttctttctctttttttttttttttcagatggagtcttgctctgttgcctaggctggagtgtagtgacaggattttggctcactgcaacctccgcctcccgggttcaagcaattctctgcctcagcctcgggagtagctgggattacaggcgcccaccaccacgcctggctaattttttgtatttttagtagagacgaggtttcaccatcttgaccaggctggtcttgaactcctgacctcgtgatccattcgcctcagcctcccaaagtgctgggattacagccatgagccatggtgcccagcccatcctgcttcttaatttctgtcttcctacaacttatgtccaattttatgtcaagttcaatattctgtttacctctttgggcttagctttcctccacaatttgtcctagcagttccccattatcttatcagattttcagtgcttttaagataattgttttaatgttttacccaagaatatttagttgatttcagtaggatgactgctgtaaataatttaggctgccattacctgatattccctatcatagagttctatcaccagtgactagcatctaagtaacattgaaatgcttttatgtatatcttaaaatatttgaattacttttgttttgaaaacaatagtatctttactttccctaaaccttgataagggattcatatctcttattattaattttgggaaaaaataattcataaacctggtctattatgaaatgtttgctaattgagccaagagagcacatgcattcatctaaaacattcatataatcaaactttattaaaggtgatatttgtggctttacttgacataaaacagcttccatatttctctattccagacattttatttaaaatacatttttgagcataagatatttaaaatgtgtaggcaaataagatatccatatcattaaaagatatctaaagctggtaatggtggctcatgcctgtaatcctagctacttgggaggtcgaggcacaagaatcacttgaaccagagggaggcggaggttgcagttaacggagattgcaccactgcattccagcctgggcgacagatgagactctgtttaaaaaaaaaaaagatatctaacaataaacaagtaaactatcaattataatacaatcaaattcaagctacaactgaaataaatacatggtatctaggaaactcagaggggaagcaactaactcagtatggtggggggtagggggttgaggcagaaaaatcttcccatataggatgtcacatataattatagtgtttatatttgccaattgtaaaaaaaaaaatggcaaaagagatctcattcagaaaagcaataagcacaaaagttttaggaataactttaatgagaaatatgaagtaaaagtatgaaattttgttgaaaaatattttaaaatcttgtataaatgagatggcataatgtatttttaggcagaatattacaaaggcatgttttccacaaactagttggatttggccctgtgtcaataaaaattccagtaagatgattattttgctttagcatgacaacttttttcctaaaatttatctctaagaataagcgtgaagaaaaaaaaaattgaaaaagagtttaaagtgtagacgttctgttatcagaattaaattttggggctgggtgtggtggctcatgcctgtaatcccagcactttgggaggctgaggtgggtggatcatttgaggtcaggagttcaagaacagcctgaccaacatggtgaaatcctgcctctactaaaaaatacaaaaattagccaggtgtggtagtgggtgcctgtagtcccagctactctggaggctgaggcaggaaaatcgcttgaaccctggaggtggaggctgcagtaagccaagatcatgccactgcactccagcctgggtcacagagtgagactctgtctcaaaaaaaaaaaaaaaaaaaagaaagaaagaattaaattttgggaagtcattattagcaatattgtgtagtatccattggacaggatgagagtagaggaaaggagatcattaaaatatacaggtaagaaattatggatatttaaattcagactagaggcaagggctttaatatgatataaaggatagaattgataaggctaaatgtgggagatacagtaaaataataaatagatgctatcaaggttcatggaaatgttgagttcagtatgcaaaatgtcatgtaaatagacgtagacaataatcattttaatttgttgatctgagtggggctgaattctaaatatagactttgattcatctgcataaggaagctggattatggataaaaccatctatgaacaatgtataaagtgtgaaaaaaagggataaggtcaaaatattgtggaacacatttaaaggtctgagagaatgaaagtccacagtctaaaagcagtaggagatgtaggaaaaaaactaggaagtggtcctttatgcaaagcaaaagaggaaagtttgaagaaaatgagttgattgaagttgtaagatgtcacagaagtcaagaagaggtctctgaagtgttcattggactggtcattatgatgtcatgagcactttagcatgagcagctttagaagtgtggttataggagaagcagtgaattaaagagttaaagtaattaagaaaacagagacagaactactgagtaccccccaaaagcaattatcttcaaaatatggaaaaccagattgggatacaaaaaggtttcttgttaaagataaaggaggcctgagtaagtttatatctcatgggaaaatggtaccagagaagaaaaggttgaagattagaagagttgaaaattaaagggccaaggctggttttttgttggtttgttttgttttgttttgtttttaaagagggttttactctgtcgctcaggctggagtgcagtgatgtgatcactgctcactgcagccttgacaccccgggctcaagcgatcctcctacctcagcctcctgagtagctgggattacaagcacgtgccaccacacctggctaatttttaattttttatagagatggagtctcactgtgttatccaggctggtctcgaactcctgatctgaagtggtctgcctgcctcggcctcccaaagtgctgggattacaggtatgaggcactggactgaggcttcttaaatggtggcaaggaacatattttgtgctttaaatgatttaagtatttaaagatcatagttttcctggcaacttactgtagagatcacttcagaatttccctgggtagagtagtgtgctgtagaagtatagtgttgtaagccagtgtggattgggagtccataccccttatttatctattctgtgtatcctattaataacagtaattatcaggttattttgcctttgaacaccttagtaagtctgagcatttacatggaaaaaatgctgggtttattcctcctgttattgtattttacaagtctgtcgagggtccacagtgatctttgccccataattgtaaaatgagatattagaatcatccttatttatcttaaccacctactccactgtacagttcctataattccacaaacttctctttatattggtttatgccttctttagatgattgtgaataagagtattatcttaacctctctggtgggtctacttctgtaacggttgtgggtcatgaattattttttactcagacataattatctttggtcttatataaagaaaaccctacagactccaccaaaacactcttggaactaataaacaaaataaagttgaaagataaaaaatcaacttacaaaaatcaatagcatttctatacactattgaactatctgaaaaataaatcaagaaaaccatgctatttacaatagctatgagaaaataaaaatacttaggaataaatttaaccaagaggatgaaagacctgcaagttgaaaactttaaaacattgatgaaagaaattgaagaagacacaaataaatggaaatatattttatgttcatagcttggaaaaattaatactgtttaaaatgtccatattacccaaagcaatatacaaattcaatacaattcgtatcaaaatttcaatgaagtttttacagaaatataaaaaacttccctaaaatttgcatggaaccacaaaacaccccaaatacccaaagcaatattgagcaaagtaaataaataaataaaacaaaacatacaaacaaaaaaatgaagctgaagacatcatactacctggcttcaaaatatacttcaaagctataataatcaaaacagcatggtactggcataaaagacatgtagaccaatggagcagaatacagctcccagaaataaatccacacagttactgtccactgatttgcaacaaaagtatcaagaatatacaatggaaaaaggacagcctcttcaataaatggtggtgggacaatttgatatccagatgcagaaaaatgaaactagacccttatctcacactgtatacaaaagtcaactcaaaatggattaaagacttaaacatagacctgaaattgtaaaactaacaaagaaaacacagtgggaaagatgaaagatcaataacactgatctgagcaatgatgttttttatatgaccctgaaagcacaggcaataaaagcaaaaatagactaatggattgcatcaaactaaaaagctcctgcgcagcaaagaaaacaagagtgaagggacaatccacagaatgggagaaaatatttgcaaaccacagatctgataaggagttaacataccaaatatataaggaactcaaacaactcaatagtaagaaaacaaataacacgatttaaaagatgggtaaaggatgtgaatagacatttctcaaaagaaagcacacaaatgaccaacaggtatactaaaaaatgctcaacatcatgaatcatcagaaaaatgcgaattaaaaccccaatgagatatcacctcacacctggtagaatggctattattgaaagaggaaagataacaagtgatggagaggatgtggagaaaagggaactcttgcacacggttggtaggaatgtaaattagtacaatcatagaaaacaatatggaggttactcaaaaattgagactaaaacaactatccagcaatcccactactgggtatatatccaaaggaaatgaaatcagtatgtcaaagacctatccgcactcccatgttcattgcagcattattcatgatagttcagatatagaatcaacttaggtgttcatagtggatgaatagataaagaaaatgtgaaatatatatatatatatatatacaatggaatactcatcagccattagaaagaatgaaatcctgtcattcgtgacaatatggatgaatctggaggtcattatgtttagttaaataagccaggcacagaaagacaaatactgcatgatctcattcatgtggaatgtaaaaaagctgatcttatagaagcagagagtataacagtgattaccagagatgggtagggcagtagtaaggaggagagattgaggagaggttggtcaatgggtacgaagttacaattagataggaagaataagttctggtgttttattgaacagtagagtgtagttaagaataatgtatatttcaaaatattatagaatagaggattttgagtgttctaacttcaaagaaatgataaatgtttgaggtaatggatatactaattaccctgatttgatcattacacagtgtatatatgtattgaaacatcagactgtagcccataaataggtacgtgtcaattaaaataataaaaatagtaaaatgtatagttacttccacggggtagaaaatgtggtatatattcatggtatactacacagccttaaaaaaagaaaatcctgtcatttatgacaggaaaaaaaaataagataatccaatgtaccatttgttgaaaatactttttctttttattgcattatcttgacatctttgtaaaaagtcggttgaccataaatgtgtgggcttaattctggactctatttcactcctttgatctatatgtttatcctttcactaaaagtagactgtcttgatattgtagctttataaatttgaaaatcagctgtgaaatcctccaaccttgttctacttgtaaacattgttttggctattataggtcatttaaattttcatataaattttagaatcaacttttcaatttctacaaagaattccgctgggatttatattgggaatgtttttaacatttagatcaatttagggaagatttggtatcttaacaatattgagtcatcagatcgtatgaacatatatacctccatttacttgggtctttaaaaaattgtctcagcatgttctgtagttttaagtattgaggtttcaaaagttttttgtaatacctattcttatgtattttatggtttaaaaaattctattgtaaatggattttaaacagacttttaatttgcagagactatttcttcctttccaatattaatatttgtttatttattttgtcattataatggctaggacttccaggacaatataaacagaagtggtgagagcagacattcttgccttaaccctgatcttatgagaaaagtgttccatattttacaattaagtatgtgctactcataggtttttcccaaatactttattaaatttaggaagtaccctttctggtttgctcagagttttatcatgattcattgttgaatttcatcaattttcttttaatctattgatatgagcatatgatttttcttcgttttactaatatgttggattacactaattgatttttgaatgttggaaaaaaccttccattcctagggtaaatcccacttagtcatgatatattatcttttcaaacattgttagatttaacttgtattttagtaaatatttttacatctgtgttcatgtagaatatctgtaaataattttgtaaagaatatcttttcttcttgaggggtaatgttttcattaggttttagtatttctaacctaataaaatgacttaggaggtgttccttcctctattttctgaaaggttgtgtaatattggtgttatttcttccttcagtgaaacattctgtgccagggattttcttttagggaaagtttctgataataaattcaatttctttcatagactttctattaaaaatgttaacactatttatattttatttcatgctctgtcaattttgttaagttgtattttttaaaggatttgtcagtttcattcaatttatcatatttttggcacaaagttgttaataatattctctcatcttttaacgtctgtataatctgtagtgataacatctttttcatttttgatattggtgatttgtgttctatcctcttttttatcaataagtctagctgagaatttatcaattttgctgatttttttcgaatagccagcttttggctttgttgatatattttctattgtttggtttctatttcattaatttctgcttttgtctgtattatttgccttcttatattacttcgggtttactttgctctcttttagattttaagtggattcttaggtaactgattaggtaactgacatttcttctaatataaaaaaattaaagccacgaatttattagtatgaactgctttatttgcattttactaatttttatatgtgatgtttttatttttattcatttaaaagtatgttctaatttccattatgatttaactctttcacccatttattacttaggagtgtgatcaagtttacaaatatttttggttttcctagctatcttgttgcttttgatttctaatctaattctcttttggtcagagaacatactctgcatgatttcagtcttttaaaaatctgtttagacttgttctgtggcccagcaacagtctatcttgatgaacatatcacgtgcacttgaaaagaatgtatattctgtaattgttgggtgtaatgatttataaatataaattattgttatccagattttctgtgtctttatttttttgtctagttgtcctatcaattgctcagagagcagtgttaaaaatcacctatcatcattgtgtttatctctttgtgcccatttttgcttcatgtaatttgaagccctgttattaggcacacacattgatgattattataatttcctgatttattgatccttttatcttcataaaatatcgatttgttgctggtcatactttttttcttgtagtagcttttgtgtgatattaatgtggccattctagtctcatgttttctgttttcatggcatattgctttttgttcattttacttttgtttctttaaagtatgcccttgttgaagcgtattgttggatcttgctgttttacccattttgataatatctgctttttaactgaagtgcttagcccattcacattagtgtaatatttgatatgtttagatttgtgtccttcaatacattatttgctttctatttgtcccctctgattttgttcttctgtttccgcttatctgttgtcttttgaattatttgggtattcctcagaatctcttttaatttttagatataactatttttagattttttttaatttgcattttttagtggttgctgtaaggattacagcatacatacttaacttttctcagtccacttaatagtgtacaaccttcataaaatatagaaaagttacaaccatataagactatttagctcttcctgtgccattgcttatgctatagttttcatttgtattaaatctcatacaatacaaaacccacaagacacagttataatttttgtttaagcagttattatgtactttagagaattaagaaggaaaaaaatagtcatttctgtttacctagtcatttaccatttctagtgccattaatttgttcctaaagagctgagtttatccataatgtctttttgcttcaacctgaaaaactttacttagcagtttttgtaatgcatatatgctgcagtgatttatcttagttttcctttatctgaagatctatttatcttccatttgaatgatatagaattctgggggattgacagattttattttcttccacttaaaaaaaatgttattctactgtcttctaatgctcatagtttctgatgagaagtgtgtagtcatttaagtcattattccctgtgtgcgatatgattgtttttgttgctcttgcatggctggggggacacttattttaaggttttctacttacctttggtttagaagtttgactatgatgtgcttatttatgcttttctttatttttatcctgtttatggttggctgagtttatcaaacatgtacatgtatattgttaaccaaatttgacaaatttttgttccttatatccttaaattttttaatcctaatttctctctatcctttctggactccaattacatacatatggtactttttaaatattgtctggttttaccatagtagggttaaagtttggtcctttaagactatacatttctttcatattcttgtatattctatattgttcaataggtctctgagatttattttatttttattttatttcagttctttttcttttcttcagattggatcatttctattgatctattttcagattcattgacttttgcctcttttagctccatttttcccaagatcaggcagtgagttttaatttcaaatattatatttttattgctaaaatttccattggctttcttatattttcctttttttctgataagatttcctttattttcattccttaccaataagttttcctttatcttattgaatatagttatagtagctactttaaagtcattgtccgctaattcccacatctgtgtcatctcaggtttggattcttgatggtctttacctttaggaatgcatcacatttttctggtattctatgttaggtaattttggattatatcttgatattattaatgtgttattcttgagattcatcattctgtttgtgttagtccattattgcactgttataaagaaacacccaagactcggtaatttataaagaaaagaggtttaattggctcacagttccacaggctgtaggaagcatgatgccggccatctgcttggcttctggggagccttcaagaatcatggtggaaggcaaaaggaaagcggctcatcttacatggccggtgcaggagcaagggacggggggaagtgctacgcacttttaaacaaccagatttcacgagatctctctcactgttatgagaatagcaccaagggggaaacctgccccatgatctaatcacctcccaccagggcctgcctacaaaattggggattacaatgtgacatgagctttgggcggggacacagatccaaaccatgtcattctgccactgccctcaccctccgcgaaatctcatgacgttcttacattgcaaaatacaattatcccttcccaatggtccctcaaagtctgaactcattccagcattaagccaaaagtccaaagtccaaagtctcatctgagacaaggcaactctcttctgcctatgagcctgtaaaataaaaaacaagttagttactcccaagatacagtgcgggtacaggcattgggtaaatactcctgttccaaaagggaaaaaccagccaaaagaaagaattataggccccatgcaagtccgaaatccagtagggcagttattaaatcttaaagctccaaataatcttcattgactccatgtctcacatccagggcacactcgtgtgagggatgggctcccaaggccttgggaagctccactcctgtggctttgtggggttcagttcctgcagctgctctcatgggttggtgttgaatgcctgcagcttttccaggcacagtgtgcaagctgcttagaactgctggtggattcccattctggggtcttgagggtggtggccctcttctcacagccatttcactccagcctgggcaacaagagtgaaactccatctcaaaaaaaaaaaaaaaagaaagaaagaaatttcctctgccaggtaccctaaactcatcattctcaaatttaatgttccgcagattcctacagcacaggcataatacagccaggctctttgctaaagcataaggaaagtgacatttgctccagtcctcagtaagttcctcatctccatctgagacctcctcagactggacttctttgtccatttcactatcagcacttcggtcccaatcattcaagtagtctctaggaagttctaagctctccctcatcttccctccacactattccaacctgtgcctggttacccagttccaaagtcactttcacattttcaggatctttatagcaatatcccactctcagtatcaattttctgtactagtcttttctcacactgctataaaaacacctgagactggataatttagaaagaaaagaggtttaactggctcgcagttctgcaggctgtacaggaagcatgatgctggccatctgcttgtcttctggggaggcctcaggaaacttacaatcatggtggaaggcaaaggggaatcaagctcatcttacatggcatgagcaggagcaggagcaagagagagagaagggggaagtgatacacacttttaaacaacaagatctcatgagaactctctcactattatgagaacaacattaagggggaaatccacccccatgatccaatcacctctcacaggccccatctccaacattggggattacaatttgacatgagatttgggcagggacacagatctaaaccgtatcactgttatatttctatgaagggtgttgacatttttgttttagtagagaataaacttgattagactaaaaatgcaaaatctttcttgcttctgcttggtagcagttcaaacttcagtttagttcttttagctttagcctttgctctttatatgtgattcagggacggcagagatgtgggaagaatttgatcatagaatttagggctcaccttcttttgttctgtgcactcaaggattctctacccctctcagttgtggattacagtgctgttgctcctggctcctcccctttgtccttaagctggagaaactagggattatctgtcagagttttaacttcctcatgctgtgtcacaaccttgatcagctattaggccaaagcaacaaaaacgggaaactcacttcatgctgattcttttctccaagttttagtgccctcctctcccaaaactgcctccttttgtttattccccagagtccttagatatttgctttatgtattttggccaggagctatagttgttatctctggaagggtctgtttattatgagcttactttgatctactagactgagcttcagacattgtgttttgaaatttttgcttaacattacatttatccaagaattaaatttaatatttatttatttttttcttcaacttttaagttctgaggtgcatgtgctagttgtgcaggtttgttacccaggtaaacatgtgccatggtggtttgctgcacagatcaacccatcacctaggtattaagcccagcatccattaggtattcttcctgatgctctccctcccattgctcccccaacaggccccagtgtgtgttgttccccttcatattttcatgtgtactcatcattcagctcccacacatagtgggacgatgtggtatttggttttctgttcctgcattattatgctgaggataatggcttccagctccatccatgtccctgcaaaggacaagatcttgttcctttttatggatgcatagtattccatggtgtatatgtaccacattttctttatccagtctatcattgatgggcatttgggttgatcccatgtttttgctattgtgaatagtgctgcaatgaacatacacatgcaggtatctttataataggatgatttatattcctttgggtacatacccagtaatgggattgctgcgtcaaatggtatttctgcctctagatctttgaggaatcgccacacagtctcccacaatgagtgaactaatttacaaccccaccaacagggtaaaggtgttcctttttctccatctgttgtttctggacttgttaataattgccattctgactggtgtgagaagatatttcattgtggttttgatttgcatttacctaatgatcagtgatgttgaggtttttttcatatgtttgttggctgcatgactgtcttcttttcagaagtgtctgttcatgttctttgcccactttttaatgggcttgtttgggtttttcttgtaaatttgtttaagttccttgtagactctggatattagacttttgtcagatggatagactacaaaatttttctcccattctgtaggttgtcttttcactctgatgatagtttcttttgctgtgcagaagctctttaatttaattagatctcatttgtcaatttttgcttttgttgaaattgctttaggcacttttgtcatgaaatctttgcctgtgcctatgtcctgaatggtattgcctagcttttcttctagggtttttatagtttcatacttttatgaattacgtctttaattaatcttgagttaatttttgtataagatgtaaggaaagggtccagtttcaattttctgcatatggctagccaattctcccagcaccatttattaaatagggaatcttttcctcattgcttgtttttgtcaggtttgttgaagatcagatggttgtaggtgtgtggtgttatttctgagttctctattctgttccactggtctacacgtctgtttttgtaccagtaccgtgctgttttggttactgtagttttgtggtgtatatgaagtcaatcaagtagcatgatgcctccagctttgttcttttgcttaggatcggcttggctataaaggctcttttttggttccatattgatatggtttggctgtgtccccacccaaatctcaccttgaattgtagttcccataatccccacatgttgtgagagggacccagtgggaggtaattgaatcatgggggcaattatcccatacagttctcatgatagtgagtgagttctcattaggtctgatggttttataagggctttttcctttttgcttggcacctctccttcctgccaccatgtgaagaaagacgtgtttgctttcccttccaccatgattctaagtttcttgaggcctccccagccatactgaactgtgagtcaattaaacctctttcttttataaattacccagtctcaggcagttctttatagcagtgtgagaacaaattaatacacatatgaattttaacatagttttttcgaaatctgtgatgaatgtcaatggaagtttaataggaataccattgaatctataaattactttgagcattattgccataacactgattctgtctatccatgagcatggaatgtttttctatttgtttgtgtccactgtgatttccttgagcagtggtttgtcattctccttgaagaggtccttcacttccctttttagctgtattcctaggtgttttattctctttgtagcaattgtgaatgggagttcattcataatatggctgtctacttgcttgttgtttgtgcataggaatgctagcaatttttgcacattgattttgtatcctgagactttgctgaagttgcttatcagcttaagaagcttttgggctgagacaatggggttttccagatataggatcatgtcatctgcaaacaaagataatttgatttcctctcttcctatttgaataccctttatttctttctctttcctaattgccatagccagaacttccaatactatgctgaataggagtggtgaaagagggcatccttgtcttgtgctggttttcaaggggaatgcttccaggttttgcccattcagtgtggtattggctgtgggtttatcatatatatggctcttattattttgagatatgttccttcaatacctagtttattgagcatttttaacatgaagggatgttgaattttatcgaaggccttttctgaatccattgagataatcatgtgggttttgtctttagttctgcttatgtgatgaattacatttattgatttgcatatgttgaaccagtcttgcatcccagggatgaagcctacttgatcatggtgaataagctttttgatgtgctgctggatttggtttgccagtatcttattgaggatttttgcattgatgcttatcagggatatcagctggaagttttcctttttgttgcatctctgccaggttttggtatcaggatgatgctggccttaaaggagttagggaggagtacctccttttccattgtttggaatagcttcagaagaattggtaccagctcctctttgtacctctgatagaattcagctgtaaatctgtctggtcctgggctttgtttgcttggtgggctatttattattgcttcaatttgtaatttaatatttttaaatcttgggttaaatggttgaatgaatgtgtgaaaagttagatatcaatgaatgaatattcttaaatgtataaactttaatcttgctggatataggataaaatttacattaaaacactgtaattaatcagtcaatttaagtaaaataaattcaaggaagtggtctgaatttctcagtgagcatttagatatttatgggagtcatataaaataaattataaatgtgactgagggctttttattaaggaaaatgaaatattgctatggacatgattctgtgtgtttctttactacactatgaactaaaaattttggagacaaatctaagtatataaattggtttattgatgaccgattgggaatataaataggcacaaaaatttggcgaagcattttggcatgtctacctaaaatttaaatatgtaagcactagtccccccttacctgcagtttcactctgagcagtttcagaaaataggtgagcacagtacagtaagatattttgagagagagaccacattcataaaacttttattatagtgtattgttataattgtcctaatttattattattgttgttaatcttttactgtgcctaatttataaatcacactttatcataggtatgtatgtataggaaaaaacatagtatatgtagaattcagtattatccttggtttcagacattcagtggggatcttagaaagtattctctgtggaaaaggagggactactgtacttttaacaaagcacttcccagaataaacacacagacatatacatgcacacactttcagaaatgcacttaaatattcaatcatggagtaaaaattaattatgaaatatctagacaatgaacattatgtagtttttattaagaaagaagcagaattatatatactgacatgaaaggatgttcattatatatgttaagtaaaaactaagttcatcatatatgttaagtaaaaaaaagtcacaaattaagagaaagtgttaattgatttgagagtttgtgtattttttttcctattttgtgctgaaaagctgaagttggcatcaaccaaggcatattgttatctatgtatcaagctaaataatttaaagatctttaagactattaattcagagatgctgtataaatagaatcagtgccagattttttgtttcaattctatcagccaagtatactatgctttctttgcttgtgatagaaaaaagagagaaaaaacacagaagcaaaaagtaaagttgtacaatagtgtgtagagtgtggttccattttgtaaaatgtatcagtgtgtatatttatatagcatagtcaaaagcctggagtgatataaattttctgttactggtctagtatacaagggaattagattttaaaggactttcattgtttttaacaattctgaacaaatttaatttggtacaagaagtatatattttaaatattattgaacttaattaaaataaattagagctcaaaaaataaataaatcacaggaagttcacagtctgactttatcaggaatgttgctattttcttaacaggtcatcaaacattatcactgatgcttggaaagaagcactttttataatttaaaaataccttttattcttcaacttctgctggcttaaagagcactaagtccacatatcctaggaggcatggctgtccaatatatactatgtgtacattgatttatgaaccaataaatgtttcatacacagttgagattttaaatgagcttatgataattggatcaaaggaatactagtccagcttgagagtactgcagaaaaccaatcacagaaagctatgatgaaattttaattataaaggatattgaatatcctagagtgacaactctgttataataaatgtaacactgaatgggaaagagagaaaggagatttttacccatttctgtttgaaatcaactttctatttctagtaaattatcacaccattctgttttaatttttatatcttaaagttatcattccagtgtctttggtttactgggtttataaaagaattgaccagtagctatataatagatacagaaaagtctgcctgggtgtggtggctcatacttgtaataatattatattattataattgttctattttattattagttattgttgctaatcttttactgtacctaatttatacattaagctttatcatgggtatgtatgtataggaaaaaatgcagtatatatagaattcagtattatccttggtttcggacattcagcaggggtccgaaggtgggcgaggtgagcccactttgggaggccaaagtgggcagattgcttgaccccaggagttcaggaccagtctgggcaacatggtgaaatgctgtccttacaaaaaatacaaaaattatctgggcatgatagtgcatgactgtagtcccagctacccaggagcctgaggtgggagcatcactgagcccggtggttgaagctgcaataagttttgattatgctactgcactccagcgggacaactgagtgagaccctgtctcaaaaaaaaaagtcacaaattaagataaagtgttgattgatctgagaatttgtgtatttttttctattttgtgctgaaaagctgaagttggcatcaatcaaggcatattgttatatatggatcaaactaaaaaattttaagatctttaagaccattaattcagagatgctgtataaatagaatcagtactagattttttgtttcaattctatcagccaagtataacatgcttttcttgcttgtgatagaaaaaaagagagaaaaaacacagaagcaaaattgaagaatttgtaaatcatttctaaataatttcaataaaatgagctttgaaagggaaaatttttagataacattatctcatcaaaatgccttaaagtatattttaatattcagtaagaacagtgtatattaacatggctaatttagaggatttatattttacccacatgataatgtattatgcctgtaactgctaaaggaattatgtagcaaaatctgtcaaggaatacacgagtgggatttatatcagaaaaatcaaagccatttgtaaagccccattacttaggcagaatatcataggtaggaggtagatgttactgaaagaagaagttgggatatgaaatacaaatctattttgcatcatgattttgttaagtccggctgtttattattaaaaacatgtacagaagattcaattgaagtttctaaaagagaaagaaacttgtagttgtgggaacaatagtattccttatgaaatacttagatattaatagcttgagactgataatacaattcttaagttaggggttgcatgtgtagtggtcagatgttatttcaggatctcaagaaacagagccatggtaaaaagaagcttcctggagcttctgataaattccgtcacctttttgggacccagtttcttcatcaataccaacctcattagggtcctgtgagaagtacatgaggtgagatatgtactgaaataatatgccaactcttaagtgccaagacattaggatgcaagggggggtgcccaaaaagtcaacaattacttgatactctagatatatgtatggataattttgagaagtaatccttcttacacagaggtgtaggtttgtttgttccaagcagcaaacataatgggtataggaaagagaaactgtggccttcatatagactgagcttaggaaaacagttggaaaacagttcaaattcaaggtacttcaacaatatctagtgtgtttttgaaatatatttttaaaacccctatccaaatcaatgaatgctttggctaaaacctacttgggaatgagggtgttctttagtgccaaatactcatcttattttagtccatgattttagtccatggctaaaatcccaagagttacagaggagaaatagggccaaacaaggtttctattaaaataagaggtcccaagtgatgaatggaaacttggaacaggtttaatggcaactataagccagaaattagctgaaatacacactaatgaatttggggcatatcttgagtttcagatagaaaattggtactaagtttagtgaattagaaacatagcttaacctaggcagttgcaattcttgttccaaaaatgctcaatttgctgctggactgcatggacacttgctacctccttgttttgagtcattaacaaaatgttgaatgggatatctggagtatcaagtaattgttgactttttggtcacccaacccccttgcatcttaatgtcttggcacttaagagttggcatattatttcagtacatatctaaccttatgtactcctcacaggaccctagtgaggttggtattgatgaagaaactgggtcccaaaaaggtgatggaatttatccgaagctccaggaagcttctttttaccatggctctgtttcttgaggttaaagaacatgatttaccaggctctgtttcttgagagaccaagagtggatccctgtagtccccattagaattctccttctagtttgaactattccattagtaaacactttttggcatgttatttaaacaattacaaaatcacctaactacactgtcttgcagctgcctttctttttttgtcttgtccacgtgagtatattgggagactttgtttaatgtctccacaaattctagatagactgttcctgcagcatttctttttttaaattttgttttgataagcatttattttggcaatgattctagtaaatgaaactaaagtgcccatatgaaaaacaatcttaagtctatgtggttagtttgaagttaccagtttttaattaagccggagtagtccttagtatgaatgccttcatttctaagtgctcataaacaatcactttagtaatattacagttttgaaggaatttatatcaagcttaatggcactttttaaaagataggaaattgggttctctagtcacatctgtaagttatttcagtgccttggaagatcatttatctggccacagataattgacttacttacatcagttttttttttttttgagatggagtctcgctctgttgcccaggctggagtgcagtggcatgatctcggctcactgcaacctccgcctcctgggttcacgccattgtcctgcctcagcttcccgagtagctgggactacaggcacccaccaccatgcctggctaatttttttgtattttttagtagagacggggtttcaccatgttagccaggatggtctcgatctcctaaccttggcctcggcctcccaaagtgctgggattacaggcgtgagccaccacacccggccacttatatcacttttatgcttcctatctccttattgatcttgaggttcaagtttcacttaaccattttcttcaatgaaaaataattttataatttaaaaaacctcaacctttaatattctatgattcttgttaggccatctcaattgagaatactgataaagaagtaaaactccccccaatactggctagtttgattttatctgttaatattacgcaatctgccccaaacctgtctctccctttttattgttacttatccaaagatggcttgaatctcttatggcttgaatctctttgtttattctaagcaattttcagacacctcagccaactatcaataatatattagttttttagaactaaaaatgtagaggatctccccctaaaagccaattgttaatgccaaatatttgactgatatatttcttctggaggaagggagatgtgaaaaaatttagccatcaagttatgtgaaaactttttcatcttcccatccactggatgttttatctgtaaataatgctataatcatattggaaagtattttccttctggggatgcatgaagatcaggaatcctattcgtttttaacaagatggaatttttaaaaactactttggacaactctaaacatcagagatgaccatttgtctcttttttattatataacttgtgctcggtttgtagagcaacataaatacatgaattaaaaaatgaaaactagctccttccctatttgacagatacttctcaacctcctctccataagatatgctctatccctatataggaaatttttctgtagcagcttgagtttactaaaaataagatctgaagaaaatgaagcaattaacatttattgagagtctataagggtttctacattgtgaaggagacagaaatataagacatggctcctgctttcaggttgcttataattaaagagataatattaaattatttggatgaatttaaaaatgacacatgccatcttacagatatgctgtagactgtgaaaatgaaaaaaaaaacctcgtgtttagagtagacactgtttgatggattaggtaggttttcatctggactttgaaatgtatgtaagattttataaggaggagagaaaataagaagctgtttgtattagaattacacagataaatttgtaaatttagttcttttcaaagaacattaattgagcacctctgtgccaagctccctactggatgctgtagattacagcatgtttaggaactaacttcatactctgttgctaaagtatttctgtgttttctaaaaaggtaaatctcttgtgaggaaacaaatctcttgaaggggttctcataacagaagtcccatttacttcatgatataaaaaggggctgttttctggttttgttctcaaaatgtaggatatagttctagacgtaattgggaaagcttaactttgttgcatacgcatcttccctatcatggttgatttcctatatggcatagttaaatgtgtttatccgtgtttgatatctaaagggccatgctacatatagactgccaactaaggttttatctgatgataataaattgttgtatttcatgacgacagcaacaacaacaataatgtacttaactagtcactgtgcaaattgctttacatacattttctcatgtaatcataataataaccgtatgagttttgcttactattgttttccttaattaaaatgagtaaagtgaagcttaggctaagtaacatgtccatagccaaacagttagtcactggcaggagtgtgactgactccaaagtctatattcctaattactgtgttctactttttaatagagagctcttgaaggtccaaggaaaggaatgcataatggtgtggtcaaggcattagtgttaatatttgtagaaagggtaattaacaacagtctgagcaatcacattctaacaactagtaaggttggcaggagcctcagtataatggtgtgaggaacgaaatcattatagtgccaaatagagtataccatctctttagtacaatgtctttcaaaatgaggctgattgtgttggctttatatttgactccttaataattaaggcagtaaattctagctggagctaaatacctacaaggcctaaaacagcataatggacaacctggcaggtgtccttgctggaagatgacaagagtgctgaaaggagagtcctggtttttctcccaagacatgacatttgggggcttccattaaaaaattaccaagcctctgccactgtaatctcttccttaagtgcctatgattttttcacagtcacaggtctatgcctggtcaatacccagtggccaggtctctgagctgcgtgcagagatggcagcgacttggagggctgggaggagataaggggaggaaagatcacttttcatgacaacttacaacttgattccacttataagccatttattttcagaaacaagtaatgggtgaggacacaggccaggtccacaatttgtgcacttgagagattaaggcctccgagatcaaattaccacagcaaactgagacagaattattgtagggatgtttggggaggatgcagagagaagaggaagaagccagagacccaagaaaggagacaggaatagattttgatgaaaattgcttcctactctgtacccttgaggaaacaaagaggacaaataagaagcagcagtgataggaggctgggcgcttctctggaataacactggctaggtagtggagcattgatagtgagtgtgcttggttggtggaacgaagggatgtgctagttcaggcctttgaattctgggtgtcaggatcacaaccttggctcctttaactgtccgctctaggagggaagcatgccaaatgtcaggtctcactctgactttgttccagtccatagctagaaaatgacccatagaggaagatctacagatgacagaatactgggagatgaagagaaaggacgttttagtgagtgctttttttgcacatgaggcaatagatttcaaattcctgtggaagaaatgtgagaacctgggaagagtgaatattcagaactgagcagcagaggcaatgacacagcatggaaagatttcctctgatccttctaccttctcttttactgaagtgaatttgttgtctctgtgttgcctctatagcagtacaagaggaaacttggggacacagaagaacagaagtctaaggagtcttatatttaaggaagataagctgcagtcattgaaattgctggttattgtaagataaatcccagactcccacattttgcttaatgacagcagatttttttttttttttaactgcaaagcattaatggaatccaaattccagcctggcttaggagatcaacagtaacgctcttgatttaatggttttgcagactcttgaagacattgtcatccattaaagaaaaaattttaaattactcttgaaagaaaatgtcttgggtgataaatgtaaaagatttgaagcaagattagaaaaagcttgagagaagaatctctttaaaaattttaccagattttccccattgtcgccaaaatgggtcaaataatagatttgcctacagcttcatggagactatttttttaaacagagcattttaaacatttaaatattggttatttgccaaggcacacactgaaaataagggccacttggccgagagcagaattgagtcttggatcccaggatgctggttttaggcttgctcccggaaagagggcagcatttgccatccccctccttttgccctaggagttgagcactttctgcagtacttaagagtgtccagggaagatgtgggagtcaggtgaatagttcccatcgccagtaaccccagagcgcctccccctgcgttgtttccttttaatgttagatccgccgcctgggtgcccatacttagctaaggcccctcagtttattttcctgaattgcgcttggagatcttttcctggggagctgatagccagacttctaggggcttgactgcttttcccagactaatctccttaaagacccgttaagcaggggagagacggtggagactggatgaactggacagtgggggtagggagaaagggagtggccgtgttcctgcggtccgctgggatccggcaggtccagggtgaaggagatggggctggagaggctgagcagtccgggttcgctgtccgccacttcggcgcggaatcagagcaggacttgctgagccctcctaccgctccctttccccctccccctctgtcttcccttctgtttccttttccctccccctggagctgtagcggcagcagcagcaggaagccgagccgggttgagcgactcggaggcgagcggaggagctggaatatggggagtcagcgaggacggtggggccaggagcccttgggagggcctacggagggagcggccccaggcgctttctagagcgtgagcggtgggggagcaggcgcagggtggcacgagcggaggcggggcccgggcgtggggcacggctggggaagctgccgcctccggccctgcccggctgcctccgccgcggccagtggctatggagcaggcgggcaccagacctgcggcgacagagcatccacggctccggcggcccatgccctggctgctgctactgcctctcctgctgctgttgctgctgctgctacctggccctgcggcctcccagctgcgatactctgtgccagaggagcaggcacccggcgcgctcgtgggcaacgtggctcgcgcgctggggcttgagctgcggcgcttggggccgggttgcttgcgcatcaaccatctgggtgcgcccagtccgcgctacctggagctggacctgacgagtggagcgctcttcgtcaacgagcgcattgatcgggaggcgctgtgtgagcagcggcctcgctgcctgctcagcttggaagtgctggcgcacaaccccgtggcggtgagcgccgttgaggtggaaatattggacatcaacgacaactcaccgcgtttcccgcggcccaactaccagcttcaggtaagcgaatcggtggcgcctggagcgcgctttcacatagagagtgcgcaggaccccgacgtgggcgccaactcagtacagacctacgagctcagccccagcgagcacttcgagctggaccttaagcccctgcaggagaacagtaaagtgcttgagctggtgctgcgtaagggcctagaccgggagcaggcagccttgcaccacctggttctcacagccgtggatgggggcatcccagcccgctcgggtacggcacagatctctgtgcgtgtcctggacactaacgacaactctcctgcctttgaccagtccacttatcgcgtccagctacgggaggactcacccccaggcacattggtggtgaagctgaatgcctcagacccggatgagggctccaatggtgagctcaggtactccttgagcagctacacgtcggaccgggagaggcagctcttcagcatagatgccagtaccggggaagtgcgagtaattggggggctggattatgaggaagcctcctcctaccagatctatgtgcaggcgactgaccggggtccagtgcccatggcaggtcactgcaaggtgctggtggacatcgtggacgtgaatgacaatgccccagaggtggtgctcacggacctgtatagcccagtgcctgagaatgctacacccaacaccattgtggccgttctcagtgtcaatgaccaagactcaggccccaaccggaaagtgagcctgggtctggaggccacactgcctttccgactgaatggctttggaaactcctatacactggtggtgagcggcccactggaccgagagcgggtggctgtctacaacatcacggtgacagccacagatgggggaataccgcagctcacatccctgcgtacactgaaggttgagatctctgacatcaatgacaatccaccaagcttcctggaggactcctattccatctacatacaggagaacaatttgccaggtgtgttgctctgtactgtgcaagccacagacccagatgaaaaggagaatgcagaggtgacctactcccttctggagagggagattcaagggctgccagtcacctcctatgtctccattaacagtgccagtggcagcctttatgctgtcaactcctttgactatgagaagtttcgggagttctttgtgactgtggaggctcaggacaaggggagcccaccactgagcagcactgtgactgccaacgtatatgtggtggacatgaatgaccatgcccctcacattctgtaccctacctcaaccaactcgtcagcagccttcgagatggtgcctcgaactgcccctgctggctacctggtcaccaaagtcatagctatggactcagactctgggcaaaatgcttggcttttttaccatctagcccagacttctgacctggacctctttaaggtagagctgcacacaggagaaattaggactaccaggaagatgggagatgagagtggtagcactttcaacctgaccgtggtggtccgagataatggagagccatcactatcagcctctgtggccattacagtagctgtggtggatagggtttccaaaatcctccctgacactcagaggcatgttaagagccctcggacatactctgaaattaccctttatctaataatagcattaagcacagtgtcttttatatttcttttgacaatcatcattttgagcatcatcaagtgctaccgctacactgcgtatggcactgcatgctgtggaggcttctgtggagtaagggaaaggtcccctgcagaactgtacaaacaagccaacaacaatattgatgccaggataccgcatggcctcaaagtgcagcctcacttcattgaagttcgagggaatggctccctcaccaagacctactgctacaaggcctgtctgacagcaggctcagggagtgacactttcatgttttacaatacaggggcccagacaggaccagggccttcgggagcccaagcagcagtgactgacagcaggaatctcacaggccaaagtggtcagaatgctgggaacctgattattctcaaaaatgaggctgtttctcaaaatgaggtgagacagtggtcagggggtcttctacaaactcatgcatttgttacacatcccccaatatcctgtgatttggctttattgagtcattaacagtgacaagagttatctggtaaactgagtatatatagtatccacaatttgatcataatctgctatttcctctctagaaaaatagcactaaagaattgttttatttttcattttcagaggcatgaagccttgtccataaaattgtttgagaagtgaggattagtcttaatatttaatgctaaaacacagatttgtagagaaacaggacaggccttggaatagggattatgttttagggagtaatgttatgagactcaaggagaaatggcctctgctgtatcatctacagggaaatttttcttttgaaatcctatatgagtgatgtttcttaaaaagctctgaggcctctaggggctatcatagtcaccactatctgctgtctctgtttatactctggactgtctacagtggaaattatctagttaatatttctggtacttgcactgaacctatgtgataggatcctctggaaatgcatgtcacaagtgataaagctgtagtatttagacatcatactgaagctaaagtttgctttggctgtatgatgtggcaactcttctgtagagggctgtcagagggagtggatgatggtgaggcagagagattaagtaccaatttgtctggttggtccagggaggtattagaatgagtggattaggggtgtggggggatggtgaagaccaagagaagctgggattagaaggaagagaagggaaaaagaattctcccaatagtcacctttcttggcatactctgaattcattgtaagaggatttccctgaatttagcttaaatgcagcctgtaatcttctgattttctgttgacagtttctatggttttgatgagatgtaaagtagccttttcaagtccttcatgtctttaagttaaatgacagtacttccaaagcatgcattcattttctggatctaaaatttgatttgctatagcttcaaaaggctggcttggaaagtggatggcttaccctacagtaaggtgtagaggcaggtgttagtatatgcactagttttgagatttaagtaggtataaggccagcttgttcattattatgaagaatgtacataaattattagaaagtagatgaatatgtgtgtgtgtttgtgttgtgtgttcgtctccatatgtatgcttgaaataacagagatatgctttgtgatacttaaaacttggatttcaaaagccaaaattttgtaccataaatagtgatgaattgttatctttccaaataactactttgtagaaagggcttttagagctactacacaatgtgtgaacaatatttgtctctcctctattttttgcaatatattttcattgacatattgctgtacatacatattgtatgtaatatccatattgttacatttcaagttcatggtaatcttgaggaatgtaatgcacaggcacaaaagttccattcctgattgagagtagatttttctcatggacatttcagatagatttattcatttatcagaagtgcctggtgttagtcaatgctgagaaaccatgggaggcagattgtagattaagaaaaatgggggaataaatcaaagagtttccagaagtctttagatcgtagcatttgaaagcacgtaaaagggtttagctttaaataaggttgctgtagacatttgcttaacaaattcttgtgaagccctttgggattggggtgggctacaggtggtgaagaggcatgaacaagtcaggccaggctcagctttgccaccagctgtaagccggaagctcagaggaaagacactgttaccctccctctcctgactcaaagcttggggcaatttgatacataaactatttctgtcttacactgacctgtatattaatatgtactttggtacacaaacatttaatctagggagaaaattatttcagaaagtgcttgcttttgggagattttgccaggagagtgcatgactttaataaaggcaaatttctgccaggcacttttggaaatccagtgaagaaccccaagatctacagctccagaaatttttgcagttatagggagagagtgtcacattgttacagtgtggcaagataggagcaaaagccactcagttctgaaagtcatcattgccagatcaacctgttaaattcccatgttgggctttctttttttcctacctagttactacagatggcaggagagtcctggggtacaattagtaccatgtgcctacattaaaagtagatgggaattagagaggaagagtaagggaatttgtactcactaaccaccctgctatatagatatatgtatatcatacatatacacatacatatatctcatattactgaatcttgaatattattcaagattattcaatatattgaatattataatattgaatacatatatgatttcattacctgcaagtcatgcgttaaatatttgttaacatctagcatatgaggaaataagctcagggaggttaggtaatctacacagccacactgctagtgttattttaagttgtatccatctgactccaaaaactttttttcaatactatgagtagacagaagttccaatgtttatattcccttttatatgggatattcaggcatttaagctatcactaattcacctagtcgtatatattaactgcttttggaaaaagagtaatttctggcatagaagcaggtaacaaatgggaatatcagtgagttactactatttttttatttttatttttttgagacagagtcttggcctgtcacccaggctggagtataggtgtgaatatggctcactgcagcctcgaccttctgggctcaagcaatcctcacacatcagcctcctgagtagcttggaccatagatgtgcgccaccgtgtctgactagtttttaggtgttttttttttttggaagagatgggggtctcactatgttgcacatgctgttagtatatttgtatttgtttatttgcttcactattggcaaaccctgttaagatcttttatttttattatttcactgatttttctcttgttgcttattaaacatcagcatttaaccccagactctaatctgttggtagattttacccccagtgagcttatttcataaatcacttgtgcagtgaggattctgaagtaactatttggcaatagggcagaatttctctttggaaatttctgaacttgatactgaatgttgttggcactcccttcagagtctccataaaaagaaaccaaattttttttttttttttttttttgagatggagtctcactctgttgccaggctggagtgcagtggcgtaatcccggctcactgcaacctccgcctcccaagttaaagtgattcttctgcctcagcctcctgagtagctgagattacaggcacgcgccaccacgcctggctaatttttgtatttttagtagagatggggtttcatcatgttgtccaggatggtctcgatctcttgaccttgtgatccacccgccttggcctcccaaagtgctgggattacagatgtgagccaccatgcccggcaaaggaaaccaaatcttaaggtagattctgtgcatttgtggtcgtggtgttgtgattgttaatgagtcactttgagtactctagtagatttgtccaacagtgtctcagtgggcccagctggcacaacatgtagaaattatgaaagagtagcagagatgaattaagtttgcattcactttcacttattttaaagcaatttgtagtcaccaaaccttcagttatttctgccactatgtgtgcatattcaccctaattccaggtatagtgacctgaaagagttaattcttctttcagtggcacctacttttatttcccccagcactgatttttctatctgatgactctatcctggaacagagtttacactcgttgtaaagtgacatagtagtgaatttataaaaattgcacaatggtcagaatagacaaagaaatcatatctatgagcttccactccagtttttcatcctctgatggtcactttataatgactggggctgttttagtttgcaaatttcatattggtcacaggactcttcttctgagaaaaagtttattttctttggtctgatgatacaataatttatttcaattacctctttcctcaatttttctacagactgctgagccagatggaattatggctgagctcttctctgtttctgtatcttgtacacattctgactgaagaagaaatctatttattgtagcttgaatgtcattggcctactgtttccttctgacccaggagtgagccatcacatgggcatctggtctaactcagaacactctgcagggacacagcctggcatattataggttgcctattggcatgctgtctacttgacagaatagcaaagtcagttctgggtacttgcttgttgcctaccaatttttgctctcaatgagaggtcagaataatgtcaatttgcaaatgtttgaggaaacattcctgtcaccaaacccagaggtttagctgaatatgatggcattttacaggtgtctttaaatgtggcttttacagaacttcacctggatcaatgttttgtgcatgtgataatacaactataaatttagcttattaatatgataatatttggagcagtataatctataaccatgacttcaaaaatcaaaggttaaaagtattcttttgcagtgttttaaatctgctaacctgaaaactatacaagggtttttctttcaagaattttaacttgacaaatgcaaaggaatatccaacattgcaaaggtaaagagaaatcttagttccttggcatataagcaccatcagttcctttctggccttccagggtcagaactctgggctccaaggaggtacaactgtgagtgagagagtagctgctgtgctagcaggctatgcatccagaactaaacagacctagcactttctgttgtactggaacccattaggtatgttctaaagttatgtttattttactttcctggtttgtaaattagcattttaaatgactacattcagaggaaagtattccacccagaattctcaaatgtattacctttgtgttttattttattttagtttttttgagacggagttttgctcttgttgcccaggctggagtgcaatggcatgatcttggctcactgcaacctctgcctccagggttcaagcgattctcctgcctcaacctcccgagtagctgagattacaggcatgcgccaccatgcctggctaattttgtatttttgggtttcaccatgttgttcaagctgctctcgaactcctgtctccaccttggcctcccaaagtgctgggattacaggtatgagccactgcgcccagccctcattttgatatactagaagaccaatatgcaacataatgattattttaaatgttatattcccttttgccttaatgcggaacagtctatgtatcccttttctgatgatttgtaacaaattaccacaagtaagttgtttaaaacaccacctatttgttatctcacagtcctgtaccatgtggctgagttgtccgctcaggtattctcaaggctgaaatgaacacagctgggctgtgttgtcctttgcaggctcttaggaagaatctactatcgagctcattcagattgttggcagaatccagttgtttggggactgagatctctgttttcctacttactattggcctggggtcactctcagttcctagagaactgaggactcaggactcttgtcccatggtctgctccatcttcatggctggcactggagaatcttccctcacatggaatccctcttatgcttcagatctctctgatttctgtctctgacctctagacccagatttaaagagctcatgtgattatgtcagtcccatccagatgatctccctttcttaaagccaactgtgctacatagcataatgtaatcatgggaataagatccatcacaatcacagtcttggagactattcagggtgtgcacaccaggatatagggatcttggggccatcttggaattctgcctatcagtttatatcaatgttcataaaatagcactatgcaaaatctgcagtggatatattcttaatacagtcctattaggaaggaaaaggagatattatatgcagtctcatgtcccagagggcaatttgttgatgtcttccacatggatttccatggtacgaagatagcatattatttcattgagtagttgtgtgagtttattaataaaatagggtattttaaacttattttactttaaatcttagaagaggtgattcatccttctgtagctcaaatattctatgtcataaatcacagataataccattacaagataaattaaatcttttttataattttaataggaactgaagtgtattcttattcttcagtaatactacatcacccatatggactacctaattgattttttccacatatggagttttgtgaccattattctaccaaaagactaacctttgaagcaataggacatattagagttcttcaccaatagaaagtaagcatagtcctgggaggtaccatctaagtattaaagaactaaataatcacagttatttcaactgtgattgaaattgtgatagtaatatatgtcttactgtgtcagatatatcagtagtcaacttttcaacttgaatttttccaagtttaatcaagttctggatgaaactcatgtacattttactacttttagttttgtattgttttaaatcaatatcctggaaactcagaagtaaaaaagagaaagaagaaaaatatatgtcatttcatgtaaatttatttaaaacacagacttttggcaaggcacagtggctcaagcctgtaatcccagcactttgggaggccgaggagggtggattgcctgaggtcaggtgttcaagaccagcctggccaacatggtgaaaccccatctctactaaaaattcaaaaattagccaggtacggtggcagatgcctgtaatcccagctactagggaggctggggaagaagaattgcttgaatccgggaggcagaggttgcagggagccaagatcgcgccactgcacaccagcctaaatgacagagtaagaccctatctcataaataaataaataaatataaataaaacacagacttttgtgttaaggggacctaaacatgactgtcagctgaactcagcaatcagacaagtaatttaatctctccaaagttcagatgtctcatttttgcaatttaagtacaataatgttgactttgcattatagttcatttatttaaacacattttaaaaacctcccagatgccagaagcctgctagactctgactatatagctacgcttttatgaatatctgaagatatgcatgtgtctaatgagcaaaacagatataatccctttcatagagtttactgtctgacaaagaaagaattaggatacatgcaacagtatgtaataaagtgcaaaatctagtactgtgtagctacttaaaacatattatatgctttcttcctttccttttccctgcctgatcttactgccataagaaatcttgtaactgtgattctgtcaaatgaatctaagaaggatgttgttgctgatggactagtatagaaaatagcagcatgacaaattaaatgtgtcattggggaagtgagattgtataatgaactgagtttcctggtcagtcctgctggaactgtgcctttcagcaaaatgagtttgatgatttcattccaaagatcaagttgcagcaattttcatcatgaatgttacccaatcatagaaaaattggcaacatttctcagcagatgttacagtctttctcaaaggaaggttctctcagctgacaagctaacgatagtgctcctgatggcgaggggagagacggtgatgatgactgattgataaaaagtattttagtcatatttccaggtttataaaatgatttgcaaacattttcttttgttccctctaacaccgctagtagataatggaaactcctttgatttggtctgtagataattttatgctatgttatatggaatatccacagcattttgtgaacttgaaaacaaaggaggaagcagcttgcatatgcatatcttgctagcagattggtagaatagagagagcagttagcatgtgaggaccattgaggtaaagtatcccagagttgtaactttttctgggccttgactttggctaattctctgcatgccaaatatcatgtagccatccagaaatctgtctgaatattgagatggtgatcatttctctcctgggtgttatgaagaaatgtgtttattaaatactttgcatcccttaaaggaactatatgaatgataggaataagaattattgacagttttgaatggtctattgatattactatggctttgtttctaccaaatatggtaagtataatgtagaggaaaatacaaaatacaacttttatcccccatttttttcattcaactatacctcaatattcagtgacagggccacctcaatctccgcccatgaaaacgcatctagaggagtgtcacaagtttttcacagtgacatttttgcttactgatacaagacagtgatggtgactgatgatgtcccagtgatttctgagtagcttctaaccagcacataactcccccaacagtctttaagtctttaggtgcccatattttcctctttgttctcccccttcagactgagagtttgtagagagagggcaacagatcttttcaatacacaactaatgcaaaatgtatcaggtttttcttggatttcagctactccctgttaaacaatcagagcttagtgaacagtgattcagtgaggagggaaagcactcaggaaggagcaggaacaagtacaagtttatgaaaaggattagctagcaaaacaaggtcaaactctgcaatagtttgttttcctctccctagtatccctcttcaatcagaaaagagactgttatcagttgctggtgttatgactgggcacatccgccctgggtcaaatatgctgcagtctgcaaagccagcagcagattgcagtcctctgcagtccagccaggccagcagaacttgtgtagccatgtgccctgttatagctgtaatactgaattgggaatgttcccttaatggggcacttgagggcaaaagcagtgaaagcttttcctttctcaaagcagactgttcttcccgtagtgttttaagaacacagacatgtattgggcaaggcaaagccaaaggtggcctttacaagattattaaatctggtcttccagggtatctaatctgtgtgaggaccctgatgaactaattttcttctaaagtgctatatatgtagatatcatcatagagttacacatgaaatggctcattcaatacttttttagatgcctggaaatatttaagggagtaactaatcaattagcagcattcctgggagaacattgtcttgtcattttaacagaaaactctctttgtgattttgcagccacgacagcccaaccctgactggcgttactctgcctccctgagagcaggcatgcacaggtatgtatttccctcctcattcactcagaagtaaccttaacttggtatggctcagataaactgcatctccataggccagaagcagctgtcaaaactaaaaagctttaggtactttgccaggaaaatgcaattattttgtccccatgtttattccttgaaagatcgcaaatggtcagtgccagatgcttatcaagtgctggcatataagagtcctctgtaaaatcacagaaacaggctgctatgtattttctcccatcaaaatttctacagggaagtaatttcaacctccttcatccctctctacctatgctttcttttcctcctttaaaaactgtaattaatactcatgctttgagacttgggtacattgtgcaatgtatacatacatgttgtctaccttgttttttttttaatctcacattggctattacatcctattaccctcaataattgattgctattgttgtttgtgttcacacctattagagcctcctcatctttcccatctgttgctatcttattgtcatcaatgacatggttcttcagaagatgagccatgtaaagggctccaaatctagcttactttaaattaacctagagtaacggtattagtctaagactcagattaaatataattttgctttctctactttgtctctctgacagtaattgattaactaccattatttctggaggtgatccagtatccatgccatggggccaaataaaagattcattatttgcgaatgtctttggaaaccaaatgggaaggaccaagaaacaaatgatcacaactatcaaaaggatttaattttaaagaagaaataatcttcaaacttaagcccctcaaaatatctgggcaactatcaagtgaatattcaccaaacttagatcagttcgtaaagagaaagcctacaaagtatgtgtagagttaatgtgaaattagttttagcccattaaaatgcattagattgaaataaattaacatactctcaagcattacaaatgagcagaaatcattacattgggtgctatttctgattcagaagcaatcagtgaagggctgaagattagtagttggcttggtaagatgtcacattggaacctgggtcataattttaggccagaaacattcatgcatataccagaatattaggtatcagaagaaattctttatatttattagagaccaacttgtgcttttgcctgcatctgagctgttggtggagacatgcaatgggtaaaagcatggtttacagtaccaactcttgaaaagtaccaaagctatgagttgtgccttaaaaactacatttgaaataaaacattaaaacataacttcctggactgggcgcggtggctcacacctgtaatcccagcactttgggaggccgaggtgggcagatcatgaggtcaagagatcgagaccatcctggacaacacggtgaaaccctgtctctactaaaaatacaaaaattagctgggcgtgatggcatgtgcctgtagttccagctactagggaggctgaggcaggagaatcgcttgaacccgggaggcggaagttgcagtgagccaagatcgagccactgcactccagcctggcgacagtgcgagactctgtctcagaagaataaataaatgaataaaataacataacttccttatcccattttcaaattgaaaaaaaaaagccaaatgtgctcctattcgggtttcaattaagatattatgagatttgagtagggtaagaaataaaataaaaattgaaattaaaatgccatttcttttttgcattgtaatacattgaacatattaaatgagttgtgaacctaaataatactaatctttttcgtatgtgtgcttgggtgttctcggtctttccagtcttggacatcatgtaactattctttaaaaaattctgctttgagctgagctggctccaggatagttacaccttcatgaatctgactgagcccacacaatttgctagtaggatccaggaacacttgaaggctgttaatatttggggaaaaaaaacagataattctagagtgtagacaaggggaagaatagtaaaaggtcagagtttaatgagtgaatttctactggatatgttgtttgaagtcaaagagtgagaaaacattgaacttatatgttgccttccctctaatagttcaagtttgcctgctctgttgcctcatataacccctttagtcagtagtctaaattttattttagaaatttaactttcaagataagcaaatgtctagtttaaaagggtcctctagtctaggtgtagtggctcatgcctgtaatcccagcactttgggagggtgaggcaggtggatcacttgaggtcaggagttcaagaccagcctggtcaatatggtgaaaacctgtctctactaaaaatacaaaaatgagccaggcatggtggcgggtgcctgtagtcccagctacttgggaggctgaggcaggagaattgcttgaacctgggaggcagaggttgcagtgagctgagatcgtgccactgtactccagcctgagtgacagagtgaggctttgtctcaaaaataaataaaataaaacaaaatgttcctctaattttgatgagggttttcttggacattttctcttaggatcccacttatttcttccttcctttcttccttcctcccttccatcattcattcattcattcattcattcatccaacaaatatttgagagattaatatgagttagtattagacatacataaatgaatactgcaccatgttctcttttcccttgaacagtttatgttctatctctgcttgcctctaaaggtctcccagtttgtatctcactcccagcaatgttttatgctgaattaatctcttctgagcggggatctgtgagtggtggtgatcaagtttctctagtctcaggaaatatagggtgggtcatctatgcataaaagatatagaaagagtaaaatagaaaataaggttaagaattaattagatagccaaattggaacaatactccaattatcagaaaatattttagtgtgttttcttctttagagtagagaacctaggaacaagagaacctgcaagagaggcttggaacttttgagaacaagccctcctcatctgcttcagtatcgagatgttaaaatggcttagtcctctgatgggcttcctgttagatttagtgagcgccacatggcgttaataaaaaacagaattgccataaagatagaacatgtgtgttcctggaatagtatagcaggcaataagtaagtcagcaatgcttctgcagtttatgcagggtgactgctcagcagtaattgcttcagttcaagcatgagcagaatgtgttagctgcagccctggcttcatagttgtaagcaatttctgagggtggaagaagagatgggaaagaatttatgatctaaccgttatctgggtctgtgtgtttattcagctctgtgcacctagaggaggctggcattctacgggctggtccaggagggcctgatcagcagtggccaacagtatccagtgcaacaccaggtaaagagctggggtctctccattctttcttggtttctggaaagtgatcagatgacctacttttgtaagatcaggaatgttgatggctctttttcttttatatttttgttattcccttttttccatacatacatgatttccttacatatatgattattttgattttatacctaatgctcttcaggagttgaaaaaggataacaaggaaagtgtgtgtgcacgcatgtgtgcatgtgtgtgtgtgtgtatgaagtttttggggtttgtttgtttgtttaaatcaggtacctttcaaatgcttaggtcatccaagccatgcagagaagatctggtggccttatgcacagagatgacactgttaacaaagatcttttggttgaagactatggaaacccacccaaagtagtaaggaaagaaagagaaaaagaaggaaagaaagaaaaaggaaggaaggaaggaagatggtttctcatggaagtggaaaattatcggaaccaaggcattgttttgagttcaagtcaaagtcaatctgcttctctctgcacatcaacaacattctgcagactgacttttagtgccttggcatgcatgttgccaaacatgaccgcctcacaatttcttagtttagagggataatagggactatttcctaatccaaactttcaggaaagagaacctgctaagttgtgtaaaaaacctaatggctgggtgagtataggaaaattgcttaaactcacatttgcttggtatccttattcttgccctatcactaaagcagggtcatgtaatagaaatatggctttggaggcccatcgctgtggcagttttcagaaagggaagattaagtgttggtagagaccacaaattgtgtctactctaatcctctattaatagaacatcatgatgataatagtagttactaattattaagccataatatgcctagacactgtgccaagtacattgtatgtgtggtctcatttattccttaagtcaagcttgcaagggatttattacatctattctacatatgagaaactggagaggcagagagattaagaaatgtacccaagttcacgtagcttgtaagtggcagagggtaggattcaaacccagatgtgtttagtttcaaatccaagtatatctagcacttatattcataacatggctggcttgcaataatccattcaaattcaaatacatatctacatacataacagatgacagaatgtgtgtgtaaaaggttttttcccaaaaataatcagatgcctttcaaattattaagtaacatgcagctaagggcccatttttactggcaactttaagggcattcgttgattctaatcagccaggatttgctatttatggatgttgcacaattcaactaaaagtcacatttgtccaaaaaatatacgagttgaagcaattcattagagagctaatattgccagattgcaaggggaaaaacataaaatagttcattgacaaatctgtaccctcagtgccaacgatggagtgaagaaatgatggaggaggaagtggttttagactgccaagtgttgcaggatgtggaggcatctgggaaggtgagaacttcccaaagaagccacgtgaaatcatgactttctaccttgcctttatttcagagtttttcttgctcttatggaggcattgtaggtcgacctggtaagccacaaactaactttgaatacattctccctcccattggtgatgctggttggtgtgtattcctaggcaaatgtggaataggaaccatgtattgatatttcatacatctggccaagtccctctttcagattcaaaaaatgttgagaacctatcttttttacagagatagagaaggggatctcccttgttccctttcttactgtcccagcccctcttgtataacccattttatccagaactgtgcctggctgctgatgcatgagtcacagtcttcatggactgtgctggatagagcttacatcttccaactactccatggcaacctaatcatacttttcaatacatacctctgcatcagtggtgtaaagttaaagggattctctgccttctccctgtccttctggtacttttaggtttttaggactcaatatatgttctgcactgcttggagggaatatggcataaagattaagattatgatttagagtcagatttgagttgaattctaatcccaagcttacttgctgggtgagcatagacaaactgcctgaattcatattttcttaattaccctttctgtaaattgggtgtagtaataataataacacctattttattgagttaccatgagaactaaaggagaaaaaaagaactgagcatagtgcttgacatatagttaataaatgtctaatcttttttttttgagacagagtctcgctctgtcccccaggctggagtccagtggcacgatatcggctcacagcaacctctgcctcctgggttcaagtgattctcctgcctcagcctcctgagtagctgagactacaggcgtgtgccaccaagcctggctaattttttgtgtttttagtaaagacggggtttcaccgtgttagccaggattgtctcaatctcctgacctcgtaatccgcctgcctcggtctcccaaagtgttgggattacaggcgtgagccaccgcgcctggcctaatcttcttactcttttttctttctggactacttttctgcaatctatgatatagtgttggctgatagcctggtggccagaattcagtagttctcatttgcaggcccagatatagaccctctgaggttatctgggtctatataatccagtcaccccaactgttcccctggaaatggagtgaggaggatttattagttgctgcctgaagaaaagggaaatgctccaaaaaatttggttgtttccagactcaaatagagcctgcctttcattgattctgttgcccttaaagcttcacggtgaagatgcagttgcttccaaaaggcttctttctggtgcctaagcctccttatacttgcttcagagccctttccgtgaaccagctgtgtattgctcttctcatcccaacacttgcaatggctgaataaaggaagtggggcctgccttacgctaatcctcgttcatatgtgtttcttaaagttatttttccttcactgatgaattccttttttttttttttttttttgagacagtctcgctctgtcgcccaggctggagtgcagtggcacgatctcagctcacaacaagctctgcctcccgggttcatgccactctcctgcctcagcctcctgagtagctgggactacaggcgcccgccaccactcccgtctaattttttgtatttttagtagagccggggtttcactgtgttagccaggatggtctcaatctcctgacctcgtgatccgcccacctcagcctcccaaagtgctgggattacaggcgtgagccactgcgcctggcctcactgatgaattcttttgctttttaaagaaactgttcatttattttcacagtctgcaaaagcctaagataaagatgccacactctgaaaggatcaacaagggcatcaccaagtaatgttttctgcaggataaacaagtcaggcattaaattggttaatcctgattactggcccctttctctagcctcccctctgtgtgagcagacccggaccacaggctttcttatttcctttcagcttcccttgagactgagcagagagagaaaattagctaaatcaggaatgcagggaatacagttgcagcctcttcttcagatggaggaatgcgttttggggggagggacattaaagggccagtcgctcatgttacagctctttttaacttcatgagtactaatgccctgaagaggttttaatgaatgccctcttgtgatcagttcctagggcaatcccaggttataaaaggactgcccctgcctgtgagggaactggcctggcttcagtgggccaggctgctttgttatctgttattggtttttccagctcctctttctacatttcaagggatctcaggccttacctaaggcaacagtacattagttttagagtgggagatgctcacagttttcagaagagttcagaaagtttcaaaacacacagcactgcagaagataacattatagcttctcaagaccccaggggatctgggactaaacagtgaaagattaattaggtagcggaagccactaaggcagtgagtcttagttagagaactttggtttagacaatggttctcaaaggggcagcaacaccaacaatacccggaaacttgttagaaatgcaaattcttaggccctatcctagactaatgaatcagaaattctcaggatggaggctgggtgtggtcgctcatgcctgtaattccagcactttgggaggccaaggcaggcagatcacttgaggtcatgagttcgagaccagcctggtcaacatggcgaaaccccatctctactaaagttacaaaaatgagctgggcgtggtggcaggtgcctgtaatcccagctactcgggaggctgaggcaggagaattgcttgaactcgggaggtggaggttgcagtgagctgagattgcaccactgcactccagcctgggtgacagagtgagactccatctcaaaaaaaaaaaaaataataaataaagaaagaaagacattctcaggaatgggacccggcagtctatgttttaacaagccttctatgtgataccaatgtactgtgaagttttaagaactggtctaaggtaaatattcctgaggttgtcttatatcattacagggtcagaatgcatgcaaggaagccatctgtttatggttcttgtgagaagcagggggcctttccccatgcccgagagataattgttaagagctcaagcttgggagtcagtgaccctttctgaattctacctctgccactcagtaattgtatgttcctgggaccattacttaactttcctgattctcagtttctttctctataaaatggggagaatagtggtgtctaccttatagggttcttggaagaattagatgagataatgcacacatattgcagaatctgaagaacaatcagggtttagtaaatagtagctatttttaaatgatttttccaggtatgagtctatcctacagcttcaaaatttagacccaggttgttctgagtattctctgtgggaagaatctgctatagagaagatttttttaaagtgcctgtctctttgtttccttaggggattgcttttgccctgatttgccacatctctttactctgtggaaaatggacagtttatgtgccctagttttatatggggatttatattcttaattgtctcaaggattcttacctgtctgacaaaaccaactccccatggaaagactccatggagactccatctctgatccttccccagaaagaaagcatgattcttaagttttttagaatctgtttaggagcactgtcaacatgaatttttctatttcatgagtgagtgcagcctcgggccttgttggagaatttagaaagcatgctgttccactaacctgttcaacctcaacttctgccgttgtcatagcaatgacagtcctgggaggtgtgtgcatatccttattaggaaaaaaaaatgagatcagggatctatgtgagtggggcagctcccgcctgtgagtatccttcgctgtcacctgccatctgacagcccaggagtgccagcttggcttggctttctctacccgaggaaagtaagtccttttaagatgcacttttactttctggggttgtgaaactcattgtgtttgccagagttctcttcgcagcttatgtaaagaatttgtttgttttggattgacctgaagggaggaagcaagggtgtgggaaggggaattagcatcccctacctaggagaagccatgaagcttacttaagtctctgctggctccatccattcatgactttcttcatcttcttcttgggaaaacactctgtaccttccacttttaatggtcatgtaaataaaagactagaatggagatgtcctggttttctgaaattaaacatttttgtttatgaatagactctaagataattctttccctagacgctctgtattttcttggacctctcatttgccccatagtaattattctaggattggtggcctgggcagaatacagtcatggttaagaccatgatacataatagaagaatttcttccgtaacagtagccccaaacagagatcacgtgtctcctgaaacctatccagtctcatgtgcactcagatgtacgatcctggatataacattttagagggtgtagtgaggagaatagaacaacactgttctcttaggctgcagtttccttcaagccccacgatggagagaagcaggctaatgcagggtaaggaaatagagacttattatagtttcttcagttatcattgattcctttaatatgccagctacattgaggcaatacagtctggcctctgaaaaccttgtcaggagaaacaacttttgaatatatcttagaaaaataagacactttatcccttcttttgtttaagagtgttgcataaaacaggagagtttctgaattaccctcccttctagctttctttatacaccattctttgtagctgaagttttaagccccttgtcaaaagggagattcaagtttctgctggggacatctcagtgtcacaaagggccaaggaagtagggtctcaccaactttgccacctgactcagctcaaaggtgataggtcacctgtgtgactgagagctttgtgggaaagatgatatggagggtggagagtctgcacttcactctgtgggaaaaattgctgaggttgtttagaattgttaggcttggaactcctcctgggaggtgcttgaacaagaaagacctgcttataacctgagttgagggcagaggaggaagatagtttgtaattcctttacgttttgtggctccggcaagccctgtcctcagcctcactgacacaagtaaactaaaaatgaaagtctgtcctagtgacagcaagggtctttcatggcaatattttaaaagaaactctgcccagatttcaaaggaacgtgaaaattttatcttcagaggcagtcagctttgcagttgaaaaggccattgcctaatctggagaaacatattcagttcaagcactggctagagactagaggcccccaggaaagggccataagattggtcactgccaggaagcctgtcaatgagtgtgtggactggagaggaatctttctctgcctcagcacttggagtctccgttattcacaatcagaaaaagagggagagcagagatagatgacattccacgtttttctcggtgagaccaagagcttcctcagcaacagccctgcctgaaattgtctatctccaagggcgtgggctaggcaaaggatgggagaagtcagtcctgaagatggtaatacttaaaggaaataagggggacaaaggatgcttgtgctactattgaaacaggaaattgagagctctgtagaagtcagactcaagaggcataataatagaaagttagggtatgaaaaggtgacttttaagaaccaaatgtggacccgaaagagaacaaagagaagtttattgtaactagcgttgtattccttgtctgctggataccaaacaatgtaccccgggtcttgagattatcgatgccattgtctgtaaaaaaccaaccaaacaaactttaaaaataagtaaagcctgccctgtacagaaaatctaataaagcaaatttgttggtgatgttccaagaaggttcaccagcttgggctttcaaccagcattgacccaatcttgtgtccagagctgttgctgtaggtggtatcatgtatcaagctgaatagtgaggtgacattccccaagtcttctctcttgtcttttttgactgtgcatcatagatactgtattacccaagaacacacacctgttcgatctcttttcctataatcacctggagtcagatgaataccgtaaaggtctgtggtaagactagaagcctcagccagtatgaatgatttacattagatgcacaccaagctgctttcggagagtccagatttatggggataagagcatcactaggtatatcaacagccctagggtggatacctttgagcctgtaaatttggctctgtgttggacgatgaaccatggaatacagaagaagctcccttctctcagctaaagcctattagcaaaaatagagccctgaggacattgtattttaagtgtatgttccagtgagtgggtcgttgctgggtcaagttttataagtctttaaatcccatactgttgcctcctggactgtagaaatagtctcttagaacaagagaaaggaagacaatagctaccatttattgagaactgtgataagcactttacatatgttgcatacttaactttgagagaagtacattattattcccatgtttcagataaaaaaattaaagctcataagaattaagtggctttcttacattcacacagctagtaaaaatgttttttgctcaccattgtattcccattgtcaagcaggatgcctagcacacaatgatgctcaataaattttgttaaattcattaataaatgcagtggtaaaggcagtatttgaactcatgtctgcttgctgctgaactctatacacttaacacattactattatcttgtcccgcatgatacatgaagggaatagcttggtaacttggaaaagactatttactgtctgagttctaggccaactgtagggtgtctgtatttatttcccattatgctataacaaattaaccataaacttcatggcttaaaacaacacaatgtattatcttacagttctggaagtcagaagtccacagtgagtttcactggctaaaatcaaggtgtgttcttgccactatataacaaggatccactttcctttagtttccaataacaggctccttatttctacctgagccctcactggcagcacctttaatgccatatttgtaataacaatctgttcatgacaatttaggtttgctcctcacttttttctgagtcctctctagtagagccattaatatgcatattgctactagcagcctgttcaaggtaatgtaggctctttctatcatgctcttcaaaattcttctagactctgcccatttcccaatctcaaggccacttccgcatttttaggcatttataacggcagaaccgcacttccagataccaaaatctgtattagtttcctagggctgccataacaaattaacacaaaatcccttttgccatgtaacataacatattcacaagttctaaaattagaatgcagtcattttggtggggccattattctgcctaccacccggtctttcatgttcaggcagaggtggctctgtgtgtgtgtgtgtgtgtgtgtgtgtgtgtgtgtgtaagttaatttcagtagagaatgagctagagtagagaaagagaattaaggtgagatgtgtcatggaagaacagtgactgatgatgctaactttgctcaatcaagaagtgtgatccatttaaatcatgctttcagtgatctatccaatcagataaactactctcccttcctgggaagagtaaggaaggaagtagagctaaagatgaaagttcttttcgtagcacatccctgcaaaggatgggagtattgttttggtgggcattcccttttctaagagcaaagatggaaatgtggagagaggagaaaaatggttcccattacattattgtgttctggacttagagatattgttctgccccaggtctaagaatattgttccaagagttgggagcaggcagcagaggacagtactctttagatcacccagaggccaatctgtaaggattcaatcctggggcatggtagctaatggaaaagtcactgtcacaagtgatgccaggagatggggcaacacatattgcctgccttgtatgcatctagcgtctgtgtctaagtgaaagcagattatatccagaacttccctggaaaatagaagaaagagcctgattggtgtgtatgtgtgtgttaggggttgaggggtgggtaatgttcctgccagtattcgtaaatcccacctgcttttcctgtgatgcttcctgtgttggggataggagggtgggatggttcagggtcaattttatggatccatatgtatctaaggatgtgtttgttttttgggaacattttgtataacaaccagtttcactctagctccctccttgatattctaaacaagctggatatctccaaagcttaggccctctccatacttacagcagctctgactggagattaaatcaccccttatactgctgacaatgattaggccatgggacccatgaaagagcctccccagagtccagcatcccctgtgggctccgtgtgtcatcaagatgtcaatccaactgctgttcctgcagtctgcaatcagcagggctatgtttattcagcggtcagtgtcacatcaatttccttctgttgcaacaagtataaatggattctaaatatttgcctttgggaaatttctttagagggaaactcactaaagctaatttttttagctttttggtatgttctctctgaatctggggatttagatatataaattagcttctttggtcttttcttgcccagggtcacaaccttgcctccaggataataccttctaagtgtttgtgatttgaagggcactacgaagatcctcacaaaaactacctcccagccgggtccctgaaactccatcattaaccaccttcatcagcatttctcttttaaaatccttattcattcctgttctccttctttctttctcacacacacacacacacacacacacacacacacacacacacacacacggggagagagagacagagagagagagagatagagaagtgaagtatatagtatcctttctagggatgcttttcttggcttggctccaatagagaattttgttgggaccctctatatatagtcgtgtaccaaataatgacactttggttaacaatggaccacatatgtgacagctgtcccataagattgtaataccatatttttactgtaccttttctatgtttagatacacaaatacttgccattatattacaattgcgcagtattttgtacagtaacatgctgtgcaggtttgtagcctaggagcaataggctataccatatagcctaggtatgtagtaggctatgccatctaggtttgtgtaagtacgctctatgatgtccatacaacaaaaatgcctagtgatgcatttctcagaacatatccccattgttaagtgatacatgactgtagtcatcatcaaacatttattaagcacttaggtcaggccaggctctgttctaggtgatgcagatataatattaaatataacacagtcctgcccttataaatctaatggtgaagggagaaatgtaaagaaatatgatggaaatattacattgtcatgtgataagggcgacaataatgccctacgtaggtagggtcaacgaaggggaaggaagctgggacaaaccaccagggcctgttggtccagaatgggacccagggtctgtctatgttataatcaattcaaaccctaggtaaataaggtaagctaggctgcctttcttgagacagtccccagattgttttcacagggcccaaacactctcagcaaccatgaacagtggatgttgtgggacctcagaagatggaattggaaattcaggggactaagtcagagattatttgacatttaatactggatattgaggccgggcgcagtggctcacacctgtgatcccagcactttgggaggctgaggcgggtggattgcctgaacccaggagtttgagaacagcctgggcaacatggcaaaaccccatctctacaaaaaaaatataaaaattagccgggtgtggtggcatgcacttgtagtctcagctacttgggaggctgaggcacgagagtcacttgaacctggaaggtggaggttgcagtgagctgagatcacactactgcactccagcctgggtgacagaatgagaccctgtctcaaaaaaaaatttaaaatactgggtattgcaggatggcaagtaggatgtggagaggaagagaattccaggcaaaggaaacaatgcgtgcatgcaaaaacaaaatacaaaaaactgaattgtgtagtctgggttaataagatgagtgcatttgatggatgtggtagaataaagagatgttaggaaatgagatcagaaatgtagactggaatcagattttgtaggaccttaaacatcctgctaaataatttgtagtttcatttgttggccatggagacccactagaaggttagttggtttgtttatatttaggaaagaagattcttttaagtttccttaactctactgaattttcaaaaatcaacctacagcaatccaaacttatctgtggagatacattccaagaccctcagtggatgcctgaaacctcatttagtactgacctttatatacattatgttctttcataggtgcacctatgataaagtttaatttataaattaggcacaatactcttgtgctttggggccagtattaagtaaaataagggtacttgaatacaagccctttgataccaaaacagccagtcggataccaagacactttctaagtgaactaacaggtgagtagtgtagacggcatggataggtcggacagagggatgattcacgtactgggcaggataaagcgggatggctcgagatttcatcacattactcagaacagcttgcaatttaaaacttatgaattgtttatttttgaaatttttcatttaatattttcagactaaggttgactgtgggtaactgaagcctcagaaatcaaacctcaaataaggggcgatcactgtactgaataatatgtcaagatgagctatgagcttttaacttagtgtttttcttctcccaaaccaaatattggaaactttggagtgtttagaaaaggagaatcgaaaagggaagtaaatgcagcattttttttaattgttaaataaagggctgggcttggaaatgttcttaggtaatcctggtggatttggtatatcatgtctgagaaaatgtggagagtgaagggcaggtttaaaatttgtctcatgttagtttctgaagggagatagcctggcattgcacagtgcctcacatttctatcgtatcacttaataattgtgcaacctgtgcttcagatttatcaatgtataaaagaggagagaccataggctgttgtaagtattaaatgacataatgcacgcaaaatgcttagaaccatgcttagttcatggtagccactcaaaaatgtcgtcagaactattactactcagtttaatgctcctagcacttaacacagtgcttggcacacagtaaagaggattcaagatgtttttgctagattacatggaatggtatggaagtgtgcagggtggtgtagagggttctcccattatcttgccttccttatactgcaatgtgctgacagcacctccattttataccctcaatgcaaggatatcactacttgtctagaaatggttgctcaaggctgagaagtgacagcaacacagagcctgggattgctgccaaatttcaagaagcacagattgtaacaaagtaaggggggagggtagagaagaaaagtttgaaaacccaaccaaagtcagaagccattttgttgtcggctgaaataatgcctcatagagtttcaggtggggcaggcagtgtgaaaactttgggaatagtcagtgtcaagttgtggtgctaagggaggaacccagtagtgctcaggcctgggcaagtctggcttcttggggcccagcatttagaaaggccctgtgtgttttgatattatgctgtcactatcttgaagttcttgataatttgttaacaagggccgcctccccccattttcatttggcaaatttcactggttcctgcaaattatgtagttaatcctgggtgcaggctagtttttgaaccatgttgggctagtattcttctgaacctctatctctttgatttaattacagaagaaacaaaagtcataacaaattatatctgtgcaggactaaaataaaatgagtagtgcctcactccctacatccaatcatgctttccaaaagtaaccactaccaataatttagcgtgcatcttcagaattctttatatgcctacattttaatgtatttttaaataaaatagaattacattgttgaagtaaatattaaaaaatatagcatttttgcatagaaatatttatttccctcaatcccactcccctttggtgaagcaaccactgttaacaattttgtgtgtatcctccaatatttttttgaaattaatgaactttactttttagagcagttttaggttcacaggaaagttgagtagaaagtgcagagttctcatgcactcctgctctcccacatacacaatgcccccacacccccgccacagtgacatcctgcccagagtggtacattcatgacaattgatgaaactatattgacatcattattgaaactatcattaccacccaacttccatgtttactttagggttcactcttccaaatatttcttgcatcacttaacaatggggatacactgagaaatgtgtctttaggcagttttttcgttgtacaaatatcatagaatgtacttacataaacctagatgatatagcatactacacacttaggctctatcgtatggcctatttctcctaggctacaaacctgtatatcatgttactatactgaatactgtaggcaatttttacacaatgataagtatttgtgtatctcaacatacctaaacgcagaaaaagtacaataaaaatacattattataatcttacaggacaactgtcatatgtgtggtccgttgttgactgaaacatgattatggggcgcatgactatatagagattttcaaaaagcaaaatgggataatgcaatatgtattattatacagcttgtgtgtgtgtgtgtgtgtgtgtgtgtgtatgttaacaaacacctttctacgtcagtacatatagatttgccacaatcttcttgagtaaggatatagcactatgttgtatacctatattataatttatccaatttgctgttggtatctatgttttctaaacaatacaatatacattcttatacatatttcttatgcatgcttgctagtatttatacaggataaatttcaagaagtagaattacagaatcataggatataaaaatatcaaattggcaaattggcattcacgtacctgtggttggactgcacttgttacatacttccctctgagccttccatccccacctcgagctagtgctatatgtcacttaactcagtgacatcatcatcaacagacttagcctctgcagttgaaaatgctagagcaaacagaggagaaaatttacttgtgaatcataatagctaacctgtactgaacagttaagccatgtgccaagtattattctaagcactttacaagtattaactcctttaatctgtataaccacacccagaaatttgtgcattattatactcattttactgctaagaaaactgacacccataggattaaatcagatcacacatttagtaagggcaccaggatctgaagcaggattgtttgacttctgagtctgtgctcttaaccactgcacacaccgtctctagaaagtttaatgccatctttatgccaaagtttatctacctggtttatcctttaacactattattgtatttattcatttacttgtcttttcctcccactgtgctgtaactctttgagaacagggtacttgtcctaatattattcatatttatatccctaattcctaatttaatgtctaatttattgtaaataagttttttttttttgagacagagttttgctcttgttgcccaggctggagtgcaatggcacaatctcagctcactgcaacctctgcctcctgggttcaagtgattctcctgcctcagcctcccaagtagctgggattacaagcttgcaccaccacgctaggctaattttgtatttttagaagagacacagtttcactatgttggtcaggctggtctggaacccctgacctcaggtgatctgcctgccttggcctcccaaagtgctggattactggtgtgagccacatgcctggccttgtaaataataagtttagttgaataaataacaatgcctccgggaggtagctattatatccattttacagatgaagaaactgtaagtcaatgttaatcaaatagtatcctagaaaatagtagaaagcagaatgctggagctgagatttgaacccaagacttttgatacttcgtccagtgtgctttccaccatgcctaagtagtctccttcacttcctccttcagagggctatggagagtaacctagcaaccatttctaagctggaaaatgtcacagccggaagtcttcagtcccctagaaggaaaagagcctgatggggagagggtccttggaaaagagaatttctggaagtactacatttgagaataggtggttaaagtgggagttggattagtaaaggaatactgcatagtagtaatacccattctttatttcagaatttcttcatgacagacattgatctgtgtgatttataagccttgtctctttttaatgttcacaatcccattagatggttattgttatctttgttttgcatatgaaagaatgggagctaagaggccaagtaccttgcctcttattcgttcaacgaataagtggtgaagcagattccaactcaagtctatgttacccaagaacctacattttaagcattttgttaccccctggatatgacagccaatgaagagggggtattttgagaagagactataaagggaaattgccttccctacatcctgggggaccttatcaaccaggaaacaaggtagagaaaactgtgcagcctgagccctgctgggttgcggggggctcacagaaagaagaaatgtgatttttttttagctaactacggagaccagccattccaatgtttgaatctgggttcgcagcacatgatgtctttatactcttaacctagaaatggcagagttattttgggcacaaagcaagagctgtggctttaaaaatatgccaagtgtatttatctcttccgctccaagattactgaaaattagcccagctgtagcttgggacaccaaacagccaaaaaatcttcttccagctcaactcattccacccaaagagggtgaaatacccaggagtagcagctctagcggcctctgggtagtggtattagattggcctccccattgctaagcctgacatccaatcacacacacaccactctcccagctgctctgtagatcacaatgctaggcctgtgaatggagctcaactccgtctcttccctcatccccaaggcttcacaagaagtaaacaaaacaaacaaaaactatttgattattgagccaaggagtcaatgtgagaatagtttttcaccttcattatcaaatgcctgtgtggagctgaatgtggtggctgacacctgtgatcctagcactttggggaggcagaggtgggaatattgcttgaggccaggagttcaagaccagcttgggcaacacagcaaggccctatctctctctctgtctctctctgtctctctctctctctctctctctctctctctctctatatatatatatatatatatatatatttttttttttttttttttttttgagacagagttttgctcttgttgcccaagctggagtgcaatggtaagatctcggctcactgcaacctccttctccagggttcaagtgattctcatgcctcaaactcccgagtagctgggattacaggtgcctgccaccatgcccagctaatttttgtatttttagtagagacagggtttcaccatgttgggcaggctggtctcgaactcctgacctcaggtgatccacctgcctctgcctcccaaagtgctgggattacaggcatgagccactgtgcctggcccctatctctgtatattaaaaaaaaaaaatcttagccaggcatagtggcgcacacctgtattcctagctactcagaaggctgaggtgggaggatcacttgagtccaggagatccagtctggcagtcagccatgacctcaccattgtactccaacctgggcaacagatatagacgctgtctctaaaaaaaaaaatcctgtgtgatttaggacaaattatcttgctgtaatttaagccttcatattccttttttataaaataaatatgctttaaatatgtatttagatatacacttataataatagctttaattaattgtaattaaatcatttaaaattaaatacatgcaaaataccccataaactgtctaatccataataagcaatcaatagtccttaaacaaatgaatcttctgttgctctgatcttaataagtaaaatttaacgagtttttactttgcaccatgcacttatgctatgtgctgtataaggatagttacatttaatctataaatcaaccctatggggcgggcactcttatgaactttttttacggatgaaaactgaggcccagagatatgaaataatttgccaaacatcaccataatttacatgatgtagccaggtttaagcctactattctgattacagagcctaagatcctacagagaacagggagtatatttttacattcccttgtttccatggaaaagtctttccactgtcaattgaaggactaagcagcagcggggaagtgctggaaatgctagcccaggtgggcttagctttctccctctctctctgatcctggacaggatttgggtttcagaccacgattctcctgtgttttgtgggctgtgattactcagattaggtttgcccaattcataaaggactggcgggggttgggggtgaaggtgtgggagaaggcggagcttgtccagtcggtccaacaaaccccacagatggcgaaatagggggcggggaaggagcttgagatattttacaacctgggctgtttcagtggttgatggcggatggtttttgccttttggtcagcctgagtatatactatcattctacaatcggccaaattctgacagagagggagacagagagagaggttgattaaattgatgcccaaaaccaagaaggagcaaagaaatcggggctgtttgaaaaagactgcagtggctgacttgggtggtgagcggaaataaggaggagggagaggcggggtgtctctgcgcggaaagcctggaagttcacttgcaaacacagaatctgcacagccttcggtgccctgactctttcctgggcatccagaggcagcagcagccgccagcgccaaagaacgagcagtccaggggctgggccggaaacggctataatcatttaatagcctttgccggctgcactgacttagcagagtgggcggtaggcaggctccagagtgctgtctggcaagatagtccccggctttaatcaaaatgatgggttttctggaagctctttattaacctcagcactgaaatcccagagctggtaacaaagggatgaatggggagcaaaggggcggggccgaaacctggaggccgggctgcatccgcaccccttcccccacctccactcctttcaactcattctggcttagggctcctgctggcatctctgtgcctcccaaatagtagtaacaaaacaggcaataaccataataattggcacatttgtataacgctttagcattttcaaaggatgaccttgttatacagctcaggatctgagtctcctagctggagtcagactccctagatttgagtcccaggatccaccagttagtgaccatgtgaccattagtccttagtcccctcatctataaaacagacacataacacagacagagatactagaaatgtctacttcatagggctcttgtcaggaccaaaacctatacgacgtgcagatttgtttaactctgttgcacacacataggaagggcacagtaaatgttaactacatcgacaaccctgtgatgtagacaggaaggggatcatctccattttatggatgaggaaactgaggctcagagatatttatgtaaatggcccaggactatgcactagtgagagaaccagggcaagtcctcaagaacagaaagagaacaaagcaagatgaagagaagatcagaaaagtgaacaccctccaacaccctccagcacatgcccctctgagagctttcctgaaaatagtatccttggtcaaaatgagtttatgttctattagggaaagtcagtgtaaatcagaaaagccctcctggccttaacagaacagttccaaatgcagatgagggtgagtttaacaggcctggcatttgcttcacaatcttctggccctttcctggcatttgccttggcaaagactctgacctgatcaatcctagtccctgaggctcaactccatcaactcaggcagccagggttagtttagcatgaaagaggaaagctggaaattttgccaaaaagattcctgggcagtgcctaagggaagtgcccaaattggattataggattacatgaagtggccagctacttccagagggcagggttttttgtttgtttgctctgtcacccaggctggagtgcagtggtgcaatctcagctcactgaaacctccgcctcccgggttcgagtgattcttatgcctcagcctcccaagtagatgaaattacaggcgtgcaccaccacagtctcgctaatttttatagttttagtagagatggggtttcaccatgttccctaggctggtcttgaactcctggcttcaagtgatccacctgcctcagactcccaaagtgctgggattttagatgtgagccaccattcccggccccagagggcagtttttaaagtagaagtgaagatctgtatgcatttattaaaatatatgttgttctgattttaaaatatatccctaccaattgtgaagatatcggctaatccaataaaaaagcaaaaccatattttgtataattatggtcgtattctgttaaataaacttttaaatcctattgggttgtaatctgtagtctgggaagggctctgcctaacgattcagacccctaccagatttatatgtgtctgaaatcctccttctagcctcttaacaggcccattcatttgggtcttgactgcatcctcagtcttgtctttgcctgagggtgagctaggaccctgggagcataagggaggggacttgccggagatcctagaagggaaaggaggcagcactgaaagaagaaacatttccttgattgatcatttgctgatactggcccctggttggggttaggggtagaaatgtgcttcttccgttttcatcttcttcaaaagggagtatctccatgattctgccccaaaggcatgacattttataggcaaagccagccaagtgtcttgagtgctcttaaccaaaaggaattcagattaggaggtcagtcagtgtttgtcagatccttaagcttttgttttactggaatgagtcacagtctacatgctgctgagctctcagagatgtttgttttatacaacaaccagaacaggtgaggcacagtggtctgtgagggactggagagaccacaccttgttctgctctgcggaagctggacatgtggaggaggcacctgactagatctctgcctcctggagtttaggctgagtcatatagaaccaggaagctcagtgacatgttaaagtggattaactcttggcagtcctgctgtgaggggctccctctgccaatacacacagccattaatgtcctttaactgtgcaagatgaacatatctctgtgttctgcatctccagatgacagtgcttaggcctcatgcagagtcctggttatggttgaagaaaaatttccattttgggctctgagggcaactaaaggactgtggagtggtgctgaaacccagttttaggtgccgaatcagaggtttttaaatacatttctctcttttgtctcagtctcttagagacaggacctgtattttaaaggtaaacaggcagattctggctgagctcaattgcagatttgattaacttagatagatcaaagtcattagtctcagagaaaaaatttgtttctcatccctaaagtgctattgtgtcagctctgccagggtgtaaggaaaagggtttggaagagagaagaaaatttcttaccctctctcgtcactgcctgctgtaaatttgcagtatcattatcttggtctcctaagccctgagagctgcattatatataattgcccatatgtgataccatttactgaattcttgcattgtgctaaggatcaagcttagtactttacatgcattacatcattgtctttagggaccccaaaagtgcctcattggagagttgtttggtctgctaaagagtgggtaccactttcacttctcacatcagtcctttcattcattcatccagcaagtatttactaaacacctgttatgggccaggaattgtgctaggcactggtgatacattggtgaataaacagatacattttttgcctttgtgaatcttacagtggtagagaataataggccaagggggtgctgcttggctaggaatgtcatagaatgcctttccaaggaggttacatttaatacagacttgaagagtgaggagtcatgctaagaatggatgagaggctcacgcctgtaatcccagcactttgggaggccgagacgggcggatcatgaggtcaggagatcgagaccatcctggctaacacggtgaaaccccgtctctactaaaaatacaaaaattagccgggcatggtggcgcgtgcctgtagtcccagctacacaggaggctgaggcaggagaatggcgtgaacccgggaggcggagcttgcagtgagtcgagatcgcgccactgcactccagcctgggcgacagagcgaaactccgtctcaaaaaaaaaaaaaaaaaaaaaaaaaaaaaagaatggatgagaaatcattcaagacaaaagcaaaccagatgtgtaaagatcctgaggcaaaaacaactccaaggagccaggtatggtggcctgtagtcccagccacttgggaggctgagacaggagggtcgattgagtccaggagtttgaggttacatcaagcaatgattgcaccactgcacttcagcctggttgacagagtgagaacctatctctaacaaacaacaataaaaaaacaattccaaagagtgtttgaggatctgaaagaaggcctgtatggttggagtataatagtaagagggagatttgtagatgagagtggagaagaaataaaaatcagattattgaagggacttatgtatcatggtaaggagttttttttttttttctcaaggcagtagaaagcttaagcagaggagtgatataatctgatttatatttttaaaagagtttgctatatgtatgttatgcctcatttttttttaaattttttatttttagatggagtcttgctctgttgcccaggctggactgcagtggcacgatctcagctcactgcaagctccacttcccgggttcatgccattctcctgcctcagcctcctgagtagctgggactataggcgcccaccaccacgcccggctaagttttttctattttttagtagagacgcggtttcactgtgttagccaggatggtctcaatctcctgacctcgagatctgcctgtctcggcctcccaaagtgctgggattacatgtgtgagccaccgcgcctggctgttatacatcagtttttaaagagagacattaagaaataaagatgactctggctactgtgtggagggttggagagaagcaaaagtggaagcagactgaataaggagactattgctgcaattcatataagagatgatggtgtcctgaaagagtggtggcagtgaaaattgggagaagaggacagagtcaagatatatttaggaggcagaaatgacaggtcttgatgatgtattataaatggagaatgaagaatagaatagagaaaaatgaataattagctttgaactttctggcttgagaaatggggtaaatggggtgtaatttactgaaactggaaagatttagaaaggaatagattcgaggaatcaagagtttgatttcagatttcttcagtttgggatgcccatgagatttccaactggggataccagataggcagttatacatgagattggagcacagagagatgtgggcttaaaatataagtctgcatctcatcagcttattcatatggtatttatatctatggatatggctgagatcccaaaaggagagagtgaagagaaaatagagaagagagtctagggccaaacccaaggaagcttcaacacacagatgaggagactgacaaaggaaactgtcaaagaacagtcagagagaaaggtcaggagaatgttttgatggtgggggccagaatatgctgtcccaaaataagaaggattgttgagctgaaggcaagttaaaagaagcagatacaggctgggtgcagtgggctcatgcctgtaatcttagcattttgggaggctaaagtggacagattgcctgagctcaggagttcgagaccagcctgggcaacatgatggaacaccatctctactaaaatacaaaaaaaaaaaaaaaaaaaaaaattagccaggcatggtggcatgtgcctgtagtcccagctactcaggaggctgaggcacgagaattacttggacctaggaggcagagactgcagtgagctgatatctcgccactgcactccagcttgggcaacagagcaaggctctatctcaaatttaaaaaataataatcatgataataataaaagaagcagatataggagaggtcttctgccctccctgtatttgcctaaaaaaccataaatttacaaagacaaaagttatcctacttccacctccctcctctgcctcccaccaccagggagaacaaaggttaaccactgaagataactttggactcttattggcctggaaatggtactgctttacaaattagcctttatctgccattcatttgccttcccccaagtagctacccattagagactcaaagtccttaaaggtcttttcctttgtcttacacttctttaaaaatttattgttctttgttgaagatgctatataagctggaattctaagccacctttttgagaactgctcattctctgggtgtctgtcatgtatatatgaaatgtacatgttaataaacttctgtttccttttttttcttgttaatctgccttttgtaacaggggtccagtccatctaagaacttattggggttattctacatgacaaagaactcatgagaataagtgtttcaagaaggggatgacaaatgctgctgagaggtttgataagatgaggactaaaatgtgaccattgattgtggaagtaatataatgaacttgacatgagttatgttagaaaattactgctcagggacaccaaattagaggagactgagaagtaataggaaattgaaatagcagttgtacccaaccctaaactgtaattgaacataaacagtttatttgatggagcttttcacgtgtcaaccaaaggagcagtgttagatacataaacattgctatgatgtcagagttccaatgtcatggccactgggatcactttgcccagacagaccattacccttcctctccagctctgacttctactcttctagaagtcactggtatactttatggtgtgtcttccaatcagactcttgggaatgtcttttattgaaaactcctgtggatgcataatcattttcccaagactcagggcagatttcacctcctctggaaccccattaactttctcaagtataattaacaatttcttcttctggagtcccacaatactttacatatactttagttattgcatgtattaagttggtttctagttgcttgagtgtatgtccaactagactgtgagcacactgagggaaggaatttggcttggaaagtaaaattggctcccagtgttttatctaaacaaataggctcaatttacaacaggattccatcctcttacgctgtgtattcccatctcttccatgctgcatcccaccacccttcaatgttattacaataaaattaagatcaaataatttattcagctaatttttcttgttttggacaaaatagacatcctaatacatttatagccaaagtttaatctagacactaaaaggagcatattttgcctttaggctctgtatttcccatcccgttcccagtcaagataatcacaactgtattctttaggaaattcttcacaaagaaccaaacatatgttactatgaaactagattcttggtatcctggtgaaaaaacctgccctcttgcttgtctgtaaatactggccttggctgggtgtggtagctcatgtctatgattccaacactttgggaggccaaggtgggaggatctcttgagcttcagtgtttgagaccagcctgggcaacatagtgagatcccatttctataaaattttttttaaaaagctagcctggcatgggagcttgtgcctgtagttccagctacttgggaggctaagatgggaggattgattgagcacaggaggtcgaggctgcagtgactgcatttcagcctgggtgacagagggaaatcctgtctcaaaaaaattaaacaaataaataaataagtaaacacttgccttgccctcagacttgaacaaacaactcgtgatttttctggggaggttcagcctgcctatgcagtactcctgtactctaccagcagtgtggcatcaagagcatgtgttgaccctgttaatgatttgtaatgttttgtctttcagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattatattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatgttagttactagttattacagctgtaaggataaaacacgtcatgtggattcattttgaattggtgctattggtatttcctctgttattgctaataaatgaaaatggtggtatg

SEQ ID NO: 513 - DNA, 156297 bp, Homo sapiens; identical to SEQ ID NO: 509

SEQ ID NO: 514 - DNA, 6389 bp, Homo sapiens
tctcgcttttcttgcaatattttataccttttcaattcatagaattactcaagaaaactacctcagttggttgctactttttgttgattccttttaccagacatgactaagtttctttttcatcagtagatttctgggctcctatattcactagagattgcaactcctggatttctcttacactagaatcctatttcgagccatatgggagattctgaattccagaacaaaagaattttgtaatttaaaattcgtgattgctcaatggaatcattttaattgttacttcatttctgtcgttatttaaaacttaagtggagagttttctcagggataagaaaaccacaatcaaggtcatacaaaacttttagaggcagtcagtctgctaagaaggctccagcaagagaaacgggatcttctgtttcaacaatcattacttaagaaaaaattaagaaaatgaaataagttttgcagaataactgtgaaatttttattcatgaaatatgtacttacactttgggccacgtgatgtcactctttgccgcgatgttctctctgaatccagacaaatacagcccttttcccatgggaaagaggctcaattctttttcactctctctgtgctgaacgatggcgaacacagcagaatgggactgacgaaatcagatgatttcttctaatttggaggcaattttcactaattagaagaagactgagtatttgaaatgttatactcaagtcgaggagatccagagggtcagcctctactgctctcgcttctgatcctcgcaatgtgggtggtggggagcggccagctccactactccgtcccggaggaagccgaacacggcaccttcgtgggccgcatcgcgcaggacctggggctggagctggcggagctggtgccgcgcctgttccagttggattccaaaggccgcggggaccttctggaggtaaatctgcagaatggcattttgtttgtgaattctcggatcgaccgcgaggagctgtgcgggcggagcgcggagtgcagcatccacctggaggtgatcgtagacaggccgctgcaggttttccatgtggacgtggaggtgaaggacattaacgacaaccctccagtgttcccagcgacacaaaagaatctgttcatcgcggaatccaggccgcttgactctcggtttccactagagggcgcgtccgatgcagatatcggggagaacgccctgctcacttacagactgagccccaatgagtatttcttcctggacgtgccaaccagcaaccagcaggtaaaacctcttggacttgtattacggaaacttttagacagagaagaaactccggagcttcatttattgctcacggccaccgatggaggcaaacccgagctgactggcaccgttcaattactcatcacggtactggacaacaatgacaatgccccagtgttcgacagaaccctgtatacggtgaaattaccagaaaacgtttctatcggaacgctggtgattcaccccaatgcctcagatttagacgaaggcttgaatggggatattatttactccttctccagtgatgtttctccagatataaaatccaagttccacatggaccccttaagtggggcaatcacagtgataggacatatggattttgaagaaagtagagcacacaagatcccagtcgaggctgtcgataaaggcttcccacccctggctggtcattgtacacttcttgtggaagttgtggatgtaaatgacaatgctccacagttgactatcaaaacgctctcggttcctgtaaaagaggacgcacaactggggacagttattgccctgattagtgtgatcgacctagacgcagatgccaacgggcaggttacctgctccctgacgccccacgtccccttcaagctggtgtccacctacaagaattactactcgttggtgctggacagagctctggaccgcgagagtgtgtccgcctacgagctggtggttaccgcgcgggacgggggctcgccttcactgtgggccacggccagggtgtctgtggaggtggccgacgtgaacgacaacgcaccagcgttcgcgcagtccgagtacacggtgttcgtgaaggagaacaacccgccgggctgccacatcttcacggtgtctgcgcgggacgctgacgcgcaggagaacgccctggtgtcctactcgctggtggagcggcggttgggcgagcgctcgctgtcgagctacgtgtcagtgcacgcggagagcggcaaggtgtacgcgctgcagccgttggaccacgaggagctggagctgctacagttccaggtgagcgcgcgcgacgcgggcgtgccgcctctgggcagcaacgtgacgctgcaggtgttcgtgctggacgagaacgacaatgcgccggcgctgctgacacctcggatgaggggcactgacggcgcagtgagcgagatggtgctgcggtcggtgggcgccggcgtagtggtggggaaggtgcgcgcagtggacgccgactcgggctacaacgcgtggctttcatacgagctgcagccagaaacggccagcgcgagcatcccgttccgcgtggggctgtacacgggcgagatcagcacaacgcgtgccctggacgaaacggacgcaccgcgccagcgcctactggtgctggtgaaagaccacggggagccagcgctgacggccacggccactgtgctggtgtcgctggtggagagcggccaggcgccaaagtcatcgtcgcgggcgtcagtgggtgccacgggccccgaggtgacgctggtggatgtcaacgtgtacctgatcatcgccatctgcgcggtgtctagcctgttggttctcacgctgctgctgtacactgtgctgcggtgctcggcgatgcccaccgagggcgagtgcgcgcctggcaagccgacgctggtgtgttctagcgcggtggggagttggtcgtactcgcagcagaggaggcagagggtgtgctctggcgagggtaagcagaagaccgacctcatggccttcagcccgggcctttctccttgtgctggatctacagagcgaacgggagaaccctctgcttcctcagattcaactgggaaggtgggtttttctagcattttatttatttatataattttttttcttgaaagatattatcgattactcccaggggccgttcaaatagttttattcatttttctagaaatccagcagattttttttctgataaagtaaaccccttaacattggagccgactttgtcttgacttctagtgagaattataaactgtatattaaatagatattttttgggtgctgaatcaattttatttaaatttgtgattaaagtgacattgaatttctgatgctatgctgccataacacttgaaaaccaatttagttgttagtcattcattaaacattaacatcactatcatttatttattgctaaatgatgcatagtattttagtctacttgtattgtttataagaaacccaagcaaaaatatatagcaattgttaccttgttaagtttgtagttctctacatttctctggatggagactgtgaacatctgattgttcagcaaccttcagtatctattattttaataagaaagaaacttcccctaaactttagaaaacagttgctccactttaggaatcaaattatgtcaataaatgttataaacacagccttcatttcaacttatataaaatatgttttaaaatgcctgacaatgtagataattcaagaaatgttgactgaaattttgtctacacttagaacattttttgaaattcagtttacagaaattggagaaaatgctttttaaacaagtgtttcctttcttcaagaagatattctccttttaattgaaattttctccattcagtgataaaatgatcagccatgtgaagattcgaaacttcgagttcttttgaaattcagagtctgtaacttaaaacattacccttatgaatttagatgagaattcacttgttctgtcagtaatccataagacagaaatctgtttttttaaaaatatctttttctcctctcagctcatacataacacaaggcagaaatctggatatgagatttgcctctttaatgtcactacatgttatgtttcctgaattgtagtatgtgactttcaaaatggtggttttccacactctacctttagtgcaagctatttgtttgttttctaatttatagttttaaaaacttcgcttattgagtttttgttatgtggtttatatttttctttctctttcagctattttatttaatattgtgtcagatattttacaaggtatgacctaattaaaaactcagtagagaaagatcagaatggccttgagaatagagccacaaaaataactatgaaaatgccagtaacgtttatttaaaacaaaatattttaatttttaaattttcccttaaaacacacttttggaatatgctacaatattacatgttttttgtctttttatttttctgagacggagtcgttttctgccacccaggctggagtacagtggcatgatcttggctcactgcaacgtctgcctcctgggttcaagcaattctcctgcctcagcctcctgagtagctgggattataggcacatgccaccgcgcccagctaatttttgtatttttagtagagatggggtttcatcatgttggccaggttggtctcgaactcctgaccttgtgatgctcccacctcggcctcccaaagtgctgggattaaagctgtgagccactgtgccaaggcttttttattttttttttttgtcattttctttcaaaacttgagtggtctctgagctcctgtcattaaacctatctatatctgtctatcagcacaactcaccttgaatatagtcttatactttcaagtatctttgtctttgcacgtttttcaagtttcatgtgccatttaaacttggacccaggtatctgattatttgatgtgaatagagggatgctacagatgtcatttgtctcccgccctaagtcctccagtctccttagagctagtacttactaagcatttactatgtcatcaataatcataaaacgtatttttttttttgagtcagagtctcgctctgttgcccaggctggagtgcagtggtgccatcttggctcactccaagctccccctcccgtgttcacgccattctcctgcctcagcctcccgagtagctgggactacaggcgcctgccaccatgcccgcctaatttttttgtatttttagtagagatggggtttcaccgtgttagtcaggatggtctcgatctcctgacctcatgatcctcccgcctcagcctcccaaaatgctgggattacaggcgtgagccaccgcgcctggcctaaaatgtgttctttattattgacggctgtattgatgggattggtaatttagtccttcatattaatctctattctctctcagagtacaagctctcatcatatgcaaattctcagaagggctgtgaacaccttagtaataaatttatcttttgaggtcattagcaaacatgaactcacagggatccagagatggtaaaattcaaaacagcctgtcaagttcaaaacagagaggtgaaagcagaagagacactttcctattttgcctaataggtctccttatatgcatctgtagttaacattcctcaattcaagttagaatcatgaaacaataatgaagctcctcctatgtctcttttcaagttgtaattactatataggaaaaactaagttgtcacccaatatcttagacactttgagagcaaagggggtgctgtaaataagtatacaagatcacagacctaaattgagcctgttccagacaaattggggcctatggtcaacctatccttagacctgctaacgcattagcattagcagcacctaagtcctcattgaatgttctggttcaaggctccacctcagaaattctgaaatgggtagtaagagcaaattttcattttaaagcacacctgagatgattctcatacaaccgaaattttagatccatagccctatttgatacttgacagtgcaagtttctgtaatttaaaaagatgtggtggcctgacacctgcaatcccaacattttgggaggccaaggtgggagggtcccttccttgagcccagcagtttgagaccaatgtagtgagactcatctctgccaaaaaaaaaaaattagccgggcatggtggcacacatctctagtcccaattactcaggaggctgaggcgagagaatcgcttgagcctgggacattgaggctgcagtgaactgtgatggcacaactgcatttcagcccgggagacagcaagattctgtctc

SEQ ID NO: 515 - DNA, 2536 bp, Homo sapiens
gatggtttccagatgtagctgcctgggggtccagtgtctgctgctctcgcttcttctcctcgcagcctgggaggtggggagcggccagctccactactcagtctacgaggaggccagacacggcaccttcgtgggccgcatcgcgcaggacctggggctggagctggcggagctggtgcagcgcctgttccgggtggcgtccaaaagacacggggaccttctggaggtaaatctgcagaatggcattttgtttgtgaattctcggattgaccgcgaggagctgtgcgggcggagcgtggagtgcagcatccacctggaggtgatcgtggacaggccgctgcaggttttccatgtggacgtggaagtgaaggacattaacgacaacccgcccaggttctccgtaacagaacaaaagctctcaatacctgaatccagactgcttgactctcgatttccactagaaggcgcatctgatgcggatgttggagagaacgcattgcttacttacaaactcagtccaaatgagtattttgttcttgatattataaacaaaaaagacaaagacaaattcccagtgcttgttctgcggaagctgctggatcgtgaagaaaatcctcagctaaagttgttgttgacagcaactgatggaggcaaacctgaatttaccggatctgtttctctgctgatcctggtgttagatgccaatgataacgcccctatctttgacagaccggtttatgaagttaagatgtatgaaaatcaagtgaaccaaacattagtaatacggctcaacgcttctgattcggatgaaggaataaacaaggaaatgatgtattcatttagctctttggtcccacccacgataagaaggaaattttggataaacgaaaggacgggagaaataaaagtaaatgatgctattgactttgaggacagtaacacttatgaaattcatgtagatgttacagataagggaaacccacctatggttggtcactgcacggtcctagtggaactactggatgaaaatgataattcacctgaggtgattgtcacttctctgtctctcccagtgaaagaagatgctcaagtgggcaccgtcattgccctaatcagcgtttctgaccatgattcaggagccaacggacaggtcacctgctctctgacgcctcacgttccgttcaagctggtgtccacctacaagaattactactcattggtgctggacagcgctctggaccgcgagagggtgtcggcctatgagctggtggtgaccgcgcgggacgggggctcgcctccgctgtgggccacggccagcgtgtctgtggaggtggccgacgtgaacgacaacgcgcctgcgttcgcgcagtccgagtacacggtgttcgtgaaggagaacaacccgccaggctgccacatcttcacggtgtctgcgtgggacgcggacgcgcaggagaacgccctggtgtcctactctctggtggagcggcggttgggcgagcgctcgctgtcgagctacgtgtcggtgcacgcggagagcggcaaggtgtacgcgctgcagccgctggaccacgaggagctggagctgctacagttccaggtgagcgcgcgcgatgggggcgtgccgcctctgggcagcaacttgacgctgcaggtgttcgtgctggacgagaacgacaacgctcccgcgctgctggcgtctcccgctggcagcgcgggcggtgcagtcagtgagctggtgctgcggtcggtggttgcgggtcacgtggtggctaaggtgcgcgcagtggacgctgactctggatacaacgcgtggctgtcgtatgaattgcagtcggcggcggttggtgcacgcatcccgtttcgcgtggggctgtacacgggcgagatcagtacgacgcgcgctctggatgagactgactcgccacgccagcgcctactggtgctggtgaaggaccatggcgagccgtcgctgacggccacggccactgtgcttgtgtcgcttgtggagggcagccaggcacccaaggcctcgtcgcgggcttcagtgggcgtggcgcccgaggtggccctggtggatgtcaacgtgtacctgatcatcgccatctgcgcggtgtccagcttgctggtgctcacgctgctgctgtacactgcactgaggtgctcggcggcgcccaccgagggcgcatgtgggccggtgaagcccacgctggtgtgctctagcgcggtggggagctggtcttactcgcagcagaggcggcagagggtgtgttctggggagggcctgcccaaggcggacctcatggccttcagccccagccttccaccatgcccaatggtagatgtggacggggaagatcagtctattggaggggaccactctaggaaggtgggttattacgttttcattttccttttgtgctttatgaataatattttctcttaccgcattttctcaaatatgtatcagaatatttcatttttgtctacattccatttatgcttgaatatttctagtgatacctttgtaatataa

SEQ ID NO: 516 - DNA, 2446 bp, Homo sapiens
catggattatcactggcgaggagagctgggatcctggcgactactactcttgcttctgctcctcgcagcctggaaggtggggagcggccagctccactactccgtccccgaggaggccaaacacggcaccttcgtgggccggatcgcgcaggacctggggctggagctggcggagctggtgccgcgcctgttccgggtggcgtccaaaagacaccgggaccttctggaggtaagtctgcagaatggcattttgtttgtgaattctcggatcgaccgcgaggagctgtgcgggcggagcgcggagtgcagcatccacctggaggtgatcgtggacaggccgctgcaggttttccatgtggacgtggaggtgaaggatgttaatgacaacccgccagtgttccgggtaaaagaccaaaagctgtttgtttcagaatccagaatgccagactctcggtttccgctagagggcgcgtccgatgcagatgttggagctaactccgtgttaacctacaggcttagctctcatgattacttcatgctagatgtgaattcaaagaacgatgagaataaactggttgagctcgtattaagaaaatccttggacagagaggacgctcctgcgcaccacttattcctgacagccacagatgggggcaaacctgagctcacaggcactgttcagctgctggtcacagtgctggatgtgaatgataatgctcccactttcgaacagtctgaatacgaagtaagaatattcgaaaacgcagacaacggaacaacagttatcaaactgaatgcttctgatccggatgaaggagccaatggggcaatttcatattcttttaatagccttgttgaaactatggttattgaccactttagcatagatcgaaatacgggagaaatagtgattcggggtaatttggattttgaacaagaaaacttatacaaaatcctcattgacgccacggacaaaggccatcctcccatggcgggtcattgcaccgttttagtgagaattttggataaaaatgataacgtccctgagatagcactgacttccttatccttgcctgtacgtgaagacgctcaatttggtactgtcatcgccctaattagcgtgaacgacctcgattcaggtgccaacgggcaggtgacctgctccctgatgccccatgtccccttcaagctggtgtccaccttcaagaattactactcgttggtgctggacagcgccctggaccgcgagagagtgtcggcctatgagttggtggtaaccgcgcgggacgggggctcgccttcgctgtgggccaccgccagcttgtctgtggaggtggccgacgtgaacgacaatgctccggcgttcgcgcagcccgagtacacggtgttcgtgaaggagaacaacccgccgggctgccacatcttcacggtgtctgcgcgagacgcggacgcgcaggagaacgcgctggtgtcctactcgcttgtggagcggcgggtgggcgagcgctcgctgtcgagctacatttcggtgcacacggagagcggcaaggtgtacgcgctgcagccgctggaccacgaggagctagagctgctgcagttccaggtgagcgcgcgcgacgcgggcgtgccgcctctgggcagcaacgtgacgctgcaggtgttcgtgctggacgagaatgacaacgcgccggcactgctggagcctcgggtgggtggcactggtggcgcagcgagcaagctggtgccgcggtctgtgggcgcgggccacgtggtagcgaaggtgcgcgcagtggacgccgactcgggctacaacgcgtggctttcgtatgagctgcagccagctgcaagcagccctcgcatcccgttccgcgtggggctgtacacgggcgagatcagcaccactcgtgtcctggacgaagcggactctccgcgccaccgtctgctggtcctggtgaaggatcatggtgaacctgcgctgaccgccacggccacggttctggtgtcgctggtggagagcggccaggctccaaaagcgtcatcgaggcagtcggctggcgttttgggtccggaagcggcgctggtggatgtcaacgtgtacctgatcatcgccatctgcgcggtatccagcctgctggtgctcacgctgctgctgtacactgcgctgcggtgctcagcactgcccactgagggcgggtgccgggcgggcaagcccactctggtgtgctccagtgcggtggggagctggtcatactcgcaacaacagccgcagagggtgtgctctggtgaggggccaccgaagacggacctcatggccttcagcccctgccttcctcctgatctgggatcagttgatgtaggcgaagagcaagatttaaatgttgatcatggcctcaaagtaagtccatttaaatttagaactcataaattctatttgtggaaattgtag

SEQ ID NO: 517 - DNA, 144957 bp, Homo sapiens
tctccccggggcgaccgggcggctccacacgcgctgcgcccgccgccggccccacgcgcggcccatgtcctccgcgccgcgctcgcccaccccgcggccccgcaggatgaagaaggacgagtcgttcctgggcaagctgggcggcaccctggccaggaagcggagggcgcgcgagggtgagtgcgcgcccgcgcccgccgacccccggggacctgcccggcggtgcccgccctcggccctagagccccacgaggccgcccccgccctcccccacgcaccccgcccggcccacgcggctgcgcgaccttcgggacaggccaggcctttgacccaggacccgtaaacaacggccgggacctggcgcgtggggccgcggtggcctccggagtctgccaaacgcgcgtgcgggcgcctgcgcggcggggacctcgggccaccgtgcggggcccgcgcctgctctgcctgccgggtgttcagctcttccctgggccagcggcatagccagccgcgcggggtgaccgttcattccatgagcagtgacgctcacgtgtgcagggcactctgggcagacacggcctgggggacccactactgggtgttgcgcgggcgccctgcagggtgcggggctcagggcgtgcagggctgaggcctgggaggcctgcgagcaagaattgcagagatcccattaaaaatttttttttttaaattttttactgcgtgtgctcacgaaacactaccaacctcgtacgttttaaagattgttagagttgcaagggatagtctggtgtctttaagtgtaccgcttgcccagggcctcctgggagatacattctggaattttctgcttgggtggggaggttctgccccgggaccatgccctatagtgagatttcggattggtgagaggtgaggggagctgctgtggaaaggcagatggagaaaggccggcctcaggtgggtccccgggaaggagccctcccatagcgggtatgcagtacggtttccttaaaccacctgggcctgacatatcccctgggaactcttcctgtgcctccagggattagtgtaccccgggatgcaggtcccccattcatttcttccctgggactcttgtattcctagggatgtgtgtgccccgggaagacatatgacagatttgcctctaggcatgtgtgtgcccccatgcacctgctccccaggatttttgtacagtgcagggaacgcttggttccccagacattttctcccagggatgcctgtgcccccagggatgcgtgtcttcccacccgtgatcctgttccaagagggcagggtcttgtccccttcagtaggtctcctggcggataggtcactcttctctcaagccttacactggaggacccactgtagcttgtattggtcggtgttggtcacgtctcctaaatgacatgattagtggctgtcacccttctatcatccccactgttcttccatgcagtcatcagcaccctcaccagaaatcatttcggttcctctttatggcttgcaacgattatagacgcaagtgacgctcccctcccaattcagcccacagcctgtggagcgcccgccatgggccaggtgctgcttagaccccaggaagaaaagagcgggggcggggtgcttgctttcgtggaacggggaatgaatacatagacaactggcgctgtgatgacgtgccccggagcacatagaacagggcgatcagagccaggggaggcctctgaggaggggacacttgagtggaggccagaaggaaccagaggaaaaagtctttcatagaatggcaaggaaccggaatgttctgggctattgcagctttttctaggtgccgtttacgctctcggaataggaagaacacacacccaaagtaatggactgggcccaaattccaaagtacgcagtgcttctcctccttgcctgtatgaattgatgtgtgtctagaaaattcaggcccagcctggtttaattcaaatgcaccaagaattccggtagcaggaagcatcctgtgctgaatagaacgggcgtggaggcaggaggaggagcaggacgccgggcactgctgatgctgctttcgctgggggtgagctgggcgccctgcctcggttctcagggttggggtgcctggcaaacagagggccacaaaccctccttggatctaggcacaggaattgagggacaggctggattgggaagggtttagcggcttctgtgtggtctcctgggaagtggaagagtcaggaagactggataatgagggcttgaataattgagagtcgctggtatttccgcaagcccatttgccttggcaacatgcgcttctgccactccagggtggagcagcccctggccctgactttgggccgtcagagctatgctcggttgcctaccagggagtgacagggcgcttgggaggtttccacgaccctgcctgctgcaccgtcggcttcatttcctcctttgttagaaagttgagggtggatttgggagaacggatgtggctccgacatgttcctgagttgaggactctaagggaggagggggaagctgggggaaggggcgggctcatcggtgaggttccagattcaggcaggggtgtgacaaggcacggagggacttttgggagggatggttgggatgagtgacgtggcctgttccagaggagaggggttaggaaatgtggggccctggggtttggaggaagcagtgcaggaagtgtctgagaatgagcttcacggtgggcgtgattaaggctgatgtgctacgggaggcgtgtcacgtggtggcctgggtcagaaaagggaactgtgaccaactgtgggcattcagaaaatggaaaggaacgccggaaacccccagggctccccacagaagctctggggacgtgaaaggacagcgtgtttcaaacttgggttcagctttactggggcttggaggagcccgtgtgcagagaagaccaacaacacacagggttccccactgtgaccatgtgatgagaggccctgtaggtccagtgggccaggatggaggtcggggacagcccagctgctgctggaagtcctcagaggcggatggccggccctggccagtgtggaagaggtcgggtggagtgctccacacatttgccacaagaggcctgttctgtgctgcaccaggcactggacctcaggcgccactgcccagtggccagggtcaggtttctcagagacagctgaaggcagcggggcgagagcagccagtctggaggttctgtccctcttttctgagcaacacattcaggaagtttctatcccctgattaccttaaaaaatatgtatgtgtgggccaggtgaggtggctcacgcctgtaatcccagcactctgggaggccgaggtgggtggatcacctgaggtcgggaattcgagaccagcctggtcaacatggtgaaaccccatctccagtaaaaacgcaaaaattagccgggcatggtggcgtgtgcctgtaatcccagctacttgggaagctgaggcaggagaatcgcttgaacctgggaggtggaggttgcagtgagctgagattgcctcactgcgctgcaggctggtcaacagagtgagactccatatcaaatagaaaaaaaaaccatatatatatatatatatatatatattcatgtgtgtgtatatatattcacatatatatattgacgtatatttttaaagcagttttaggtttacagcgaaatctagcaaagaatacaaagtgtccccacctatcccttctcacctccatcagtgccccccggctgtgtggtagagtcgtgagccaacgctgagacatcattatctccgcaagctcatagtttacattaggggttgctcttgccgttggacattctgtggctctggatggatgtagagtgacatggacccaccattacagtcacctctggagcagcgtcactgaccccagaatcctctttctgctgcctatgcatccctccgtttccccaaatccctggcaaccacggatcatttttttgttttgtttttttggtttttgtttttgttttttttactgtatctgtgtttttgccttttccagactatcatctagttgtgatcataaagtgtacagtagcgttttcagattggcttcttccactcaatgatatacattgaaggcccttccatgtcttctcagggcttggtagctcattccttttttgactgaataatattccgttgtctggatgtgccagtttgttgatccattcacctgctgaaggacatcttggttgcttccaagttttggcagttatgaataaagctgctgtgtacatctacgtgtaggtttttgtgtggagataaggttttaattcatttgagctcaattgctggatcgtatggtaagagtgtgtctcgttttggaagaaactgccaaactctcttccaaagtggctgtgccacatttattcaccggtggcgaacgagagtcctggctgctctgcatcctcaccagtatttggtggtgtcagtgttctggattttggaattctgttaggtgtattgtggtgtcttgttgctgtttcaattcgcatttccctgatgaggtatgaagtggagcatctcttcagatgcttatttgccatctgtgtatcttcttcagtgaagtgtctattaaggtcattggctcatttgtattttatttatttttatttttattttatttttgagatagggtctcactgtagcccaggctggagtgcagtggcacgatcctggctcactgcagcctcaatctcctggggctcaagtgatcctcatgcctcagcttctggagtagttgggactacaggcacataccaccatgcccagctaatttttctattttttgtagagatggggtctcgctatgttacccaggctgctctcaaactcctggactcaggagatccacctgccttggcctcccaaagtgctaggattacatgcgtgagccacagtgcccggccttggcctatttttaaatctgcttgtttgtttccttactgttgagttggaagtgttcttcatatattttggatacaagtcatgtgttttgcaaatattttctcccagccagcggcttgtcttccctgtctcttgatcctgatatctcctaagcatttgatgtagagttaatgattaatgagcaagatattgagacctcatcaactagatctaaagaaatcactaggccagacacataatcccagcactttgggaggctgaggcaggtggatcacctaaggccaggagtttgagaccagcctggccaacgtggggaaacccggtctctactaaaaatagaaaaattagccaggcgtggtggctcacgcctgtaatcccagcactttgggaggctgaagcggcagatcacctgaggtcaggagtttgagaccagcctggccaacgtggtgaaaccccatctctactaaaaatacaaaaattagccgggcgtggtggcacacacctgtaatcccagctactcaggaggctgaggcaggagaatcactcgaacccgggaagcagaggttgcagtgagctgagatcgcgccactgcactccagcctgggagacaaagcgagactctgcctcaaaaaaaaaaaagaaaagaaaagaaatcactaggtagctgcgacattgaactgaaggttgaaagtattaagtttctttgtggactttaaataaccttcaggagagaaatctcaaagctctaaaccagcaaccgagaatttccttcagggcatccatcttttacacggagccatcagttgtgtagatgatgggttgccccaaaacactaagacgcaccagtgaagggaggggagctgtggcaggggggcctgcactgcccccgcctttccccccagcaacgcctgggctgggagctgggggtgggtgagaccctggctcaggccccactcaggacagtttgagggacaggcagatggggggactgagccatgggggtctcaccacccagacttggggttttgggcctccctggaggaagtggtcctggctgaatgtctaggatggatgtaaattagcccagggagggggagggggctcctgaggagacccccaggcaggctcccagtggctgagcaacggtgcagcctgtgggctgtggccagccctggtcgggggctggagaggtgagcagccctggcgtcccacaaacacaggagcttggaacccttgctggggcttggcaggggtggccgatttcagtggtgctttggggagtggggaatggacggaatgggggaacggcggggaggcaggctggcaggaatgtggcacggggcacaggcagtgccccgaggaggtggcgtgggtgggcgcaggcgtggctgtgatttccacgctgttttctagcgggctgcagcccctctgatgctgaaatgaaaaaggacccagatccttgtttgtgggaggggtgggaaaggatttgcaaggagtgtggtctcttttggacgatttttcagacttcttctcgtttccaggccctctgtgctcacgtgacccctctgatagcgtcagggcccgtagaaaagtggctgtggcatgttgggaaggccagcgggcctcctagccaacgaaaagggggagtggctggtccgaagttgggggatatagacaggtgagggaccagggccatagtcactgtggtttctatggggaagaggggatggtggaggtcctatttggagctgttgtgttgtgaggctctttacagaccctgccaacaaagagaaagacaattccacactgttatctctaaacccaaacctccttcgagcagaggccgtctccgtttggggatggacagctgttggtccaagaaggaaaggcacagtgaggtcactgcgacgctgcccagcaccttcatgggaaacgctcctcagggtggtgagtggaactccctggagaccattttccagtgagggcctatctctttcctcttgggctgagaggaagtgggtggctcagctacatttcctttgattattattctgactataatcttcaaaccctacatttctcattgtgtgttccgcccatgcgttctgttgtccggggcagcaaagtcgacctgcaccacgtgggtgtttttgttttcttttgttttgttttgttttcttgaaggcctactaagagctgtcggaaactctgcttctgtagaaaaggtaaaggcactgcttggccacaagtgatgactcttccctgcctttcggggcttggggaggaagggcaggttctcggtggttctcctagcaccttggttacaaacctcccagcagagtcagatcaccttggcaaccccacactcatcaaagggactctgccttgattccctccccaccgctgtggaattaatatcgattgcacatcctgaaattgcttaccctcgcgctccctgtccagtcgtcagaataattaaggggtgtttattggatgtaagtgggttcatccctgctgcgagtatggattttaagtgctccgttggattgattcctccctgctgtggttggcacagggcaggtacctttaccgagctgttttcttcttttcgaacatgcggttccatcacataaaagacataccctatgaaaatgtctctgccttagctgtacatgttacactttaggtttcaggtgaaaaattggtttatctcctaatatgtctgctatttgttacatcacatagaggctgcaaaacagattaataagctttggaggatattataagcatacgttggcccaatggtattaatttgcttatccatactaattgctgtcttggtaaaagaaggcggacacaatgcaatcaatcctagaagtgttctgtggctttgcaactttgagatacctcaggctgacatattcaaatgagagccttctctctggttacaagaaaaaaatggaatgagcagcagttttggcctcgtccagtctctagggctcccagcatctgggtagtaacatgatcagccctgggaaaccagcggagtcttttacctcctctgatgttctgactaagagtgtctgggccgtggggactgaacgcaccctttgaggctatgtgtgttaaagtttgggggcccatttcttcatttctaatatggggcagtgtgggcagatcccagctctgcgtttctgagctgctgagtttgccctggttctgagaatgcccgtcgcggtggtgcagtccgcctccttgcactggatctgttgcttcttctctctaagcctctgttcctgatggtcccttgtggagcaaagcagcacttgtggtgtaaggaaggaaagcctcatcagcaattgagtgagcgctcaatcagaattcgttatggatgaatgtggatgactggaggcattgacgcagacaccagagtccagagctggtacgtggtacagcagaagtggcaagtcagctcagtttaggacaagtacctaaccctgtgttgagaaggattctgtggctgagtctgggcttagggaaaaagaatgctgggaccagtcagccacactaccagtgtgtatggagggttagttgctgagtggctgtcacccccagaacaggagccttttccagctctagtgctgtgtcatttcagcagcactggctgctttattcccattgagtgccgtgcaacagctagttggctgttggtaacaaaagttgtgtgaatcgtttaagatattgcagtgagaatgttggtatcttaactcttcccctagctgtctgtggctaggaagcatctccagtgctattgtttttttcttgagacagagtcctgctctgttgcctaggctggactgcagtggcatgatctcggctcactgcagcctctgcctcctgggttcaagcgagcacatccagctaattttttatatttttagtaaagacaggatttcatcatgttggccaggctgatctcaaactcctgacctcaactgatccgcccacctcggcctcccaaagtgctgggattacaggagtgagccaccactcccggcccccaatacttttttgaggtatacttggctgagtaactgtttagcgtgtgcagagaagcaggtgtttctgagctggaattccttgtacccagaaatgtgagggcaactcacatgggcaccaggaggcatttttgccttcctcaccagcctacggcatcagagaacatttggcagtctctgagtgggagttctttacgcttgcctgatagtagttggaggcctgctcctttaagctttgccacttgaagtgatgagcttggttttggcctttgaacctttacctgccagccacccacaatcagtcggtaatgttggtttccccaagcaacgccatcttaggaatttctttgcttgttctcttacaaagtcatgcattattatacgtgttttcatttgaaaaattacagttccacaggatctagacttgaatgttaagctattaaaaagttaaagagggagtgaaaatgttagcactcctagggcctgcgtacgttgcttgctcaaatccagacgctcctggaagcagctgtctcagcggagccctgtctgcccttgttgttttctgcttctcaagttactccagactccagggaactagaactgaccaggccccactttaaacatgtggatggagtgcccctgacaaggctggagaaagggggaggtccggggcggggcctcatgcgcatatggtattcagagtttatttttgctataaatggaatttgaagaatatatatatatatatgaacatacaaataaaaatatataaagaatatatgtataaagaatataaagaataattttggaattcattgcattgtgtctgcattcttttactgcaacagcaattataattataattatattataaagaatatatattctttatacatatatatttgagatgggtgtctttatacatatatatgtttgagatgggtgtctttatacatatatatgtttgagatgggtgtctttatacatatatatgtttgagatgggggtctttatacatatatatttgagatgggggtctttatacatatatatatgtttgagatgggggtcttgctgtgttgcccaggctggagtgcagtggctgttcacaggccagatcatcagacactgtagccttgaactcctggcctcaagggatcctcctgccttagcctcctgagtagctgaaacaataggtgcacaccaccatgcccagctcttgagaagcatctggcccatagcttaatttgaagtgtcttcatccctgtcttttttctttttgttttaaaattaatagaattgacccttgaacagcacagggggaaagaggcactgacccccatgcagtcagaaatccacgtgtaacttttttttttttttttttttttgagacggagtttcgctcttgtcactaggctggagtgcagtggtgcaatcttggctcactgcaacccctgcctcccaggttcaagtgattctcctgcctcagcttcccgagtagctgggattacaggcgtgcaccaccacacccagctaatttttgtattattagtagagacagagtttcaccatgttggccaggctggtctcaaactcctggcctcagttgatccgctcacctcagccttccaaagtactggtattacaggcatgaacaactgcacccggccaccatgtgtaacttttgactcccacaaaacttaactagtgatagcctgctgttgactggaagcctcactgataacataaacaattaacaatattttgtatgttctatgcattatgtgctgtattcttactacaaagtgagcctgaggaaagaaaatgttattaggaaaatcataaggaagagaatatgcatttatagtactgtgctgtgtttattgatgctgcacgtttacaacatgcgtttacaagatgaatgctctgaagtggccggcaactgcagctgcagacctcaccctaccatacaacatctcaagctattcagcttcttggaatgtcacgcttttcttcttttctttttccttttttttttttttttttttgagacggagtctcgctctgttgcccaggctggagtgcaatggtgcgatctcggctcactgcagcctccgcctcctgggttcaagcgattctcctgcctcagcctcccaagtagctgggattacaggcatgtgccaccgtgcccggctgatttttttgtatttttagtagaaatggggtttcaccgtggtggccaggatggtctcgatctcctgaccttgtgatccgcctgcctcagcctcccaaagtgctgggattacgggtgtgagccaccgcgcccgtccgtcaaggcttcttgggagcacttacagcaacacaagtggtgctttgtatgagtcccatagtgttattcagggtttacggtattgcactaaacatgatgaaaaatacgtgggaacccaaacagatcacttttttttttttttactatgatatggaatttactggagcggtgaactgctcaagtggagataattaacatcaaataatgttctaagcaatgcaatagcaacaggaggcggctactattacagtggtgcagtatggactgcagttaattttatgcagttattattgaatactgcatcttggctgggtgcagtggctcacgcctgtaatcccagcactttgggaggccgaggcgggcggatcacttaaggtcaggagttcgacaccagcctggccaaatggtgaaaccttgtctctactaaaaagataaaaattaaccaggcgtggtggtgggcacctgtaatcccagctactcaggaagctgaggcaggagaatcacttgaacccaggaggcagacattgcagtgagccaaaatcatgccactgcactccagcctgggtgacagaatgagactgtctcaaaaaaataaaataaatacaataaaataaataaatacataagtactgcatctttacatttgtttacatttctctcaactgtgaacacagtctgtgtgtgtgtgtaagttttgatacattttaactttttatagtagatttgtatgtattttatggtggtaaatgataaaacagatgagtatctacatatattttatgcatttgtcgcatatctaactttttcttaatttttaaaaatatttctgggctacgtggtttgcagttttttcaaattgtcacaaatctccaaaaaattttccaatatgtttattggaaaaaatctgcatgtaagtggactcatataattcaaacctgtgtttttcaagagtcaactgtaatgtctttcaaagtaaaatctaaatgagtttatacttgatatatataagtttaatagaaggagtgcgttggctcatgcctgtaatcccatttctctgcgaggctgagatgggcggatcacttgagctcaggagttcaagaccagcctgggcaacatagagagaacccctttttattaaaaattaaaaaaaaaatcaatcaggcgtggtggtgcacgtctgtggtcccagctacttgggaggctcaggtgggaggctcaggtgggaggctggcttgagcccaggagatcagggctgcagtgaaccatgattgcgccactgcactgcagctgtgtgacagagtgaggccctgcatcaaaataataatcataataaagataatctgagaagtgagggtaaaagttaaaggaagattaaaaacaaaaaaaaaatgcttataatcccagtactttgggaggccaaggcaggaggatcgcttgagcccaggagtttgagactagcctgggcaatatagtgagacctcgtctctgcaaaagaaaacaaaacaacaacaaaaaaagaaaaaacagctgagcatggtggcacatgcctgtagtcccagcctggccaacatggtgaaaccttgtctctaccaaaaatacaaaaattagccaggcatggtggcttttgcttgtagtcccagctactcgggaggctgaggtgggaggatcgcttgagcctgggaggtggaggttgcggtgagctgagatcgtgccactttgctccagcctggatgacagactgagaccctgtctcaaaaaaacaaaaacaaaaacaaatcagaatggagcttataataatcacaccgtagctaagacttgggcactgctgatgtcccaggtgctgtgctagatgcttcctgcattattaccttgtttactcctcacaccaagctgggaagtcggtgttatgtggttattcccattttgcagatgggcaaacacaggcttagagaggatcgaggtcatcctgccagcaggtgagatttaactccaggcagtgtggctcttcattgccgctgaccctgcttaaactggaagaatgattcagatgggagtcatcttcccagctggctcctagtaagctgatgtcattcctggcatttaagctgcacccagccccagtgttaggaagacgcgctagaggagacacattagatcctttttgtgctgaatgaacttgttggtgtttataagaagaagacagaaccctagtggcttcatgctactccaggaccaagtccagattctcgccagccacccagcgcctgtccagcccagcccagcccagctccagctccagctcccaggtcttctcccttggcctggccatggggtcttcgtttgctttctgtgggtcccatgatcttccttggctgaaagccctcacgtcccctgttctctctgatctgacaactctctgccctgttgacttaaatgttgcacctccagcagggtgggggcccctctttgcccattggcaccatcatgtccctgcattcctgtttcaggttgttggcacagttcctgtcttcctggggtgtggtgcattcccatttcactgggagataatgatgaccatttacagtgatctttgtgtatttgcccagcaagcaagaggcagtctagtgtagtggttagggtgactgctcttgaggccagactgcatgggcttgaactgatctttctgggccctggagctgtgaccctggggaaggtacttccccacgctgtgcctcagtttcttcttctgtaaagcctacttaactcatagggtcattagagaattgagtgagttattaaatgaaatgatgtacttaaaactggacctggggccgggcgtggtggctcacacctgtaatcccagcactttggaaggctgaggtgggcggatcacttgaagtcaggagttcaagaccagcttggccaacatggcaaaaccccatctctactaaaaaatacaaaaattagctgggcgtgatggtgtacgcctgtaatcccagctactcgggaggctgaggcaggagaatagcttgaacccaggaggtggacgttgcagtgagctgagatcacgccactgcactccagcctgggcgacagagtgagactccatctcaaaaaccaaaaaccaaaaaacaaaaaagctggacctggtcaagccatcgagtgggagaaaatgtttgcaaaacacatgtttgataaaagactggggtccaggagatggagagaacttccgcaactcaagaataaaaacacagtcaacgcagtaaaagaatagatagataaagggtttgaacagacacgtcaccaaagaagattgacagatagccaatatgcatctggaaaagtgctccccgtcaccagccacctgggaaatgcacatgagaagaacagggaatgccccgcagacccatgggaaaggctggaagatgtggtgagaataggacagctgctactcactcaggctggagggatgtgcagtggtgtggcccctcaggaaatcagcttggtagtttcttttaaaatcaagtaaccatccttcctatgacccagcaattccagtaaatcttagatagatttgctcaacagaagtaggaatctgtggctgagcacggtggctcattcctgtaatcccagcactctgggaggctgaggcggacagatcacctgagctcaggagttcaagaccagtctggccaacatgacgaaacctaaaaatataaaaattagctgggcgtggtggtgcatgcctgtaatcccagctacttgggaggctgaggcaggagaatcacttgaacccgggaggtggaggttgcagtggcagtcaatatcgtgccactgcactccagcctaagcaacagagtgatactctgtcaaaaagaaagaaaaaaaaaaagtaggaatctgtaagaagactcttgtacaggaatgttcatagcagcttcattcataagagctggtacttggaaacagcttggggaccatcagtaggtgaatggatacacggacagcagtaattgacaggacggaatgatcctgggcagtgtcaaggaacaaggtgccggtacaggaaatcacccgagactctcaaaaccactatgctgagcaaaccaagacagaccaaaagagtacacactgtgtgatttcatttcatttcatttttttcaaagatgagatctcactctgatgcccaggctgaagtgcagtggtgcagtcatagctcactgcagcctcgaactcctggcctccagtgatccttctgcctcagcctcccaaggagcgaggaccacaggtgtgtaccactacaccccgctaatttcacttttacaatgttctacagcagacagagctaatctgtggtggttgcctctggggctgtgggcaggagttgcttggggaggagcaggagggattttctgttgttatgaaaatattctttacagtgagagtggtttgagatacgcaggtgcagcatttgtcaaaactctgcatgtgtactttaaatttgtgcatttcatggcatgtaccttttaactccaaggaaataaaagaactataaataaatactgaactctaattagtgatgtgtgtgattagagggaaaagtactgatgtctgcaacttactttgaaatgtgttaaaaaaagatgatatggtagactgaatagtagtaccaaaaatgtctatattccaatacctggaaactgagaatatgttctcttatgtggtcaaagggaatttgcaggtgtgattaagttaagaaccttgagatggaattagcctgggttatttgggtgggcccagcgtgattaccagggtccttatgagaaggaggcaggagggtcagagtcagagagaagtgaccatggaggtggaagttgcaatgatgtggggccaggagccaaggaatgtgagcagcctctgaaagctgcaaaagccaggaaattgatttcctcctggagcttctagagggaatgcagccctgctgacaccttgattttagccagtgagacccattttggagtcctggcatccggaaccacaagatagaaatttgtgtcgtatggaggccgggcgcggtggctcacgcctgtaatcccagcactttgggaggccgaggtggacggatcatgaggtcaggagatcgagaccacggtgaaaccccgtctctactaaaaatacaaaaaattagccgggcgtggtggcaggcgcctgtagtcccagctactcgagaggctgaggcaggagaatggtgtgaacccggaaggcagagcttgcagtgagccgagatcacgccactgcactccagcctgggcgacagagcaagactctgtctcaaaaaataaaaaaaaaaagaaagaaatttgtgtcgtatgaagtcccacagtttgtgggaattatttccagctgcaattggaaatgaatgctgatggattgctggatagatagagggatggacggatgtggaataaaacaagtatagacaaaggtgggtggtggactgtaggctgtgggtatacaagtgttcacttcaaactttacttggctgggagtgggggcccatgcctgtaatctcagcactttgggaggccgaggcgggtggatcacttgaggtcaggagttcgagaccagtcttgccaacatggtgaaactccatctctacaaaaatacaaaaaattagctgagcacagtgacatatgcctgtggtctcagccacttgggaggctgaggcaggagaatcgcttgaacccgggaggtggaggttgcagtgaactgaaattgtgccactgcactccggccagggtgacagagcaagactccctctcaaaaaataaaataaaataaagttctttagatgtttctatgtgtttgaaacttttaataatgaaatactggggggaaatgactgggcctgatacataataaaagccctacaggccaggcacagtggttcacgcctgtaatctcagcactttaggaggctaaggcaggaggattgcttgagcccaggagtttgagaccagcctaggctacatagtgagaccccctctctaccaaaaaatagaaaaaaatagccaggcgtggtggcccatgcctgtggtcccagctaccccggaggctgagggggagaatggcttgagcatggaaggctgaggctgcagtgagtcgagattgcaccactacattccagcctgggtgacagagcgagaccctgcctcaaaaataaataaataaataaatacatacatacattcatacataccctacataggtgtcagcctttgttctcattggcatctcatctccattcttattgccaccacggccactcccccactttatccatcaggtggagaagaggcctgggaagagaagagaccaggggctgggttggtggtgagcagacgaaataataaacatacaatgaggccatatgacatattgggagaattgctttcacttaagaaaatctaggctgggcgcggtggctcatgcctgtaatcccagcacttttggaggccgaggcaggtggattgcctgaggtcaggagtttgagaccagcctggccaacaagtgaaaccctgtctctactaaaaatacaaaaattagccaggcctggtggtgggtgcctgtaatcccagctgctcaggaggctgaggtgggagaatcgcttgaacccgggtggcggaggttgcggtgagccgagattgtgccacttcactccagcctgggtgacagagcgagactccgaagtgaaggggctggggctttggaactgtagaggctcatctccccagtaagctgtcacttgtgatgtggttacagctgtaggcatttgcagagatgggacgagaagacacgccaccctgggaactggcccgtgtcttcacacgtcctgcactgctgctgctgagaacgtctgcactttgttaggggaagagagtgttttagttaaatttatctggaaaacatattattagtataatgagattttaatgatttgaaattttgttggagcagcgcagggagaatttcaatcttaactgtgtgtgcagctgggcattgtttctattttattttgtttctttgcttgggcctcattgcaaggacatgtttctacaattattatttagtttttctttcctagagccctgctttgttacagctcttaattttcttgtgtagaagatctgctggagaaaaaagaatatcctttttgtaaatacttagctggcttgatcagaaccagagaatgagcgttgttaccgaaggagacttgtgtttgtttaaggtttactggcgcactctgtggttgccgtggagtggacccaacccagatgtccgttaactgatgagtggataagcaaactatgctccatccatacgatagaatactattcagcaacgaaaaggaatgacatatggatccatgctacaacatgggtgaatctggaaaacaggctcagtgagggaagccatttgcaaaaggataaatactgtgtgattccatttatttgaatatctagaataggcaaattgatagagacagaaagtaagattagtggttcccaaagcctggggaaggtacagtgacccctcatgggtacagggattattttgggggtgacgaaaatgttcttacattgacaatggtgatggttacacagctctgtgaatttactaaaaatcattgaattgtacacttatttatttatttatttatttattttgagacggagtcttgctctgtcgcccatgctggagtgcagtggtgcgatctcagctcactgcaagctccgcctcccgggatcacgccattctcctccttggccacccgagtagctgggactacaggtgcccgccaccacgcctggctaattttttgtatttttcgtagagacagggtttcaccatgttggccaggatggtctcaatctcctgaccccgtgatccgtctgcctcagcctcccaaagtgctgggattacaggcgtaagccactgcgcccagccgaattgtacactttaaaacggcaaattgtatggaatgtgaattctgtctcaataaagctggtaaaaaaaatagcgtggtactgagaggcagcgctcagagcttgtgagatgtttttctccagttggtattcgttgcatgtttccaaggtgagatctttcaccttggggtgagggcgggtggatccgggacagacatggaattttcagtcttcctcctcctcctcatcttcctgttcattgcccctgcagtggtggcagctgtcccatatcaaggtctcacactggccaggggctgggcttggtgctgtacgcagattgtcttattaggactatgaggcttttgagataggtatgataatatgtcctcattgagcaagtgacaataggaaacccccagaaattgtgtgcactgttttgcctgatctcacacactttggacagagactttgatcacattcttaggggcccacaaatggtcaaaaacctctgaactgagacagcagcattttttgtggtttttttttttttttttgagatggagtctcgctctgttgtcaaggctggagtgcaatggcccgatctcggctcactgtaagctctgcctcctgggttcacgccattcttctgcctcagcctcccgagtagctgggactacaggcacccgccacagtgcctggctaattttttgtgtttttagtagagacagggtttcaccgtgttagccaggatggtctcgatctcctgacctcgtgatccgcccgcctaggcctcccaaagtgctgggattacaggcgtgagccaccacgcccggcctgttttgtatttttgagatggaatctcgctctgtcgcccaggctggagtgcagtggcatgatcttggctcactgcaacctctgcctcccgggttcaagtgattttcatgcctcagcctctagagtagcttggactacaggcatgcaccaccacacccagctgatttttgtatttttagtagagacggggttttaccatgttggccaggtgggtctcaaactcctgacctcaagtgatccacctgccttggcctcccaatgtgctgggattacaggcatgagccactgtgcttggcttgggagagcaacttttaaactctctttttattttggatccatggtaagaaatatatttccataaaaaccccagttcaagcatacatttacctatatccatgaataaaagtttcatgaaatgatatcttcctataagcacactgacgtttgctactctactgttctttcatttcattaaagaaacgtgctgtccaggcaatctcagtactttgggaggccgaggcaggaggattgcttgagcccggtggtttgagaccagcctggtcaacatagcaagaccccatctctacaaaaaataaaattagtctggcgttgtgttgtgtgcctgtggtcccagccacaggtgcccctgcaggggcagggggctttcaggtgggaggatcgcttgagcccaggagtttgaggctgcagtgagttatgattgcaccactgcactccagcctgggtgacaaagagagagtctctgtctaaataaataaataaatacatacatacataaaatatgctagtcacagtttcctaaatggattttatgactcattgagtcaaaatgatagttttaaaatgttgctaagagagatgtaaggaggaaaatgtgttggtgagtgttgaggagcccaacttcttttgagaaatcattgttggatctggtgtctcatgtgttaccctggggtttcaactcctgtttgctcattcagttattcattgatcaccctgtcttccaggcatgcagtcattcattcaaggtgattattgagctccccttgagagcaggtatggggctgggggttggagatccagtgagtggtcctgcttgagagactggccctgcccacatggcactagtgggctgggactctcccatcactcttgtctccatcttgttgtgcactgttgatgctccattgaatgatcttggcatctttgctgaaaatcagttgatcatcaatgtatggatttatttctgagctttcaattctattatgttgatcaacaggtctgtctttatgttagtactacactgtctctatcactgtagctttgcagtacgttttgaaattggcaaatatgacacttcccactttgttcttcaaccttgtgttggctatttgggatccctcgagattccgtatgagttttagggcgtgattttctatttctgcaacgagccaccattggaattttgggaggaattgtactgaatttgagaattgctttgggtagtatctttaacaacacgaagtctgccagtccatgaacataggatgtctttccacttccttaagtcttctttaatttcccttcgcaatgttttgtggttttcagggtacgagtctcttgcctctccaggcagatttatccctgggtggcttatgctttcggatgctgttgtcagtgggattgttgtccttgccagtggtcgctgagcccagctgcagccttgtcttgcactgcagggtgtctgtgtcacctacttgcctagttctggccacttttcttgcaggaagtcagaagtgtactgatctggagtaggacccttagcacaacagagctgctccttggtgctaggagatgcgtcctgaggctggccatccatgtcagaggacctggcgcctcaccctcatcatgggatatcactgaccaccagtgggggatgcatctctgctgggcttggcctgcaaggtaggagctgactgcaggagtgggaaagagcccatggcccctgagggggcctacagttggctctcctgtggttacttggcatgtttgatagacgcctgggtctggcacagagaacactgcccgctgacaatcattgagcctcggcaggctggccccgatgacatgttatctccccacacagtccctggacacacttgattaaaggtgcttattactttcatagtgttggctggagtgatgtgataactccacaaaaggttctggcagaatcccagaccttggggtgttcccaccagtgtctctgtgttcaaagttcagcacagtgtggggtggcaggagatgggaacttggagactgaggccagagtctgctgacttgagcctctgctgaggtccttatcagtgccgggagagcagcagcctaatctcaagatggtttagaggatttagcgggggcgtgcatgcagagttgagaactggctcctgggtcggtgtgcggggggtggggatggcccgggggccgtagctacagtttgtcttccttcccccaccggcagaggtgaagagaggtgttttgtcctggagccaccaggcctatccatggaggagcagagcttcacatggagcctgtgccccgtcttagtctatttcgtgttgctataaaggaacactaaggctggctaatgcataaagaaaagaggtttacttggctcctgtttctgcaggctgtacgtggcactggcatctggttctggggaggcctcaggggcttctcctcatagtggaaggtgaagagggagcaagaaagggagaggaaggaggtgccatgctcttttctaagaaaacagaaacacagctgcattattttaagcaaaacacatattggcttaggtcgctgtattcatctcccagggctgtggcaccaaggcaccagacactgggtggctctttgggaggccaaggcaggcagatcacttgaggtcaggagttggaggccaggctggtcaacatggcgaaaccccatctctactgaaaataccaaaattagccgggcatggtggcatgaacctgtaatcccagctatttgggaggctgaggcaggagaatcacttgaacccaggaggcggagtttgcagtgagctgaaattgtactattgcactccagcttgggcaactgagccagactccatctaaaaaaaataaaaaataaaaaacccagcagaagtggattctctcacagttatggaagccacaagcttctaggggttagaattccaacatatctttttttggggaaagaggggcataattccccatagaagagcctgtaatctcagggagccttgacccaggtatttgacgttggtgtaatctacttgtgtatgtgtattggtggacaaaggggatggcctcacatcccttcagcatcttgggggtgggcggtgcctcccctccggctcccctgagtcagccccggggaagaccaattgtggggctggatggtgtgggaacccccagctccgtcctgtctccagccatcagtgaggtgtgcttggccattccccacaggaccagtgggcgggatggggcagctttgcagttggagaggatgggggttcaggcaggcagaacagatgcgcggacacagaagagctgtgcagaatgtggagttgagcttcctggaaggcccataggagaggcgagactgaaatcttcttgatactttttcactggggcctgaaagcctggtgcagaatgaaactgaaagcacttgtctcgttgagcaaatcattcaactttgttatttctgtaattgaaataattcctggcattaattatgtggagagcactcatgaccatgtggacatatcttttgggggcacatgaactgagggtaataatttcgctcgaattttttttttgagatggagtcctgctgtgtcgcccaggctggagtgcagtggcgtgatctcggctcactgcaacctccacctcctgggttccagcaattttcctgctctagcttccccagtagctgggattacaggtgcccaccaccatgcccggataatttttatattttttaattttatttttatttatttattttttgagacggagtcttgctctgtcactcaggctggagtgcagtggcacaatctcagctcactgtaacctccgcctccaggcttcaagcgattctcctgcctcagcctcccaagtagctgggatgacaggagtccgccaccatgcctggctaatctttgtatttttagtagagacagggtttcaccatgttggtcaggctggtctcaaactcctgacctcatgatccgcctgcctcggcctctcaaagtgctgggattacaggcatgagccactgtgcctggcctaatttttgtactttaggtgggatttcatcatgttggccaggctagtctcgagctactgatctcaggtgatctgtccactttggcctcctaaaatgctgggattacaggtgtgaaccactgcgcctggcctatttcactccattttgccgaggagggaacagaagtgtggagtcctcccagccacatggcctcggatccgggctgcaggtccaggctttccggctccagggctggtgccctctgtcctgtgccacttcccctgcaaaatgagatgaaaatgagtctcattttacgatgaggaaactgaggccctgagagagggtgagaaaccaggtctctggctgaatgcacctctcactgaagacatctccgggtggaaatgttctgagagctgctgtgtgtgctggtgtcagaatgaacaatacccatagtgcttggcgtagacaatcagcaaagctagggacccgttttctcctcccagccccctttctcacttcaggccctagacaagaatcggaggtccgtttctcaagtttagctcctgtctgattaaatttgaggttcgtttctcaagtttagctcttgtctgattaaatttggatttgctccactctttttcacgggcataaaaatatctgcggagtgaaaatgtgtgcagaggatgcactgcgtgcaggctgcggctcgaggtcaatcagattcctccagcgataaaaggcctgctgaggaagcggccccactcccagcacagccccattgattggcttttattttcctctgttgctggagtgatccaatttgaagccctgtttctgagcatgttgcaaggaaccctaggggctgccatagccctggagatactggctggaaatcaaattcaaattggtgctttcttcctattaaagcaggagacctctgcccgggaacgggccatttgggggctcagccatctggcacatggagtgagtaggttttattgccaaagccgtcccggccttggcctcagcctctgtgtggctctggtggggagtgtgtctcgatgttgtactgtgaataagccccatgcctacttgagtttggggtttctgttttacctacacttccatattgtgggcatgtggctgcggaaatgtgcctgcacctggactcgctgtcactcactggcttctcgtggtacagcctagggagggttgccccagccgtatttagttcttcctgcctcagatgaacgggcctcctctcccagctcctaatcaggagggcagagtctcgttggcggctctcctgtcctgctgccactgcctttacacttcttcagatatgcggccgtcttaaggtgtaaatgccttcctctgtttcccagtggttatctaaagcaaggattggcaaacagaatccacaccatagatttgaggtatgtttgttgtcctctttccttcttaaactgttagtaaacaagacattcctacaggtgacccctttcggcctttttttttttttaagactgagtttcgctcttgttgcccaggctggagtgcaatggcgccatctcagctcactgcaacctccgcctcccgggttcaagtgattctcctgcctcagcttcccaagtagctgggattacaggtgcctgccaccatgctaattttgtatttttagtagagatggggtttctccatgttggtcaggctggtctcgaactcctgaccccaggtgatcctcccacctcagcctcctaaagtgctgggactacaggtgtgagccactgcgcctggccagtcctgcactcttcaagtttctatgtgttgcagactggtggggtagcaatatcagttagagagacaggactggggtcacttgtcccctgttagctcagtgaccttgagctcagcttagacacattgtctctgaacactgtgctgatggcaacacctctctcacctgtcttgcagtcttatttgaggaattaaatgcaataacctgggagaaagtgcaggtatgaagtcagggcacacagcccgtcaccaggagcttgaaggaggagaagagtgggtggggatgtgagcacagaagctgaggcgggggctgagccgggtgtgtatttctgcctgtgccacagggacacccctttcaggcactgggcgcctagctcctgttgtctcatctcctaagagagtctcgggaggcctgagactccctcactgctgcgggcttcaagagcagcatctgtgctgagtaacagccatgggggcagaagcagagatctcccgtgacagagtagttaggcagccgtaaaaatcctaccaccagctcgtggaaaaggtctcatttgacaggtgccatgccgtcaaagacttgtgctctgcagctgcaaattcccaactgaaaaatatcaacaattcttacgaagagagaaggggagccctgcaaagctgttgtgtcaccccgtctgtttgtaggcgctggggggattgatgatgaggtggggactgttcggctggccacactgccattgtagatagcctgtgactctgtggctggcgcctggctggcctcagtgaagcccttcagtcccagctctgaccatgtctctgtggagagacaagcaggtgatagtgttgggtgggcaaggctgtgctggtggcctgcttagcaacagcaggaaaaggaaggagataaccaccccaacctttcttgctggaaggagcccttcctgttgtcggcgctgtgtgtaaccaatgaggcgaatgccgggaagcgcttggtttgtgtcaatgaggggagaggattgtgcagaagtgcaggaagggaccatgggaggaaattgagtgaaggtctctgttaggggtttgtgttcccctaaaaggtatgtccaggtcctagtctccagcccttgggactgtcaccttatttggaaatagggtctttgcagatgtgcttaagacgaggcctgtctgaagtagggtgggcccctaattcaatgtgactggggcctttatggggagaggaggcaggacacagacagacacgggacacagaggctggacagagattggagagatgctgccacaagccaagatgcaccgaggactgatggccaccaccagaaactgggaagaggccaggacggatcctcgcctggagccctcagtgagagcacggctctgccgacaccttgatctcagacttctggcctccagaactgggagagaatcgacgtctgttgttttaagctgccagtttgaggtactttgttaaggtggccacaggatgcgaatacagtcaccatctggcctttgatcttctaattgcctcggcggttctcctgccagtaagggttgtgagtgaaacttgaaggtcacagttggaaatcaagttaaaagaattaagctggaagtgcaacatgagagtccgtcaccctgagaggcggtgtgaatgccaaacacaggcaggcagggctggacctgcataaattgtggttcgacagcaccgggagaaagaaggcccgggcctgctctcctcacctgattctgggaatgccgaacctacctgtgttcctgatatcaccccagtgctaacttcccaccccttgaaaatgtcaaaacattgtgttatgaatgttcttcattgagcaactgcgatctctttctgtaaagatccagagaatatttcagcctctgtgagccatcctgcctctgtaggaatgaatcaactctgccttggaagcatgaaagcccctatagacagttcataagcatagccgtggctgcgtccccctgaagctacaaaagtaggtggggggctgggtgtggtggctcatgcctgtaatcccagcactttgggaggctgaggcaggcggattgcttgagcccaggagttcaagaccagcctgagcaacatagcaagaccctgtctctacaacaaatacaaaaattagttgggtgtgttggtgctcacctgtagtctcagctacttgggaggctgaggtgggaagatcccttgagctcaggaggttgaggccacagtgaactgtgattgtgccactgcaccccagcctgggagacagagcaaagccctatctcaaaaaacaaaacaaaacaaaacaaaacacccaaaaagacaggtggtgggccagatttgctcactggctgcagtttgccaatctatggtttaaaccaacaatttaaataacacacacacatctttgtatgatgttacacatcttttttttttttttttttgagatggagtcttgctctgtctcccaggctggagtgcattagtgtgatctcggctcactgcaacctctgcctcctgggttcaagcaattccccttcctcagcctcccgagtagctgggattagaggcatacaccacctcgcccagctaatttttgtatttttagtagagacagggtttcaccatgttggccaggatggtctcgaactcctgccctcatgatccgccctccttggcttcccaaagtgctgggattacaggcatgagccaccgcgcccagcctgatgttacattttctagaagttctcagtgatgggcatttaaaggattcggctgctgctccctgtggctttcacagcgctgccctgaatgggtgttagggcaccgtacaggtagcggggatgcctgggaaagcccagactcacagcaacacaacaacagttaacagactccagtgaccaaatgtgtgggtttttcctgcaccaactggcggataccagctggatgtcccctagttcaattcaattcagttctgactccacctacctggagatggcatcagatcccacagggtgagggctcagtctcccaagactctgaacagtggctgtaagtcagggttcccacagccccatctttgggttcaattaatttgctagggtgactcacagaactcggggaaacatttacttatatttcctggtttattataaaggatattacaaaggatacagatgaggagatacatagggtgaggtgtagggaaaggggtgcagagcttccatgccctctctgggcgtgccactttgccaaaaccaagcatccagtctctggaagctccctgaatcctgccttcctgggccttttatggagcctcattggatatgcacgattgacagccatgtagaaataggattggacagcaagggtgtgatctaacactaacagatggactggggaggccctgcaagacctatctgtgcagccttccttcctccaaggtgtgggggcccctctctggagtgagggtctcattacttacaatctgatgagagtcctgccttgggcaggtgaaaggagggcagaaggttagagagattctgttttctgaggctaaagtgccccaacatcttttattattattattatttttgagacagggctggagtacagtgatgcaatcttggctcactgcaacctcacctctcgggctcaagtgatcctcccacctcagcctccctagtagcaggcactacagccgcgcactacaacgcttggctaacttttaaattcttttgtaaacacaaggtcttgctatgttgcccaggctggtctcgaactcctgggctcaagcaatcctcccgccttggcctcccaaagtgctcagattacagcatgagctcctcagctagaagagttaaactcatagagagaggaagtggaatggcagttgccaggggcaggggttgggggctgggcagggaggggacagggagttagtgtttctgccttgcaagaagaaaagagtttggcggataacagcgatggtggcacagcagtgaatgtccttagtgccactgaaccgtacacttaaaaatggttaaagtagccgggtgcggtggctcacacctgtaatcccagcactttgggaagtcgaggtgggcaggtcacctgaggtcaggagtcttgagaccagcctggccaacatggtgaaactccctctctactaaaactacaaaaattagccgggtgtggtggtgggcgcctgtaatcccagctgctcgggaggctgaggcaggagaatcacttgaacccaggaggcagaggttgccgtgagccgagattgcgccattgcactccagcctgggcgacaagagtgaaactccatctcaaaaaaaaaaaaaaaaaaaaaaggttaaagtgagaaattttatgtattttatgttaaatgtaccttactacaattgaaagaatgaaaaaaaaatactgggaaatacattacacatacaaaagagtgtacatatgtatagtttactgactaatattaaggaagtacccacgttcctgctatccagcttaagaaataacattacctgttccccgagccatatgccccgtacctcctgtgcgcctccctccccaccagaggtgaccagtgccgccttgaacgttgcatttagcatgttgtattagttagagttctctggagaaacagaaccaatgggagatatgtagctctctctgtctctttttttttttgagacagagtctcactctgtcgccaggctggaatggtgtgatctcggctcagtgcaacctctgactccctggttcaagcagttctcctgcctcagcctccccagtagctgagattacaggcactggccaccacacccggctaatttttgtatttttagtagacacggggtttcaccatgttggccaggatgatctcgatctcctgacctcgtgatccgcccgcctcggcctcccaaagtgctgggattacaggcgtgagccaccgcgcccagcctgtctctctgtctgtctctatccatctctctctctctctctctctctatatatatatatatttgaagagattgattataagttattggctcatgtggttacgagactgagaaatcccaggatcttcaagctggagacccaggagggccaatggcgtcagcccaagtgcgggaggagacccacgtcccagctgagtgaatccccttaccctgcctttcggtctattcaggtgtcaaatggattggccgaggcctatccgcactggggagggccatctgttgtacccagtctaccgattcgaatgctaacctcatctagaaacaccttcacaggcacgcccagaataatggttagccaagcaccaggccgctccccacccagtccaggcagctagtcagcaggccctgccccacttgcttgtctttccttgcgttttgcacacgcatgcatctctgtccctcactttctttagttttgcccgactttgaccccaatatgacgggagccccaccgtgcgtgctgtcctatgactcgagtttacgcagtagcctagctttggggcacagccccatttacttggggcaccgctgcctctgctgtgtggccgtgtgggatcccacaccaggagcaccgtccctttgtcacctgggaggggtgattctgtgcctgagttgcatgtggatttcctcctgctgagttttaattaagaggcagggagcaggtgggtgaagggcacacacacggatgcagcgttgcccgggttcgaattctgcctgcgccatttcctgcctgctgaaccagatcggacaaattactctacctctctgtgccacagattttttgttgttgttgttgttttgttttcattttgtctcgttttgtttttgtttttgagacaggttctccctctgtcacccaggctggtgtacagtggtgcaatcacggctcactatagcctcgaccctgtgggcttaagcaatcctcccacctcagcctcctgagtagctgggacgacaggcgtgcacagccacacctggctaattttttaattatttgttgagatggggtttcactatgttgcccagggtggcctcgaacccctgggctcaagtgatcctcctgcctcagcttcccaaagtgctgggattaagtgtgagccacctcatctggcctttgtgccccagttttctcaatcaggtaatgatgatagctctcaggtggtgagggtgactgtataaaatgtctggaaatggcacctgctctgtgcccaggggttagaggcttgggaccgagctgggggctgagctgggggtggagctgggggctgagctgggggtggagctgggggctgagctgggggtggagctgggggctgagctgggggtggagctgggggctgagctgggggcgtttttgttccaaggctttcttgctgataagtttctctttctctctctctcttttttttttgtcctgcgtgtctcaacctgacaaaaatgctcagtttagaagcgtgtcgttccatttgtgggaaaattaaacacatttaagagtaaattaaattaggggacttgtgatcattagctaagtaaattattttttaaaaatgtgatgtaccaagcatagcacatgtggcacgctcaataaatatttgttagaatgaatgataattttatgagccagtcgagtcatatataatgggattatttggttctagaactaatgaagtgactgtagagcaataaagcttctaaaaagaatctccgtgctcgcaaaaaatccaaaagtgggggaagaggctcatgctggatttcacccaagagcgaggcccgaggagagctgggacgctgtgtcctgagagctgtccaaggggggcccttgtgacttggcaggggtggttttggagcctgagtttatccgcactctgggtggactgggtctcgggggaggcctgccttaggtcagctcaggagaccagtggatatagcaggaggcccacttgcagttcacggtttgtcttgccagatgtgcagggggcccggtgtctcagcacttggcacctgtgggactgagagaggagtcagtctagcaccagacacccgcttggtgggggaggggagtggaagaggagggagaggagagagagggggctggagccccagtcccacagcttaggtcctgggaagccctgtgggttcatgcttgccttgaggggaggttggacggctcaagcagggaccaggagcctcccagtgtggcatgagctttgctggaagcctgggctctttgagaggggtggggctgagagccgctagacctggcttcatcctcctgcctgctttcctgtctggggtgtaccctgggaagggacataacttccctgaacctcggttgcctcccctgtccagtggaggaaaggaaggcacctgcctaactgggctcttgaaaataataaattgagataatacaaaatctgcattaatttcctaggcctgacataaaagagtaccccacactggctggcttacagagcagaagtttattctctcccagctctgaagaccagaagtccaagatcaaggtgtcagcagggccttgctccatctaaagtctccagggagggatccttcctgactctcttggcttctggggacggtgggcagtcctggcatatcttgatttgtggccatgtcactccagtcagcctccattgtcacaggtgtcccccttcatgcccctctgtgtcttcctatggtcttctctctgcatgtcagcatccaaatttctctctcccatgtggacaccagctgggcccaccgcagtccagtatgacctcatccgaacttgattacatctgcaaagaccctgtttccaaataaggcacattctccagttgtccaattccaggtggacgtggatttttttttttttttttttttttgagatggagtctcactctgtagcccaggctggagtgcaatggcacgatcttggctccctgcaacctcctcctcccgagttcaagcgactctcctgcctcagcctcctgagtagctgggattacaggcacctgccaccacacctggctaatttttgtatttttagtaaaaatggggtttcactctgttgcgcagggtggtcttgaacccctgagctcaggcaatccacctgcctcagcctcccaaagtgctgggattacaggcatgagcctctgcgcccatcggacgtggattttggatgagacaccattcaacccacagtacctggtgctcagttagtgactaaaacccactagttatggtcactcagtcacccttcttgttattactttcatagatgagggtgtgatgggggggggaaacagaagcagagttgattgtatcttcttagttctgcacaccctgtggcttttttttttttttttttttttctgagagggagtcttgctgtgttgcccaggctggagtgcagtggcacgatctcaggtcactacaacctctgcttctcacatttaagcgattcttctgcctcagcctcctgaatagcgggcattacagacatccgccaccacacccagctaatttttgtatgtttagtagagacggggtttcacaatgttggccaggctggtcacgaactcctggcatcaagtgatccacccacctcagcctcccaaagtgctgggattacagacatgagcctctgtgcccagccccgtggctagttattagactgttctaggtcttgatgggaaaggggaggaggacttgttcttctctttggattaataaaacaccgtgaggcttgtgtttgcacagtgcccacagcttgcacactgacaagcccttttaggttgacttctgctgagtcatttcatcctgttccatttgtcagccataaggtaaggagcagtttttctgatgtactccttttgcataaatgctactctccatcagcctcgagaagtagaaggcaccggtatggtatcccaagctcattcacaggggagaagagatgcctgttgccacaaaatgtgaatgttgggtgtacattcaggtgtcacgtacgtggtgttgattgtctcagcttaataaagaaagatgccgtacacattttcctttaaaaagtctcacttggcttgtttgacaggcacagaagatgtgttattaaacacttgcaaagcctgctgtcatttggttttaaacagcactcgtcgtctttggcggggcgtgtttgctcagcatcatggaagggggatgtgaggtacccaggtggcagtttctctaccacgatgctttctctgcttgctatcgggagaaatgttctttcctatgttgtgggaaggcggaaagggcactctgaaatgtaaggtggccttttgtattagaatttcatggctgagaccaggcgtgggggctcatgtctgtcatcctagcactttggaaggccaaggcaggtggatcacctgaggtcaggagtttgagaccagcctggccaacatggtaaaatgccatctctactaaaaatacaaaaaattagctgggtgtggtggcagccacctgtaatcccagctacttgggaggctgaggcaggagaatcacttgaacccaggaggtggaggttgcagtgagctgagattctgccactgcactccagcctgggcaacagagagagactctttctaaaaaaaagaaaagaaaagaatttcatggttgattgtcacaggaccatctttagtcccaagatctgaggcaagggaatcgttttcaataggaaacttttaaatgtttgagcagcagaaagggagattgagccagaagaacttgctggtggaaagatggtggaagctgggagctttgaggttctaaaaatcctggtgtgtcaggtcaggtagtggggcaaccggagcttagggtgagttatacctgatgggacttaactgggtaaatgtcatctagtaacccaactacattcggcattaatatctggacaaaaggtggaatacacccgggttctttgggcacaggcgaaggagaggtctcatagtttgatgttgctcaagaagggaaaacaagcaggatgggaagaggtctaatcagccggctggagtggggtgctgggtttagttcattccttcttaaactcagccagttctcattattcatggtggttttgatctataaagttgccacaaaccccaagttagccaatactgagccatcactcctagggcagtacagcgctcggttcctgcgagcctctggtcacaacattttcagcaacagatccatacataactttttcttatatatgtttctttttaaagatacgttatttaaaatgtattgttgattgattaacattgagctcacggccaacagcagtataagtgctgcctgaatgaagcttctctgacctgtgcgttctctgcaaggcatacctcagccttcttgcacttgggaacactaggagtacccctcgccacgcgtggggacccattttaaacagcaaagttggctgggcacggtgactcatgcctgtaatcccagcactttgggaggccgaggcaggcagatcacctgaggtcaggagttcgagaccagcctagctaacatggggaagcccagtctctactaaaagtacaaaaaaattagctgggcatggtggtgtgcttctgtaatcccacctattcaggaggctgaggctggagaattgcttgaacccaggaggcagaggttgcagtgagccgaagtcacgtcactgtactccagcctgggcatcagagcaagacttcatctcaaaaacaaaacaaaacaaaacaaaacaaaacaaaccaaaacagtgaagtcaccaacaaatagcagaaaaatgtgaaaaacatggcattaaatagaccatgaaatggacacttgtttatgatgtgagacctcagacaagaaggcagagcgccccgtgtttgacctcaggtggggacacatccggcaactcagattcttttttttttgagtggagtctcactgcgtcacccaggctggagtgcagtggtgcaatctcggctcactgcaacctctgcctcctgggttcaagcaattctccagcctcagcctcccgagtagctgagactataggtgcgcactaccacacccagctaatttttgtatctttagtagagacggggtttcaccatattggtcaggctggtctcgaactcctgacctcaggcgatccacccgctttggcctcccgaagtgctgggattacaggtgtgagccaccacacccagtcagattctttgcttctgtgtgcaggtctgtgaatgaatgtaggccaagagtattgattctgagcttacaaattttagccagtagacacatttacacatacagaatccatgaatcaaggcgattgactgtactttgacaattatttgtttagcactgtaggaggaacctgcaaactgttccttccctctgctcacatactgcccagggtaagacttctgacaccagaggtgcagggatgcttcctgccgcacctggcagttctccagcagacaccagctgggtgtcctgcagttcagttcaattctgacaccatcgacctggagagagcctcagaccccacaggtgagggctcagccccacgagactgcaccccaaatcagggtccccacgactgcttcctcggttttgattaatttgctgggactcagaacttggaaatgggccaggcacggtggctcaagcctgtaaccccagcactttgggaggccaaggcaggtggattgcttgaggtcaggagttcgagaccaaccgggccaacatagtgaaaccccatctctactaaaaatacaaaaattggttgggcatggtggtgggcactgtaatcccagctactcgggagactgaggcaggagaattgcttgaacctgggaggtggtgattgcagtgagctgagatcgcaccactgcactccagcctgagcaacaagagcaaaaccctgtctggaaaaaaaaaaaaaagaactcagggaaacactgcatttgtgctccctggtctattataaaggagatgataaagggtgcaggtgagcagaacaggaggaggcacacagggtgaggcctgggagggcccccagcacaggagcttctgttgccctggagttggggtgtgccaccctcctggcacctggatgtgtttacccacccggaagctctctgcaccctgtagttcagggatttttacggaggcttcatcatgtaggcatgtctggttattagttcaatctccagcccctctcccctttctggagggtggggttggggggtgtggagctgaaagctccaggcttctaattgtgtctgggtctttctggtgctcagcccccacccaggagccaccaagagtcacctcattagaataaaacatccttttatctccctggaaattccaagggattaggaactttgtgtcaggaaccagggtcaaagactaaatattagaacaaaagattgtcctggcacctggaaattacaaggttcttaggatctgtgtgccagggactggtggcagagaccaatatgaatatttcttttcttttctttttttttttttgagatggagtctcggtctgtcacccaggctggagtgcagtggtgtgatctcagcttactgcaacctccgcctcccgggttcaagtgattctcctgcctcagcctcctgagtagctgggactacaggtgtgcaccatcatgctgggctaatttttgtatttttattagagacggggtttcactatgttggccaggctggtctcaaactcctgacctcaggtgatccacctgtcttggcctcccaaagtactgggattacaggcgtgagccaccgcgcctggcccaatatgaatatttcttattattttacaagcacttgcggtgtgtcctgtggtctccgtcctcagcgtcgtggtttagagggtgcctgacaggcagggtgtggggttagtggggttggggagtgatttccggggcacagtgatccccagagtatgtgtggttgtccagttcactcactcctcgtggcctgctcggtgctgggggtccacactcacagagggcatggtctgtgccccttgggatcaggcagctgctcctggtacagatgagttgggagatgacttcctccagggcatgtgagaagctctcaatgaccaggccagctcggattcccagttctggccgagccgatgtgctctctgttgccacattccgtgtcacttcccaggcctccccggcttcccattctcggggccaggtgttccgtggatggggtgcggtgcggcctttgataccagaggcctgggatcgctttcctcctcggtttctgtgtggtcagtggcgccttcacctgtctcatgccctgccatgctgccatgcaagggcagagggctggtgttggggtggtgctggggcctggggagtggaatatcctgctctgttaagatgctggggatcgcatgtgtgatgctggccacgtcagccagtcttccttcctgccgagaccaccagccctcggtgcagccagccgtatcacctggttatagtcacgccgaaacccagctgtttggaagcgtggccgtggggccttggatcccttttcctttccacgtgttttgtggagacgaataacacaggcatgcgccgtgcccaggtggaggcaatgttaggaaagcaggaaggagctcagagcaggaaatgtgtgtggactcgcgtttgttgaagggcctggccgagttccccagaggctggggtcagtgttcaagttctgatgcttcacgtccttggaggccaaaggacgtgaccttgaagaaggggcagttctcacctgtgggcctaggagaggtcgttggccttaagacattactccaggtaattatatgtggttcctacctataatcccagcactttgggaggcagaggctggaggatcgcttgagcccaggatttggagaccaccctgggcaacaaagtgagactcctgtctctacaaacaaaaacaaaaacaaaaacaaacagttggctggatatgatggcatgcacctgtagtctcagctactcaggaggctgaggtgggaggatcacttgagcccgggaggtggaggccacagcaagctgtgatggcactaatgcacttcagcctgggtgacagagtgagaccctgtctaacagcaacaacagcagcagaacattaatccggatagttctaggatgagggttctcagagctagatgggcctttgcaagttctttccactgatccccaggtttggttgattgtatgaaaccaagaggaaatgtacagggtttttgtgaagaaaggaaagtgtcatttctttgggttttactttgaatggcattggatgaggtcctcagagcttatgtggggccagcccagcctgccccatgtgccccactgagaccctggaaacttggctttctcccactgctcccccagtgctcactgactagttttggggttttgtggggaccctttgtctatctgcttcgtcttccccagatgaatcaggggacgtggtggtaccatagtggtgctgagggcagcttctgggtgggggttctcagaaggagaagtctgtccaggaagattatattttattaccttctccctcatcttatttattttctgtttttttagaggctgggtctctatgttgcccaagctggtctcgaactcctgggctcaagcgatcctcctgcctcggcctcccaaagtgctgggatgcaggtgtgagccactacgcccagcctcccacctctttcttatttctttattgtttatttcaacaggtttttggggaacaggtgtgtttggtgacatgaataagctctttagtggtgatttgtgagattttggtgcacccatcacccgagcagtgtacactgcacccaatatgtagtctttttatccctcacctacctcccaccctttccccaagtccccaaagtccattgtatcattcttatgcctttacatcctcatagcttagctcctgcttctgagtgagaacatacgatgtttggttttctattcctgagttacttcacttagaataatggtctccagttccatttccatccaggttactgcgaatatcattattttgttcctttttatggctgattagtattccatggtgtgtgtgtgtgtgcatgtgtgtgtgtgtgtgtgtgtatacactgaaatttctttatccactcattgattgatgggcatttgattggttccatatatttgcaattgtgaattgtggtgctataaacgtgtgtgaagtatgttttttgtctgatgacttcttttcccttgggtagatacccagtagtctcctacttctttttaaaggaagccttgctctttcttaaaagctgctaaaaaggaatgagagtggcgctacagcaaacatctattgagcgcctactgtgtaccaggtgggtggctatggtggaatctaccacttcttaaaagtcaccatccaagttaccgtttttctgaaatactttgtctttcaactgagtgctttgtttttagtgatggccagtgaagggcccaattcaaacagaagcagagccgggggatactgaagggcctttctccctgtgagccccttagaactcaggcagaaatattttagcaaaaagtcgaatctgtacttctctggcttttaatgggttatattgaaaaggatatgacctgcctctaaggttgtaacttacgtttggctcagtcttaattatcttaacaaggggtgcctccccacccatcatccccataccttgtatttatgcatgtattgacttttctcccactttgatagcttgaaggcagggctgcagtgtttctcaccttggcaccccaggcttgagtgatgcctggcacacagtaggtgcacggcacacatctgagttgagatcctgatacgcaccctgtataagaccttcaacagcctgtcgaccactcactgcctccgtttcctcatctgttagatagggatgatcataagggttctttcttgcttgccttatggggccttgatgagaatcaaatgaaatgatgacatcagtcccttaattatttctcctcctcctcctcctcctcctcctcctcctcctcctcctcttcctcctccatctcctcctctcttcttcttccttttttttcttctttcttctttctttttcttcttcttaggcagggtctcactctgttgcccaggctagagtgcagtgggatggtcataggctcaagtgatcctcctgcctcagcctcctgaataactggaactacaggtatgtgccattgtatctggctaagtttttgtagagacagggtctcactatgttgcttaggctggtctccaactcctgggctcgagcggtcctcctgccttggcctcccaatgtgctgggagtacaggtgtgaaccactgtgccaggcccctttaatttattctgaaaatggcgtgtcaggagctgggtcttggctgccttgcttgcattgtgaaatccccttgcctggcaggtaggaggcagtcgatgcatacagggtgagtgaatgaaatgttagttagttgcattacattgaagtggtctaaacctgactctaagatgtgactactaggctgctgatccttttatgatttttcaagtgcgtagttattttccttttaaaagctaatcacatttcctttcctgactgatcctctgttatttctgcctcctcccccaaggggctgaccaccagccccaggcatctccttggccagctcagtggatacacacacgtcaggaagaccctcccttgccccagccttccttcgtgggtggcactggacactgggcagatggaaaggccctctccatggagcactgggctggcgagggccttcctgtctgtgccctcatgatgtcctcacttggctgtcgaggcatctcctgggccatgaagtgctgtttgctgtcctggccttggattcctgcatcaagtctcccagcaggaaaactgttaaaccaaaaccagtgttgggaactgcatcagagctggggaccacatcagtgctggggacctggatcagcattggggacctggattagccctggggacctgcattagtgctggggactcgcatcggcattgggtgtctttttgttgcttcctcaagtcctagttttgactctggatgaagcttggtttgtgccgtgggagtggagtgttgggggacaggggtgaccggcgggtgagccctcactgttgatcctggcctcgaatgggagaggggcactagtgcccctgggagtgggccaggcatgtcccagtccactgcctgccccagagccccgcctggagcacctgctgggtcgggacatgggcctcccgtgggcctcaccgcttcctgcttcagcagaactgggattgtcagttaatcgagcaacacctccaggaagccagcctcaggaaagagcttccacagggagttgggggactggtaattggaataaataaaagctaatcgtgcttcctggatgccaggaaccactgaaatttgtggattcccacagcagcacatgaggctggtcattgttaataacccctttttaccgacgaggaacccagaccagacagagagcccgcctgtgtcacctggtagggaggggctgggcctggtgttataaaccaggagagggttcaggccgaggaaagggggagcaagttgccggccaaggtaggtatcatgcgagtcctacttctcccctcattcaaggaccttcctttggggaagtgagtgctcccgagagcagcctgccgcctccgtgtcggggcagcctcagcttcttctttctgtgtccgatatttgatttctgttgtcgtggaaacggggtggcaagtgttccatgtgttagcatttggtcctcctgacgtagtcggcacacgggagatgcagctggggtggcacgtgcccacagtggtgccacctcttgccgggggtcaggcagaggagacccagctccgtgccagcttgcagacccccaatcacttctcctgtctcagggcccagagagcaaaggcagtgggaggccaatgtctgttgttcagtttagctctgagccacgtgcatcttcagtcagcccaggggcctgggcgcgcccttccttccttctttgtgcatgggggttttcctggggagcagttgccctggcccatgaggctgatgggagtcaagacagaaatagtggtctgtggtcagcaaggagctatcgctggaaacaccccggtccttccacagcctgaccctctgtgaccttcctcaaaggctccccaaagaggctttcccttgaagtgcaagtcatagtggcgcccctgccacgtccctatatgaacggggtgtgtgcccgcctgccctccgacgtccgccggctgtgctggtctgcagagctgccgccagctgcaccctcctcgccagtgagttctgttgctttcgtatcattttcagcaggagctaaacccaggccagcccttcttttcttttctgctttatggcagaattttgttttgcaagaatggaccctgggtggctgcttgacttttcccaggaaggtgatggggacgttggtgttaggacgatgggcaagggggtccaggttgtctcactgcggccccagagggatgagggtctgacttgtggagtgaaatttccagcactctgctgggggcgagtagatcattgggcccagaagaatgggatttggaacattctcaggcacatgctgcaattaagattttctttttcataggggtacctgatactgtgggtttctctctctctgtcttttttttttctctctgagatggagtcttgctcttgtcacccaggctggagtgcaatggcgcgatcttggctcactgcaacctctgcctcccaggttcaagtgatcctcctgcctcagcctcccaagtagctgggattacaggctcccgccaccgcgcctggctaatttttgtatttttagtagagacggggtttcatcatgttggccaggctggtcttgaactcctgacctcaggtgatccacccacctcggcctcccaaaatgctgggattacaggcatgagccaccgcgcccggccatgggtttctcgttagtggtcttcggttctgtgtttcccctctaagtagctgatcgtggccggtgcctggctttcccctggtcaccactagatattctgtcttgtctttgggaggcagagtcagtagaaggtgctttgcactgggcatgcctgggagtgagcccagccttgctgttattagcgcccatcgtgacggtcggccaggctgccctatgttcgatttttcctcctgtgaaatgggaacaacagtagagctgatgtgtcctgggctttctgcatcccagggactatcccagctccttaacgtgctttgctcagtgctatcctcctaaaaagttttcttttacagttgagtaagctgaagcccagagaggttaagtaacctgcccaaggtcacaccgcagatcggaatgggagtcaggagtgtacccaacagcctggctccctagtcagtgctctcaacctcagcttgaaggccgcctccctgggccctgctaggggacccagtaagatgacagttattcacattctcctttgtttctgataccaagcaaactcctggtaaatgctccttccccacttttgtggaataaagaatgcacatttttttctgagctctgcctgggtatccttaaggagagggacgctgtgcctgggacgcagatgaacaagataggagctgtttcctggaggagctcccaggctgatttttgcctttgatgttctgcatctttttcacaggctttttgtagatgtgtggggatatttctagaggagaaaccagaggtggaaggaggggcataatgaaattgaatgctgggcatctcttagctcacattatatgaggctcttcagggacaatagaccttgcaataaaaggcaaaaaggtgattgcgcacagagtgcttttcctgcacagtgctgggcgggatggggtggatggggcttggcggctggaggagggtagaccctgcccgcacctcctgggacctgtgcgggactttgctcaccttgctgtttctaaccaaggtaccagattctcttcactcaggtgtgtcagattttaacccttgaggctagaaccttgccaggcttattcgaagtcagtggttcctagtagtcacagggcccctgccctagaccccagaccaggaccccccggcccctgcccgcccgccttggcctggtggggtaggagtcactgtgaaaggggtcctggagcccagtatcactccagcgacatttcccagagagcatcctggggccagtgtggggtgtgggggaacagatactgagcgctctgtcccctccccttggagaatctcacagtacattagcagagtcaagactctgagaagtccggtaggaaaagacacctgcttagcttcccttaacttcacgactcctccacctccttgacctttgcttgattcatgtgtgacctgtgaacgtctaaactgcaggactcactttgggagatactgatggagaccaaataggtgtcctgctcatatatcctccacttcttcagttttgctcaggatccactgggcttcctaaaatgcaaacgaattgaaaagctgtgctgaatgtgtttttctctgtctgaaagtacagccacccacgaaaggaggaggtctgctaagttttcttttagaaaaggggtccccaggctctgaatgcttgaggacctcattgggatcaccccctccattgtgggctacccatcctccacccgctgtggcctattgataacctcccagccaccacctatgctcctagaggccctgactggaatccctgtcctcaccctgagtttgtcacctccttccaaacttcgtgtcctctgttgcagttgaggacctggaagtcatgattgggctgattagtgatgggtgtttattttgaattcttaactaaacaaggaggaatcacatcctagctccgtattttactagttatgggaccttgactttcccaagatctactttccttgtcagtaaaatggcaataatcggggtaacccataccctgattgctgagaacccctgtaggcgtccatgcctggcccaaagccaggacccaggaagggaggcgcagctgggcggcctcttctgcgtctctgccagttgctggcttggattctaacaccctccttccctccctccctcgctctctaccagtgggatctgagaccatgaaaacgtttgaaggtttctcaagcgtctgtgactgccccacgtctgtcgttgggtggaaaggactttgtaattgaacggagtcagttgtaatgtgaatgtcatgtggagctgcttttccttggcaagtccttgctgtgtgagccattgtttccagatctgtagaaccctccctaccctgtccccctttccgggctattgggaggctgagcgagctcatcatgaggcccctgaaagatagtttctgtgccctgtggagctgagtccccgagtctctgtccccacctcacaggccccctctcaccaccctattgggttggtaaatttcaagttgggcatcagataggacaagggaaggggactggagaaggaagagccgacagtttgccctcaggacttcagagtcactcttttttgtttggttggttttttgagatggagtcttgccctgttgcccaggctggagtgcagtggcgtgatctcatctcaccgcaacctccatctcccgggttcaagcgattctcctgccttagcctcccgagtagctgggattacaagtgcatgccatcatgcctagctaatttttgtatttttaatggagacgggggcttcaccatgttggccagacttgtctcgaactcctgacctcaagtcatccacccaccttggcctcccaaagttgctgggattacaggtgtgaaccatcgcgcctggcccagagtcaccctttctttttgtgccttattagacatcttcctgctacaggatagcccagaagaaaggaacaagtttccgtcatgaataagtcccctacctactagggatgtagggataaaggactggaactctctttcttcaccctgcagggcaaactccttcaagactcagctccaggaagcctctctggactactacactccctcctgagcccccagccttctcacatacctcccttatgtgtctcctgggtgctggagccctcagagcagggcctgtatctaagtccccctgtggcccacccagtgccccgtgccaggcctgaccatagtggatgtcactaagcagttgttcaatgagtgaatgaacaaatgcaaactaggcccaatcttatcaaattatactagaataattgtataaaaaaccagacttctttaagtggaggaaatttaaagtcagaagtgggctgggcacaatggctcacacctataatgctagcactttgggaggctgaggcgggcggatcaccggaggtcaggggttcgagaccagccagcctggccaacatagcgaaacccgtctctattaaaaataacaaaatttagctgggcgtggcggtgcatgcttgtaatcccagctactctggaagctgaggcaggagaatcacttgaacccaggaggcagaggttgcggtgagcggaggtcgcgccattacactctagcctgggcgacagagtgagagtcagtctcaaaaaaaagaagtgaatgaatacgaccatacctgcttttccagctcctgactcttaaacgtctcgaataccaatgccaaataaagggaaccgagagatgaaaggtgtcactgtcctgatcttcagatgcagaaatttctgtgtagctgaggaggtggggcccgcttgcccccctttgaattttgggttgtgcttgagcagaagcattcattgcttggagaaagcagaggagaccccagaagcacttccctctgaaagggagaagcaggtaggccaaggcagcggttctgggaccagctctggggccacctgcttttcccacactgggtctgtggtgggctcggcagctggcctgcacacaggagatcctcaaaacagatgagcgagcatgattgccatttttacactccctcatttaatccgcagcactggaggaggtgtgattatggtgtgtattttgtgcagccatttggtggacacctaccgaggacccgccgtggggcaggctgctggctgggctctgaggatgctgacgaggacccttctttgggatcctctgttcgggttgaagacagtttatgaaaacataagataacagaatggccgactctgaggcaggagccaggggtgtgtgagtgggggtcctggaaggggtctctggaaaccagaggaggagtggtcctctgaggctggccaaggctcccagcagagagacgggggcatgggcagaagcctgtcgtgccagtgagccctggcatttctgagcccctgatcggttctgttgcctgcacgacggcctgggtgagcaacactgacaggagacccctgccttagtaccatgtctcctgggctctggctagtggcgcctcctggcagcagctgcccaggccacacaggatgctggctacatgcttggctggtctggccatccctgcatggccccgctgtcactggtatctggagatcacacccagccagagcctagtgccaccctcggatgcttccttggggagggaggatgccctgtttccatggcaaccctaggtgggaggccagggcttcaggcaagctgctgagcttttcacagccctgggagtgaggagcagggcaggctgaccctggcctgtggggcagaattagtagaggaggagccccaccatccctgagaagaggaggggagtggggtggggaacattagacaatgttcactgcccctccctcagcttcccagctgcccacggcagtcccaggccaggccagtgtgggcgtggggggcagttagagcgtggccgtgtggtgtgccagcacgcagtgcaacagccaagacaatggagtcatcccctgcccctgggcccttccctccaccccacctcatgtctgcactaggtgaggaagcagaggacggaggagcccagtgggctctgggagctcctgggactcctgagtcggtggggacggggcttcccagcctcaacactgaggattcttggttgtggagctctcctgagcattgcggggtgttgagcggcatccctggcctctacacacgaggtgtcagttgtgacaacccaaagtgtctccagatgccactacgtaccctcccagtgtgggggtggaggaatcgtccccagttgagatccgctgagctgagaggctccccggaagcaggtggtgaaggaagggaaggccctgggccctggagacatggatgcctgcctgggacacacacaaacacgcacgcacatgcacgcatgcatacactcactcatatgcacacatgttcatgcatgcacccgcagtgaccctgaagggactagactatttttagagcacttttaagttcacagcagaattgagtggaaggtgcagagatttcccgtgactgcacggccccaccacgcacactatcaacatcctccccctctaacaacgtccagaccagagggtgcatctgtggtacctggtggacccacatggccatatcagggtcacccagagtccacagtttccatgaggggcccctcttggtgctggacattgtgtaaggacagggacccccatggtagcagtgacactgccctgagatccccgtgccccacctgctcatccctgtctccctctcactcctggcaacctctgctcctttcactgtctccgtagttttgcctgccccacagggtcgtgcagttgggatcacactgtctgcagccttttcagactggtttttcactcagtgagatgcatttaagtttcctccacgccttttcacagctgacggcgcgtttcttcttggttccaagtggctctttctgcattgtctggacggatccatttgttccctgtttgcctcccagaggatccgctgctcttgctgcagatgtatagcccaggtgctgtggagttgggatggagcagtcgagctgggatcagagcccaggcccctgccctgaggttggagctctctgactgcacctggcctaggcctgtgcattgtctaaactgatggccgtggggcaggggacctggagcgcaaagcaggagaggatgctgaagggggcaggtggggccgggacttgggagtgtctggaaggaggaccgcctgcctcaacccagggctggtctgtggaggccagagcgctcagcccctcaatgctaggcctgttgtgagtttctccatgaggtggccctctcagaaagagtggctccacagcagctgagttgggggccccatggcagctgagtcgtggactccatggccgctgatttgggggatgcctgtccttgtagagactgtcacctctaggaatggtgaaagggcggccacccgcagccctgtgtcctctttctagtcctctgtcttgtaagcccggtccccacagtggccccagtcctcccctgccagaaattcgttctcctcagaaatccgttctcctctctgatctttcaggcctagagacaggctcttccctccggagggtgcagcccaggggttctggtaagatacagagcccagcctcaacatagcaggaagtttttccacaaatacacagttcttcaagaccacatgcagctgtgcgtggggtgtgttttgaagggcaatggcaggagcagtgtatgcctcgtggtgcagggagcacgagttgtttataggcgtgcctgggtcctgggtctctgtgcaccctcctctagattcatggggcatctgcccaccgtgagatagataagccagggtgcctgcccctttctcaggtgagatgctgagggccagaaacatgctgctgtgtcccatggaggaggtggcctgccccaactcccctgcaccctagggagagtgcccacaggctgggggctggggctgggtcctgtgccccctccccagccctcggtatgtggctcgctgaggtgtgcgccggaatgttgggcacatcctgtctgataccagcttggctggaagtcgaattatgatcagaatatcacatgatgtgtggcctgggtccccctttggttgacactcttgagtatgggtcctgtgcctgcccggggccaagcagcaggtgcaaccgggcctgccctggggcagcatggggtgtgctagtgtcctggggccactgtaacaaagcaccacaacctgagtggcttaaacaacagaaacatagtctgtcacagttttggaggctggaagtccaagatcaaggtgtcagctgggctgtgctccctccagggctccgagaggatcccccttggcctcttccaggctgtggtggctctggtgttccctgccgtgggccacatcactccagcctctgtctccctcttcacgtgggcctccttctccgtctgtgtctctgtcctctcctcttcttgtaaggacgcctgtcattggattagggcccaccctaatgaccgaatctgcaacttgattacatctgcaaagaccctgcttccaaataaggccacagtcacaggtgttgggggccagactccagtgtgccttttaggggagatacagtgcaatacacagcacacagtgaggtcttccagatccccagacctatcttcttccagaccgccagacaacaccgataagggtgaagttggcttacgagtcctggccaggatgtgacggggagtcgccaggtgggtgccggggaggtgggaagctctgcaggggattggagaaccacacgtcattgcccacatgtgactttaaaccttagcaatgatattggagggggatagttactctttttttttcttctgagacagtgtctcattctgtcatccaggctggtgtgcaatggttctagcgattctcctgcctcagcctcccgagtagctggtattacaggcacctaccatgacactcggctaatttttgtgtttttagttgagacgggttttcaccatgttggccaggctggtttcgaactcctgacctcaagtgatccgcccacctcagcctcccgaagtgctgggattgtaggcaggggatattactctttacagctagggaaacagttgggcttggtgacatgatagagacaccaggtcccttgaggacagggggccatttgcagagccgtgtggtggaaggagcctgaatttggagccccaagctcacagcgtgggtccttgtcacatgtcctgtgagctctgtttgcatccttagctcaggcaagctactgtgttgaactggctggacacagtgtgtctgtctctccctcttccagagaagtcctcacttaaggttgtgtcactgtttttactgatgttggaattggcacttggagatgtgaactttcccaaggccacacacccagatgagtggttagacccggacctgcctaactccagcatatctttttcagggggacacaattaaatccacagcatggactgagttcccctcttctctgccaccatcctgaccttttcctggccagggttaccatgtcggggcaggcatgggggaagtggtaagggaggtatctggacctagtaaaaggctctggtcctcctgcttcctcttgtaaggaccctgtcaatcacatcgggccccctgaataaccaggctaatctcccaccccaaggtccttacctaatcacatctacaaagtccccctcttgccatgtgaagtcacaggttcctgggacttgatgtgaacatctttgcagggaccatgatccagccttccatagaggcagtgacagatggagtagaatataggtcctttgagtatttatttatttaagatggagtctcactctgtcgcccaggctggagtgcaatggcgagatctcagctcactgcagcctctgactcctgggttcaagcgattctcctgcctcagcctcccaagtaactaggattacaggcgcagaccaccaagtgcagctaatttttttgtatttttaatagagatgaggttttaccatgttggccaggctggtctcaaactcttgacctaaggtgatccacccgcctcggcctcccaaagtgctgggataacaggcgtgagccaccgcgcccggcccctgtgagtttttacaagagacactgcagtagagagaatggtagagtcctcaaaccctgattcagtcgttcatgaattcactgagcactcaacgtttcccgcaatgtgtgtcctcttctttgccagcctgctggtgtgctcctggtgcttggtccaccatagatgggtgtgcttggtccaggaggctgatggtgctgacatctgggctgatattcaccgtttttagtgacttgaatgacgtccatgcagaagagctagtgcaccatccttgtgtttgaaaatgcccgggctccagcctgagaacctggtaggccagtaattggagggacagtagcaggatcgagaagccatctgtgtcacgtgttcttggggacaaagaggagacacaggctcaaggaacagcaaggtttgtgggacacagctgtgtctgaaaacgtcaagcagttagctcatccctggctacttcctgtgaacccattaaatccccaggctgaggaggacagagggtgagggaatctgaccccttactcagccctttagccagcggctgctgtgctaagccattctgagaagccaccggtggagaactgacttcaggtcgtgctgactgtgaggccatccagttgtttttgcacattgaaaacaatacattacactttgggaggccgaggtgggtggatcacttgaggtcaggagttcgagaccagcctggccaacatggtgaaaccccgtctctactaaacatacaaaaattagccgggcatggtggtgggcgcctgtaatcccagctacttgggaggctgaggcaggaggatcgcttgaacccaggatgtggtggttgaagtgagccgagattgtgccactgcactccagcctgggggacagagcaagactccttctcaaaaaaaacattgttccggatttgctaataaggaggcaacctcctcagaccttggtgtcacaggagaatggcccgcggcagccttagggccagttgtgattttatccacagtgttggtcagatgcgtcctctgtgcttgtttaatattcattctgcttgcgtgaacaaagccatgtcagtttcagtaacgcttgtgccagggggcacccggtgtggagcagggctcagtaaaactgctgcaaagaatgttccaggctttttgaaattacgtggagttgctggggctctcttgaggctgttaatttacttagggctgctgtgacaaaataccacaaacccagtggtttaaaccaacacaaatctattattttacagttctggaggtcaggagtcccaacatcaaggtggcagcagggccggttccttccggaggctccaggggagaatcccattccttgccttttccaacttgcagaggcacctgcgttccttagtgcctggcctcttcctctgtcttcaaagccatctcccgatctttctctgtctccttcgccacacctcctctggctctggccctcctgcttcctcttgtaaggaccctgtcaatcacattgggccccctgcataatccaggctaatctcccaccccaaggtccttacctaatcacatctgcaaactccctcttgccatgcaaagtcacagtttcctgggacttgatgtggacatctttgcagggaccaagatccagccttccatagagacagtgacagatggagtagaaagtacatcctttgagtttttacaggagacactgcagtagagagaatggtagagtcccgaaaccctgattcattcattcatgaattcaccgagtgttcacggagcacctgcctcagtccaggcgtcatgttgggagcaggggagacagagcaggccatgcatctgtcctttcagagcactgtagacgcaaatcctgtagcacagatgtgccttagactaatagtgcctcgaaaggagaggaaggggaatggatgcggggagtggggaacctgacctgctttgtggggtcatggagtgactctccacctgccgtcatccctccatcccttgtttggggctgttcctccaaaggtgcagtctccagcaggggtgtggggacccctgtgggccgtgaaggcctttctccttttctgctgtgggcattgcatctgttcctgatgggtagagttgtctgtgcccggtggggcccaaggcagtgccatggtggttctttgagtatctcaggtgggaactgagctgccagcaccagaggccaatggcttccagcactccccaaatccacctgcttttggaaggggcctgtctccgaagcaggccgggtcctcctgttgggggaagctttcatggaggcatctgtgtcacttctgcaggggagacagccgctagagggcactgtccttctggcctttcccacatccccgtttccatggcaggtgcatagtaaagcctttctttttctaacgacttaatgatttaatcttcttattttctcagcagacaacgctttggacttccctggatacattgggacgttaccagtcacattaattaatacgagtttcacaacttgggaaccagcgaacgtgcttctccagacttagcttctgcacggccgtttctgctttcctttatgaagtgcgtttctctaagagcctggcagtctcatggggctcgtctgttgctggaagtgagcagcgggttccattgccccccgcctcggtggggctcattgtgcagcttgctggcaagtggctgggctcggaggggcggtgacggtgacacacgccaggggaaaggttggcatcctcttctgagaattgtttcttttgggtttcacaccctgcccccaccttctgctgcctcgaggctcttttcttcttattattagctaatgacagatttcatgaccagtgactgaaatcatttggaagtaccccctgaaagccagcgtgatgggttggagaaatgtgacagacgcagcctctgaaaatcacagaggcagaggcttgcgtcgaaggacttgctaaggaattaggatgagagtggtcaggaggcagtggctgctgggcactggagctgagggtgaggggccgagaaaacgggaggcaaatggggtagctcttttttggggcgggggaggctggctttggggatgtgtatcccactgtgcaccgcaaggtgggggcactgggcggtaggttcccgtgctccggaagggtggcaattgaagggaggaattaaagaagttggccaggtgcggtggttcgtgcctgtaatcccagcactttgggaggccgaggcaggtggatcacttgaaatcaggagttcgagatccacctggccaacatagtgaaacctcatctgtactaaaaatacaaaaattagctgggtgtggtggtgcacacttgtaatcccagctactcaggaggctgaggcaggagaatcgcttgaatctgggaggtggaggttgcagtgagccaagatcgagccactgcactccagcctgggcgacagagcaagagtccgtctcaaaaacaaaaacaaaaacaaaaaacaaaaaacaaaaactgactcatgtggctttcagtctgagaaaccaatcagatcatcattgtctctaaagaatgtgtcctcctttgtagacaagaagctcaccggcccctccatgccccggtttctcgcccaggtgggttagacggccaacctgacattttaccgtgcacctggaagtctttcttcctgttctccttcccacaaaggattcatttttctgtggttctaacattttcctgatcaccccagggacaaaggggaagaaaagaccgtgtttctgggccaagggaatcatctgtttaacatgggcttcggagctttttttacatttctatgtaagcaacttttcgtattcagaagacccagtttccctgagccagatggactccttccatctcggggtggtctgtatttcagattcctgcagcaggtggctggtcggaatgcacaccccaggaggtgaggctggggggatgttggctcctgggctgcttgtactagcaagtccctaattgcggagcggactccttcctcctgagcccatcagcctctacgtggccacatcagggtaattgggttccttgtgaaacacgactgccaggctaatgtaaaccttaatggaaaccctctttttccacccaattaagtggctggaggtgggatgctgtgtgagagccgtcagttcagttccctgactttctcttgtagaaattatctatgtagctccatttggcctacataagcttagcatttgtgttcattcattcattcattccacagatattcagagagcagttatccatgtgctgggttttatgcaggatgtgaggccatggtcatgaatgggacctggcccctgtgcactccttgcggggtcggggggtgcagggagatgagcacagtccacaatcacatgatcggggaatagggtttgtcattgtcatgtgcacggggagctgtggaaacccagaggaggggcccgaactgcacccagggatagaggatgtgcagagtgtgctttccagacggtgggaaatgggtggagctagctgacctgaagtgaagggcattgcaggttgtggggacagtcgagcagaggggcagagatatgacctacagaagtggcctggaatggcctcatcagacgatgagtgtggaagcatggtaactgcagctgtattgatgagaggaggggtctgctcattaacagtcatcgggtaccactatgaaggttttgcgttttaccctggagctggtgggagccatggggtgcactgcagcagggagtgaccaacgccagctttgtgtattggaaggatttctacatcagacaggactctcttggtttgcaaaggacagaaaacccaactcaaaatggcttaaaagcaaaacagaattcactggtacatttgacagaatggtctgtggggttggatggcctcaggtaaggcttgatccagcacatagaaggtgttgctagatcctagattctgttctccccttccccgagctctttcgatctggtgccttcatctccaggctctgtatagtggtaagatgatgggacggcttcaacctccatcctttctgggtcaaggccagtgggaaggagtgcctgtctcattctctattcctggtaaagtctcagtgcagttcattagctctaactgggccatgcccatccctgactgtgttcctgggaggccagtgtgccagctggctttgtcctgggatgcctgctccaccccagagctgaactacaaggcccgagcatggtggcaggaggggtggctctctctgagggaggctgagtcttgtttgcctgaaaggatcaatggatgctggagaagaaaagcaatggtgtccataacagtcacctccagaaggggagaggctgggctggggtgggaagagtttagggcagggcttgcaggggccaaggtggccatcctggtgagaaagccccactggccaatccaagaatagggcacgagatgtgagcctgccaagggtactcccaggtctggcatcttggttctttccgctgcgttcttggcacagacactcatgccagggcctttgctgtcacccatagtctcagagtcatgttattattctgcagtcatctgtggggatgggaccgtgcaggactttccctccccagcttcctccctccttcagggtagctcactgtgtcccccgaggcagccagtgctgccgggagaggcccgagactccttctgggtctcagagccatttctatggttgaacccagtgtgtgtccttccctgtagaattggctgccactttgtttcctttagggtccccactgcaccctgtacataaccctgccaggacatctgtttattttccattcttgtagctttatttttatttcaaaaggagtacaagaacacagtctggtggcagagcctccctctgtctcctccttaccttcagccactgggccttgcatcagtaatgctgctcttgtcattctggagcatgccctttcatttctttttctgtgaattttgatacgtacacatagaaatacatagtggtgagttttctagttgtattttttacataaatatcatgctgtatttattttaaagtgtctcaccatgttgcccaggctggacttgaacccctgggctcgagtgatcctcccaccccagctccaagtagctgggacaacagatgtacaccaccacacccagcctttgctgtattgttctgcaacatggttttctttttctttttctttttctttttaattttttgagacaagatctggctctgtcacccaggctggagtgcagtggcgtgatcttggctcactgcaacctccgcttctcggcttcaaactttcttcccagcctcctgggtagctgggactacagattcacaccaccattcctggctaatttttgtattttgtgtagagatggggttttgccttgttgccccgctggtctcgaactcctgagctcaagccatccacctacctcagcctcccaaagttctgggattataggtgtgagccactgcagctggcccaacctgcttttgcttttttaaaaaatctcaacaccatgctatgtattgcacttaattaattgtgcatcgaatccttcacgagccttctgtgccaggtgcgaggtcggctgctgggtggaagtgaccaggatacgtcttccctcggctacacgcagactctccacggtgcaagggcagggcctgcccagccccatgcccagccctttggcatccatccaccagtgttagttagatcagcaggctgtcatgcccaaggcttgctgccatctgaataggacagggtttcagcagtgagctcttgatgtggagtctgcgccacctgttgaccttctttggatttaccttattgaaatgttcacacatttcttttagcttctcaacttatttcatcttgagaaatgggctggaacctcatgccccagcacaacaagccccataaatcagatgttcaagctgagcgatccttccggtttgggccacagtcacggggctttcttactcctctagtcatgtcagcaccgttcagaaactcatccttggcttagagatgatagtgagttacatgtacataaatacaccgagctcattaccctgggccggcatcctgcatgacaagggcccacatccatttctcggcaaaaacaaactacatctgccacttgaaacgtcaagaagcgctttcttgtatgttgtgctccatggatcactggaagtcctttccctcttttcccatgtccgggccaggaggagcagctgctctctggcactgttagcctttgctgccttttatcctaggcaagacactttgttattcctccgatttgtaatcccaagaaccttggagattggacttggagttcgtaacctcctggggagggccaggcctcacatttcaaggcctttgcacgcgtgatgtgccagcaacagctcagccctttgaattatgatccgcgactccctccaatcaccttccttctggatgtcagaaaagactgcccaacagcatctcctcccagctgccgaggctgatgatgtttttattctgatttagatctcacttaggtcttattttaactccactgagctgcaagatcttcactgaagtacaactggacttatttttagaaaaactgctctgttaagaagaccttcgtgcctgatgaagttagttattctgataaattacagcttctacgaagaaaccacacccctctgagtacggatggaagttggaaaattcatagaaagctgtcatttcctggcagaggcctggaaaacctcatttaacagagatgtctttgggttcctgcttaagcccaagcgaaggatcccgatgccccctccccagctgggaagaggagctggtggcgtgagttggcacagagccgcacctttctttctcctcctgtatcctcccgcaagctctgaagaccactctgtttctttgagcaggatcagttgtaactagaagtgggtaggatttgaaaagggctggttaagtgtttaaaactggggcagctttcctgccattttccagttcttttagatgtgcagggatggagaatggctgtttttgttggggttttctctttgatcctggttcagacggggccctctgaaatttctcgccctgatcttttgttctctatgaaaaccaggaattgcacggatggtgtagaaagtccccgtaggtggcaaagcatctctgctgtgttgaaatgacacacttagaaaagtgtcagaaaatggagttgccattgctctggccccccaggacctgtggctcagcctccattgggcctttgtgtctgggccagaccctccaggcaagcccccagtgaggctcttgggcccgtgattgcaggggcgccttgccatcccccgtgtcctgccctggttctgctagtggagcaagaagctgatcagcctttgtgttttcagatttcttctctccgttaaggtaaccttgttctttaaaccagcttgctttcaaagttgttttcctaataatatcaaaagggggaaaaaaagctgcctgaaaatccttttttgggaaagagcctgggcataaataaataaatacaaccatacaaagaagaagattaaaaaaaaaaaaatcaaagatggaactttcgcatttggcctgaggtataaatggcaggcttctgatgacatgcttttagtttttgattctctttctttccttttatgttcttgtaattccaaatcaggaacgatggtgtttttttttttttttttcttttttcttttttttaaaccttgcccaatctttgggtggaggctttggaagccgcacatattccaccattatagttactcaaagctgacgcttcccgaggggtggctgcatgctggcgactgtgccgagggtgtgtgtccctgaatctttgtgatctctctgaggtgtgttaggccccactttacagatggaaactgagacacacagagccgtcaagcagcttgcccaaggtcacacaccttgtcagtggtcaagctgggatccaaaaccagcagcctggctctgggattctaagctctctgttgtgctgctccttgaatatattaaaaggcctactatgtgcaggaactgggttggcactggcaggaaggcaagttcgggaaggagatagttacatggctgtgtggcttcagctggggagaggggaacacccaggagggcttcttggaggaggcggccagtaagatgaggttgaagataggtaggatttagtagggcacagtgaggtgcaagatcaggtagaactggctttagtcctgactctggggcttcacatctaacagcacaggaccagccactccctcacagacttgtttatttattattattgttattatttttgagacagacggagtctcgctgtgttgcccaggctggagtgaagtggcacaaccttagctcactgcaacctccacctcccaggttcaagcaattctcatgcctcagccgcccaagtagctgggattgcaggcgcccactgccacgcctgactaatgtttgtatttttagtagagacagggtttcatcatgttggtcaggctggtctcgaagtcctgacctcaggtgatttgcccaccttggcctcccagagtgctggaattacaggtttgagccaccgtgcccggcctccctcagacttgttaggagacaaggtgaatggctggcatggaagatgccctgcacatagtaggtgctcaggaaacgttagtggtgctctccccctttccaatggacagtcagcaatatgggttggacaagtatgttctgtaatccgaggttgtgtgccctctggctggcccacaaaatttgaattaatggctcgtatttataaatggggagattccacaccaaaccccacatttccagcttttcttgaaaactcagatctggtgactgcagcctgcacttcccactctgccatcccgggctgagcgaggagtgcccgtctccagagacagtgtgccaaggggccctcctcctatcaaatgccctcctgtctctctcttcctacctggccccccgtgcaggccacagagcgtggtgctgcaggtgaactctgctgcggtgggaacgagttggcatcgactccctcgtggctggctgctgggtttcgtgtggacagagacattcatcttagaacaatgcagacacttaggaaaacaagcacaaggcggtctttttcccttaatcacccatctcatgaaatcaagccccagtcccttggaagctcacaccctccacaccctccagacactgagagaatgcatgccagcatgcctgtgccagcgcgcctgtgccagcacacccgggccagcacacccgggccagcagatctttctctgtgactgaagacagccggcacttcacatctttgaagggtttgtctttctggcaagtagaccggtactttaaaaaccaaaacattcctgggattcactgaaagccagtaaactggcaccgttcaggtggcgggggggtcgggggaggggggaagccaagggtgtgagaggagcccctccttccaaaaatcacaccgatcctctgaaggtgacgatcagatccaggctgcaagttcttctgcaaaggagctgtgtccataagggaacccaggctgcaaaatatagcaaggcccagaagggcatccctcaaaccttcatggggttcagctttggacatgctggctgtggtttgtctccactgcactctgcaaagagccccgaaggccctttccttagcctggccatatttcaaggccagttcaattgctgcctcctccaggaagccctccatgcttctctgtggaataggggacctcgcctgccttgtggtcactcttcctccagtctgtgtctctcttggagcctaatcacagagaccctgtacatccacagctgcctctcccacttgcagggagtagtttgtgggccatgtgtgggtgctcacggttccccttattcctcaggaaatgtgaggaagttcctgtgaggccggtattcccaccaccccatgttacagatggggaaactgaggcttagtgcggtgaggggacttccccgaagccacacaccaacaagtggcaatgcgagatttggactggggctctgtggccacaggcctgggctcctcctgccaaccgaggggtctgccagcctgtgcccccctcctcctggtccccgaagcctttgcttccctcaggccatcgtgcataaccagccccttcagaatgcgctgctgagcagtccctgggcggtgttcgtgagcacgtttctcatttattaaggtcacaaaatccctggccctgtttagtgtcatctttgatgttcaagggcggtgtggaaatctctgttttgatatgacccaatttctaggctttcaaaatgtggcttctctcctcctccctctctgtgtttttgaaatcaggtgagcagggctgcctcgaagcgttgaccacttgccccgaggtctccctccccacccctcaggcccaggcacatgggtgcagtgccagctctcgggccttgccaagaggactctcgggcgtagcccacctgtgtaatcctccacacatagggaaactgggtcttttgttcttcctctgccatcagcgtgagcactgcaggcagctgtgctggacgggacctccctgcccctgttgtgtcctcctatgatgccagccaggacatggaacttccaccccgaccccctgtgctccagggctatcatattcccaaggatttctgtgaaaaatcacttttccctgtttcctttctgccttttaagactctctgctggttacaactctctttgtaactcgtcatgtggtacaaatacttgctgaaatttggtccctgttttctcagctgatctgggtgacctgtgggggttcttctggattatttttagagaggtggggcagagggagtctcaaaactctatgtctgtatcatttccctgtgaaggtatttaacatttgtccactgctggtgtagcgttatgctaaggattttggaaattcaaggatgagtggtgcctggatcttcccttaggatgctggctgtgggtggaggacagtgtgtgcggcagccaggctggctcgcggctggaatgtgggttacctggagagggcctgctttttttttttttttttttttgctatttaaaaaaattgttgtaaaataggcataacgtaaactttaccatcttagccattttcaagagcagagttcactggtattaagtacgttctcattgtgcagccatcaccaccacccacccacagaactctttcatctttccaaaccgaaactctgccatcattcaacactacctctctatttgctacttcccccgcccctggcatccaccagactgctttctcctctatgcattcgcctactcgagggacctcctactggtggaattgtacagtgtttgactttctgtgtctggcttatttcactgagcagaacattctcaaggttcacccatgcggtagcctggtccgaatgtccttcctttttagggctagataatattccgttgtatacgtggactaccttttgcttactcattcatctggtgttctcaaatgccaagactcagtgactgcagcagtgcccgaaggttccctcgaatcaaagaacttcctaaccccaacctgtacctaggctctgatactcctgcatcaggcagtcctctaggataaggtgcctgtttaaaatgcaaatatattaccttcgggggagtgggtaactggcatcctggggccccgctgccattgtccttatgagggagggaggttgtgttgtcctggaagtcgggtccacggtcacgtcctgagagtcccatcacgtgccatgctctgggctggggacttgatgttcattgtttggttacatttagcccttccaaagaccctggcatttttgcagtgttacctataaattccatgtgcggaaacatgggttatttccactcttttttttgagatggagtctcgctctgtcaccaggctggagtgcactggtgtgatcttggctcactgcaacctccgcctcctgggttcaagcaattctcccacctcagcctcctgagtagctgggactacaggcgcacgccaccacgcccagctaatttttgtatttttagtagagacaaggttccaccatgttggccaggatggtctcgatctcttgacctcgtgatccacctgcctcagcctcccaaagtgctgggattacaggtgtgagccaccgcacccgacctgggttatttctacttttgggctattttgagtcctgcagctatgaaaatgggaataaaagagggtccgctttttaagaagctgaatatcggcctttgctgacatgagaggagctggcatccttgggccctgctgccattgtccttatgaaggatggaggttgtgtcgtcctgaaggctgggtccacagacgtgtcccaagagcccatcatgtgccatgctctggactggacgctcaacattcatggttacattcagcccttccaaaggccctggcatttttacagtgttacctataaatgccatatggagaaataggtgcagagaggtgagtgggatgtacctggggtctcacggccagcatgagtggggccctgttggcctgctgctccaaagccatcatgccacacccccttgctgttccatcatctgccgctgtggaggctggatgtccagagctagaggtgttcaaggttcaaggtgattctggtgttaaaagaggaaataccattttacttctgaacctgtttcatggagaaagaggtacagctccgggcacactggcctgggtacctttgcagcatgtgatcagggactgctccccagcggccctccaccagtgccatgaaagtggccagggccctacctgcacccggcaccatggatgcatcttggggctggaacctcgagtcttacatgcagcagaggctgaggctgtgactgtggagaaagcgtgacattacagaagcaagggttttggcacctggtgtctgtgtgggtgggtattcctccctggtggatgtggctgaaaggcctgcagggtctcactggtgcagggagatgaggggtcatttctggttctgggattgtccctaatcactgggcgttccagatcctgtaactgttcagcactcccttgagacaggaggtcatggtgtttctgacttggagcctctggctctctttattagattctgttgcatgttccagccatcctgacccgggtgttccatcagatttctgtgcctgtgaatgtggccatcaccagtgaccccactttaaactccagattcacctgtatgcatgaccggagggggttagcatcttgagtccgtggttcaggacgcagccccccggcagagggaaggcagccccactctctcatgccccatcgctgtggtccatgctttgtctgcctcagcagtcttggtcagatctggaagcatctggaggcatctggaagctttggtgtcttagttatgagtttcaaagggcagtgaaaacagactggcagagctcagcgagacctgggaaatatttggggtggggaggaactgcagaatgtattcttggttcagagcatttttccctctgactctttctgggcaacagaccttttaggaatgtttgttaaatgctgaaaaaaacaggaattgatttctctctgcgtccacagccaacatgtgaggccacggcactccgtgtatactaacctggtttttctttccttttgctcaacagtgagtgacctgcaggaagaaggcaagaatgccatcaactcaccgatgtcccccgccctggtggatgttcaccctgaagacacccagcttggtacgggggttcctccgctccctgccctgagacagttgagcttccgtggcactaagttggtcttggggaggccaatgaggagcccgatagatctggcctcttgatcagatgctgggggcatttgggagtctaagttcttagctcaaggtcatctttagaaaagtccattgggaaaagcaagtccttcattaagggtttctgccctagtcttaaaacgtaagttttatttttcaggtggtgaagcaaacagattgggagaagactgacttgaaaagatagtttgttaaactcatagttctgaaaggaggtgtagcaggccactcagggccatgccatgccacgccatgccacgccacgccacaccatgccaagccacgccacaccatagcacaccatgccacagaaggccacatggaaagcactagtgtgaggcagaggcagaaggagcagggctaatgcctttatttgatattttatgtatatattttttgagatagagtctcactctgttacccaagctggggtgcggtgatatgatcacagctcatggcagcctttaccgtccaggttcaagtgatcctcctgccttagcctcctgagtagctgggactacaggcatgtgccaccccgcccacctaactttttaatttatttgtagagatggggtcttgccatgttgctcagactggtctccaactcctgggctcaagcagttctcctgcctcggtttcccaaagtgcagggactacagatatgagccactgcgcctggccccaacacccttactgtggctttctctgaaggaatgggcaaggctgggtgaacaggcctaggcctggcttgttggaatcgtttcactgggctttgcggtgcaggagctgtcctgagtcttctcagtaagaagactcttcttcttccacaccacgtggcgtggcgtggtatggtgtggcgtggcgtggcatgtccccagggccaggggagattagggtgaggatattggctgggagtgtaggagccccgtgagagcccaaggaaagaggtggctggggactctgggctctgcggctcaggctctgagtggttttcatatgaaaggtgtgctcacagagggtggtttaccatctctaggaattagcttgccctggaggtgcaatctctccagagtcagcaaggccccgagatgccaagcaccagaaaatacagaaaacagggcgggcacggtggctcacacctgtaatcccagcactttggaaggccaaagtggacggatcacttgagttcaggagtttgagatcagcctggccaacatggcgaaaccgcgtctctcctaagaatacaaaaattagccgagtgtggctagcctgtaattccagctactctggaggctgaggcaggagaatcgcttgaacccgggattgggatgttgcagtgagccgagatcgcaccactgcactccaacctgggtgacagagcgagacatctcaaagtaaaaaaaaaaaaaagaaaaaaagaaaatgcaaaacacaattaatatgcttcttccctttgggccagccagagctgcccgcggcctgggcttgcagggtgggctctgccaagtggcccaggcccctgcgctcactgcctgatgtaatgggtaacagccaagacacattttccttaaagtgtgttttgggatctagctgatctggaaggcatttatggaacattctgcgtatttccaaaccctggttcgaagggaagtcccggttcatcccttttttgtggtttccgtgacgaggccaggccagcaagagcttatggagaagaaacgccgatgcaagttcagccgccaaccgacccgaagccagagctggtgatgctgcctgaggtcgcaccagggtccacggggctttctctccctccgcttagaagagagtggccccaccaggctcggtggctcaggcctgtaatctcggcactttgggaggctgtggcaggtggatcacctgacgtcaggagttcgaaaccagcctggccaacatggcaaaaccctgtctctactaaaaaatacaaaaattggctgagtgtggtggcaaacacctgaaatccccgctacctgggaggctaagtcaggagaatcgcttgaatccaggaggcggaggttgcagtgagccgaggttgcaccactgcgctccagcctgggcaacaagaatgaaactccatctcataaaataataaaataaaataattagccaggcatggtggcacacgcctatagtcccagctactcaggaggctgaggtgggaggattgcctgagtctgaagaagttgaggctacagtgagccaagatcacaccactgcactctagcctgggtaacagagtgagaccttgtctcaaaaaataataataattgaactcactcactgaatatttgcacagcacctgattctttctgaagtcctctttgtatatttcatatcctttgggctcataaatgtcatcattgtagcgaatattgggggtccactgtgaatgcttctactcctcagtcccttcagtgaccctgtgaggtgggttgtatcattatccccattgtacagatggggaagctgaggcacagatctaagatcacagagatcactagtaagtgccaaagtcttgaaccccgggcattttgcccccagagctaggctcctccccctgctctagaccctctcagtgaagatggtggccctcatcagaggtgagtaggacaggtccctgtccttgggcacgttttattgcagctggctatgacgcacaaggtggggagggcgggggctcggttcccacaaaacactggcacagagataccaccctggcctctgggcactgcttctcctctgactgaagtggagagaaacctgaaccaggcccacctagcctgtgtggacccagacctgctgaagattctgagcccatgtctgaccccccggcaccccctggatggagcagcgcttgctgtacccactgtggtgtcccgggactgtgggctcctcgaggggtcctgcctcagtcttggagccaccgagaggagcatggcacagtttagcgaccactaaagtcacacagctcagagatggcatggcggctggtgtctgctctcagcttccttttaggaaaaacaaggagcctctcacagcccttttcttctctcccagagtccctggagtcctgttcctcaatgcaggatgtcagaaagtcccagggcacttggcagtgagggttcctggccacccgaagacctaccaaatgggagtatgcgggcccaggcccctctgctttaaacatgcctgcagtgactccggggcccactgaggtttgggaattgctcccctctaggccgcgtgagcagcccgtagcagactgagggccatgatgtgcagtggcctgcgggggtttcatgtccagggtccccggtcaaggctagcaggtcatgaatgctgacaggcagcaagggctgactgtgagctctggagcccccagatacagaggtgtttctcatctggagcaagcgcctgctctgaatcaggcccctgccccgtgagacgcagctgctccctggtctgtgcagagcctctgattctggcctactgtcaccatcaccaggtgaccaggagatcccggcgggatctgcagacatggacacactgccacacatagctgcctgcctggggcctgctgtccaccctctcaggcccactgttcccctctaggcggggtcaggaatgaaagctaccccacggggacaggtaaagaccggagatgcctctgagaaagtgtttggtaacagtaagcctcgaaacggcatctctgtcctccacctttcacagtctctgggtcagacgccccattcctctcagtggtcccgccgactgaggcaggacccctcaagaagcacacagtcctgggacatccgagccaccatggcatgctgcccagtctggggtcagacgtgggctcagagccttcaggagggagcagcgagttccctgtgggggccacatgagctgggcgggcccgaatcttgcttctcctcagttcagcgagagcaaggtgtggggacatgctagatagggcaatgctgagatttttagtgtgggttgaaggggatgtttccagaaacgggctctctgaaggctgggattgggtagtgacctgctcactctccgtcctgcaccccctctcatacacgtgtggactcacggcctggccctgctccttgcccgcctgagatgggtggtccagagggggtctcagacatgggtcacacaggcacacaaagtcctctttggggctggagagcttggaagatttggcattcgggctcaaggatctcagctggggagctgaggtctgaagggtgaaggaaacatgggccagggagagagtgtcagacagcgggagcaggtgccaaggctcagggcaggtggcagcaaggcttcaaggagtgagggaaggccggatgggctggagcagattgcaccaggagggcaggaaatgaggcgggagaggggccttggaggccacatggaggacgccggccttgatcccagcaggagtgggaggctgcggaggcctttgcagagatatcatcaggactcccgagaactccctgcacattacctggagtgtccttttcaggcatcagatctgtatgacttcaaaattagtttctccatgttgtcagagtttacactctgctgccgggaagttgcatcacatccgtgtcagcagcaaagtttcactcaaagccattttctttctttcttttgtattttattttattttattattttatttatttttaaaaatagagacagggatttcactatgtagcccaggttggtctggaactcctgggctcaagcaatcctcccgcctcagcctcccaaagtgctgggattgtaggcaggagccacttacgctcagcttcaaagctgttttcattctgaccgacatggtcagtgtccccagccccatgggagcctgtctgggctctgggaccctggtctcaactgtgtcctggccatctccacttgtatgtcctgggggtaactggcttctgcctggagcccctcttgtgccttttttcctctttaagagagaggtgtggtatagagcctcccggtgagtggagcctgggccccacccgacccatgctctgtgcaggtcccggagctggacagtgtggcagcctgagacccccttgcccttccctgtgtgtgttcagaggtgctcggcgcccgctggcttctgtgtggtgctgggcatttctgctgtggagcacgcctagccttggtgggtgccccctccgcagtcccgcctccccactgtctccacggcactgtcctccatgacgggctcagctggctgcctggtgtctgtgggatccaggctgaaacgtggagggaaagcaaacaggtagagaaatagaaagagggtgaggctgaacacgttttgctgttacacatcatccccccccacctttttttttgctatttatttctcaatattttttctgcatgttattttacatacaacattgcatattgattcttttccatggaatgtaccaaacattttccatttcattataaccatccagactcttcaaatgtatttataaatagtggccacagggaactacctggtgcctgaagctttcccacataccagattccggccagcggaggcatctcatgccctgtgaatgctgctctctccttatttctcctgaaaaatggaaatggtttggaccagctgctggcggagtctgggaggagcgaggccgggcagaatgatgagtttgacttcatccctttccagaagaggggaaggcgggaggatgccccatccaccttccagaaggcggttccttgcagtcaccctcccctagtgctgggttctctgcttctccatttgtcagagatgagttggcctccccctggttccccgtgtccctgccacccccacaatcgctgaccgtgacttccttttgtccctggcagaggagaacgaggagcgcacgatgattgaccccacttccaaggaagaccccaagttcaaggaactggtcaaggtaaggagctccgtcttggttggaatcttcctcttagggcgaggacttggctttggggttcagggctctcatggacaaagggagctaaacccggggctcctgaaagggatgttggtgctgcatgagaaggtgggcagacatgttggcagaggaggacggcagagaggatccagcccgaagtgccaagcgcctcccatgtgccctgctcggctggggctttaacgaccagtcttgtgaactctttgctggacagagctcggcaggaggggattttaggattaggaatgagtgctggcgtgagctagtgtagtaccttacagatggagttggaactccgtctggagcctggtggggtctagattcagatttaaccctgaaaagcaggaggggtcaccctggccactcctggccaggagccatctgatgccgatgcctgcgctgagtggacagtcagtttccaccacgtctggaggcgtgaatcccagctgggcgaggaacctggctgccccgctcccagaagtcagggaacagtgagggaaggggcccatggtgctggccttcttgggcagcggctgtccttctccagcgtggctcctgctcaccgtgaggcagtgcttgtgtgggtccaaggacagattgcagttttggttgctctgatcgaaaccacggtagggcttgagagagaatcccctgaagaggagaggctgtgggctctgcctgaccttggtgaacccagggtgggctcttgggcacacggctgtggcagacacttggcttccatagcccacggcgagcttgggcaccccgggattcttgaaaatgccgatggtgacagtgtctgccagaaacagacatttttctattaaaagtgctttttaaaaagcttctccaccttcaccaccacagtggacccaatgctgggctgtacaactgtgttttcatgagggctcattcagaataagtaagacggcttgcaagttatgttcttttaaaatctacattgaggctgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgaggtggcgggcacctgtagtcccagctactcaaaaggctgaggcaggagaatggcatgaaccccggggggcggagcctgcagtgagccgagatcgcgccactgcactccaacctgggcgacagcgaggctccgtctcaaaaaaaaataaaaaataaaaaataaaatataaaataaaataaaataaaatctacattgagaccgggcgcagtggctcatgcctgtaatcccagtactttgggaggccaaggcaggtggatcacctgaggtgaggagttcgagaccagcctggtcaacatggtgaaaccctgtctctactaaaaatacaaaaaatttgccgggcatggtggtgggtgcctataatcctacctactcgggaggctgaggcagaattgcttgaacctgagaggcagatgttgcgttgagccgagatctcgccactgcactccagcctgggcaccaagagtaaaactccatctcacagaaaaaaaaaaaaaagaaattccaaatgtcagttttagggtccacccaaagatgttgattattaataacttaaattatttaatttgttttattttttccctctgaatacccactttgttatttcaaacagaagaacgttgatgaggaaagtcactgtcttttagccacgaaaatgttgttcttgggggatatttaagcaagggatgcatgagaattatcaggcttctacaaagaaacagacccaattgtgtcaatatctagagagaggtttattatgatattggctcacttgactacggaggctgagaagtcccccgacctgccatctgcaagctagaaagctggagggccagtggtagagatgccagcctgcgtctgcagccctgagtaccgggaacagggtgggagaagatccaggtgctggcactagcagtccccggcagagagaggtgaatcccaacttcctccacctttttgttctatgggatcagatgaggcccacccgctttggggagggctgtctgctttactctatccaccaattcaaatgctcatctcctctgaacaccattccagacacacccagaaacaatgtttcattggctatctgggcaccccagagcccaggcaagttgacacagaagatgaaccatcccatgcacctttctaaagatttttttctttgatttttgagcaatgcttgagagttcacaaactccattcacaggattatctccttgaaacaacaccctggggagctgtgtcattcttgcttccatgtggagactcagagagaggtgaaggggctgggcgccatggctcacacctgaaatcccagcgccctgggaggccaaggttggggggaatcacttgagcccaggagttcaagaccagcctgggcaacatggtgaaaccctgtctctaccaaaaaaaaaaaaattaactgggtgtggtgggaggcacctgtaatcctagctatgcaggaggctgaggtgggaggattgcttgagccccggaggtcaagggtgcaatgagctaagattatgcctgtgaatagccactgcactctagcctgggtgacagagcaagaccctgtctcaaaaaaaaagacaggtttaagtaactccccacccccaggtgctggggttagtgatgtgtctgggcttgaatggctctgtccatttggtgctgtgttcactgagccaagttgagtgcgtgtggggtcctgtgctgggccctgggattcggggatggataagtgacttccctgctatgcaggatttgatttatgttcctcctggatgtctgcagtgccacccacccctgcctttgctgctttgctgccaaagacccccaggctgttttggccttggtggggcgagggctggctgctgcatgtcttccaggtttcagattgagaagaaggccacattgaggggcatggggtggactgatgggaaagctaattagcatcctttggggcaaagtacaactatggggcaaaatacaactaagaacaggaaggagctgaggaataaatgcctctccccgacttccctgatgtgggcttctgagaccatggctcatggagatgggctgcatggctgatcatcagctgggttttcttctgaagccatagccagctcatgcacctgcctcacctcccttcccctccctgttgctcgtctagggtgccctcccctcacccccaaacccctgccaaagaaaaggcatcagcagtgagctttgtcctggctctgtttttcagggaacctgggccagaatcatggtccccaaagatgaccatgtgataatccctggagccattgactatcatcttacatggcaaagggacatggtgggtgtagttagtgaccttgcaatgaggaggtcatcctggatgatccaggcgggcccagtgtgttcgctagtgtctgtataagagggacatggggagctttgactgcccatgaacatggcagcttgaccctggaggcaaggtggtagcttctggctctgaagatggaagaaggggccatgcactaatggatgcaggcggcctctgcctctagaagtggaaaagacaaagaaatggattctccactagagaacccagaaggaaccctggagcctccagaaggaaccagccctgctgacacctggattttagcccagtggaacagattttggactttgacctctaggactgcaagagaatccactgagccgttggaagcccctgggtttgtgttaatttgttacagtagccacaagcaactaacaccatcctgttctccaggctgctgcctccagctgcagctggcgtgccctggccactggggccaggcagggtgggttttgatacctgcagcggcagcatccttggccatttcctggaagggccagttgccagacactgagatgcctgttactgcaactgtcccaccagcctggagcacgtgtttctggagacaggcaaattctggaaggctccacctgctctcagactgcaggttgcgtctcaaagcaggctggcagacattttccactcttgatcaatcattttccaaaataagcatagacacagcaacccggagagcagcttcggtttggctgtcggtggcgtgttagttactgtagtggtggcacagaggcgatatacgttaaatattagttctcactgactatagccttttaaacagagcagcgtgtgggtggcagcaggtgagttggctatactgagcttgggctgcccttggttgattcttgtttgtcaggcatgcagggggctctctgtgcgtccaggcatattccctgtctggatttgcttgtgttcatggattttcagcacctcctttcttctggtttgggaatgagtcaggtcctcactacacaaggccagagcagtatgcgtgtgtgggtaggggtgagcaggtgtcattccctgcctcccctcctccttcactgccccagccaccctgaccaccttgctgttctgaggacacactgagccagtgcccactgggcatcaggtgaaaggggacatcccacaagcccaccctcacttctgacaccaatggcaagttcaggatctccaacactgccctgaggtttggtcatttgctagagggactcccagaacccacttaaagctgtcaccctcacagttacagtttctgatggtgaagggatacacatgaaaatcagccgagggaagagttgcccagggcagagttgaacgcacccacacagcacctccattgtcctttcaccatggggtcataggcagcgttactctcccggtgatgtgggacaatgcgcatgcagtattgccagccggggaggtcatctgagcctccgtgtccagagtttctgctggagctcacttgcatgggtgtggctgactgtccacatggctcatctgtctccagcccctccagcagctggctgatagagtgcaacccaaagccccctccctgaatgacatagttactccctggctggcccgagggccccaggtaagcagaggtactttatctggcagggcatttcggagcttaggagatcacctcccaggggctgaggtcacaggcccaacctctctgtgggcaaggttaggttcattatcacgtacctggtctttggactttcaaaggcccatgcctggagctgtcttcaacacttctttcagttttctctcaatgcttcctccttggagacgtatttcctgcccctgtcactccatcactctcctcctaaccccagttactttttctttgctgggcttgctgctgcctggagtcatttcctatttactagtttgtttttggtctttctcctcccctagaatgtaatcttatgctgtgagggaccatgaccattctcttcccagctaaatccccagggctggagttgtgctgcacatgcagagctaattcatccttgatagatagtaagagaaccgatgggggtctgtgtcagcagcaccaacatgaggttcacaccagcgtctcccaagatggcatgcggcttagagacaagacagatgtggttgctttttgttgttgttgttttgtgttgttgttttgagatagggtcttactctatcactctatcacccaggctggagtgcagtggcatgatctcagcttactgcaacctctgcctcccaggctcaagtgagtctcctgcctcagcctcccaagtaaatgggattataggtatgcaccatgatgcccggctaattttttgtatttttagtagagagggggcttcaccatgttggccaggctggtctcaaactcctgacctcaagtgatctgcctgtcttggcctcccaaagagctgggcttacaggcgtgagccattgcatgcccagccagatgtgtttttttttttttttttttttttttttgctctaccccaaacctgtgagatggcagggaggaggctctgggaagagggggtgagggttggggtaaacctgtggattggatgctgatgtaggtggtcccaggtgctcccttgggaggagatggacagtccggatggtgcagacaaaacacctccatccacattacctgcgtaattctctttgctttccagaacatcctttgtgtactgtggactgtgatgatctaatgctagtggattacatctaagtaggccttagtagaagccacctcccagtggttcctcggaggcatttggtccagaagcagatgattttagtgcaaagcacagaccgtatgcaggcctgagcagatcaggggacagacagatctggctgacatcctgatccgctggctgtggtggtgtggccattgcttgtagccacattgcagtcttgaatgtcccccttggaaatgggggacatttccaaggatgcctgcctggtcctctagttttctctttctctgttctctgtcatctgcacttttttcctcttgtcttgattgcttgtcctgtctcccctagtagacaccccctctgacctctgctgcctcaggactgttgctgtataaaatattgtgagatgccctctgctcctgtttaaaaaaaaaaaaaatccttagctctgggtaagctaggcactgagaatgaggccagtcattcaaaacttgtctctgagcattgattatactcatgtattatactgttaaggggtgaaggtcggctctagggtcagcttcctggatttaaatcccaactcagattaaagtgggagaataatagcaccaacgtgacaacctcaaagtgtcatttgtaaggataatgttagatcatacacttgatcacccgttagcagtgtaagggcagtgtgggaacatgagcatgaacagggcagcccagaagggagttgaatggacagatgggcaatgccagtttggaagtgggtgcatgcatccggtgggttcaggagcctggaagacttatccaaaagtcatctttgctggtgtttcttcctgtgtattttctctaaccttctccagcagtgacctgaattacttatgggtgaacactgaatgctgcccaggcaactagaggtttatagatgagatactttaaatttttaatgattcttaaaagagggagtggctattcttatgctttccagaatgaatagccaagggaaacctgtacagttgccatataaggagaaacctagacctggccttagcctctaggtcctggtgcagattcttagcacgtagcgcctaaaacctttgcgatttcctgagtgataggagcgtcttttgttattcataatgagatctgggtttatgctaacgaggtgactcagggtgggggctggccccagagtaaccaacacaggattagagggttgggtctatcagtcctacccacccccagcctctgggtggggtggagaggggctggagagtgaatcaaatcaccaatagccaatgatgtaatcagtcacacttacataatgaatcctccgcaaaacccatcaacagtggggttcagagagctttggcgctgggaaacacacatggaggtgctggagggggacacgcagggagagggcatggaagccccgcctccctccccgaaaactctgtcctgtgcagtgtttcttattaattacactgtccctgagttctttttttttttttgagacggagtctcacactgtcggccaggctacagtgcagtggtgcaatctcagctcactgcaacctctgcctcccgggttcaagcgattctcctgcctcagcctcccaagtagctgggattacaggcgcccgccactacgcccagctaattttttgtattttagtagagatggggtttgaccatattgccctggctggttgcgaactcctgagctcaggcaatctgcctgcctcagcctcccaaagtactgggattacaggcatgagccaccaccacgcctggcctgctgtgcctgagttctaacctttatagtaagttggtaatcctcagtaaaatgcttttctgagctctgtgtgttctgccaaatcactgaacctgaggtgagggccctgatttgtaatcagtgggaagaggctcaagtagcctgggagccccatctgcagctggtgtctggaatgaagtcaatttggtgggactgagccctcagcctgtggggtcaactgtagctagtgttagaatcagactgaactctaggacaccccattggtatcagataatcagagaattgctgttggaattttcatgtgcgtccgtgtgaagagaccaccaaacaggctttgtgtgagcaacatggctgtttatttcacctgggtgcaggcgggctgagtccgaaaagacagtcagcgaagggagataggggtggggccgttttataggatttgggaaggtaatggaaaattacagtcaaagggggttgttctctggtgggcaggggtggatctcacaaagtacattctcaagggtggggagaattacaaagaaccttcttaagggtgggggagattacaaagtatattgatcagttagggtggggcaggaacaaatcacaatgctggaatgtcatcagttaaggctgtttttacttcttttgtggatcttcagttaatttaggccatctggatgtatacgtgcaagtcacaggggatgcgatggcctggcctgggctcagaggcctgacaggaatgacacgttgggtgtcagaaaaaaaacacagaaaactccctaagcagattggttgaaagcaggctgactgcatgtcatctgggggtgcgtctccccccaagagcaggtttcacatctcattccccggttgattggacaagacccttcctgtctttaagttctgttttcttcctccctttgtctctccgaagaaaatcagctgcatgaaaacgatcctctgggcagaaattggtgctgttggagccgcacagaggtgccctcccgtgccccctggcccccaccgggccgtgtctcctcctgcctgttgcaatcagccctcgtccgactctttttggaagtgattaaaacataactgtcatagctctgggggagacaggctgcagatcctgattataattcagaaggatctaaagaaaaagtaattttttaaaaaaattctggttaaagccaaagctcataagacgtgtgtgatggagtggtatgcaagagcacaattaatgtatgtcctagacatctgcccacaggattcagggctggcaaatgagtgcgtccctaaaaataatgactagtgctatctttaaaaagtcttttgtggcatagcagattaagatggatggcctgggaagtacagtggcagcgtgtgctgtggtatccaggaataagttgtacctcctcggggtggcagtggaactgggccgtgaacagcttttgcttcccagagaggactgccatggcctgctgcatggaatttgattttaatctgtttgttatttttgggtttggtcttggactgggtttgaaatccagatgtgacttttttttttcttttttcagttttctttatagcagcaatgttgtatcttgtgtgtttcctaacaagactgagctctgagcaaggcagcctctggaaccaaatgtctgcaggcccaggagacctttctagaaagttcataggtgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaagaaagttcataggcggttctgcagtttgagccccttctgtgggtctgtgcctgctttagccgcttgagatatggcattgaacaaaacacaggccccgcctgggagaagctgccaggccagctggggagacagacctgataagtgaaaatgagatcgcgtggcctgcatgctccgaagaagactaaggcaggaaacaggactattttctcccgactgaattgtcctggtatccttgttaatatcagttgactgtgacttgagacttatcttggacacccctttctgttccgtgggtctgtgtctgccttgatgtcagtcccacagtttcgacgactggagctttgtagtcaggtgtgaaacagtggagtgtgggtcctccagttttgttcatctttttcagattgttttggcaatccaggagtcctttgaatttacatatgcattttattttattttaattattaatattattattattttttagatggagtcttgctctgttgctggagtgcactggtgcaatctcggctcactgcaacctctgcctcccaggttccagagattctcctgcctcagcctctcgagtagctggaattacaggcatgcaccaccatgcccagctaatttttgtattttcagtagagacagggtttcaccatgttggccaggctggtctcaatctcctgaccttaagtgatccaccagcctcggcctcccagagtgctgggattacaggcgtgagccattgcgcccggcctatatatgcatttaagacctgcttgtcaagttctttagaagccatctggatagtgattaatttgtaaaaatgatacttattatctttttgaactgccaaagtaatatatgctgctgaaaacctggaagacagaaaaatccaatagaaggcagggctaattttttttttttttccatgtatgtcccttcaggcttctctgtgtttttcatttttcctacacaaatttggaatcattccagagctagtaagcatctagggccacatttggactagtaccttgggataaattagagctggaattgccgggtcatatagtgtgcacagggctagggactgacttattttcctttctgaatgaagactctgaggtctagagaggttaaatgagtgactcaaggtcacacagctaaaactctggtggagctgggtcttaatgcagaccctacatattcatgccatgctgtatttatacaggcatgtacaccagcgggtcgggattttagggggtgttttaaaattctgcctgcaaaacctttttttttttttttttttttttttttttttttttgagacagggtcttgctctgttgcccaggctggagtgcagtgtcaccatcacagctcactgcagcttcctcccaggctcaagcaatcctcctgcctcagacccctgagtagctgggactacaggtgtgcactgccccacctggctaatttttaattttttttgtagagatggggtctcattttgttgcccagggtagtctcaaactcctgggctcaaacactcatcctgcatcagcctcccaaagtgctaggattgcaggtgtgagccgctgccccaggcaaacccattttaaagccatgagccaaaaattataaaagacatgcaaaatattatgagtagtcacttatctagtatttgcggcatctctcaggcttggggctttgctgggagctctgagggggtggaagaggctctgtcactggccttacctggctgtcaagggctgagtgtttggtggagggaagacgtctgcagcctgggaggctgcgggtcagaaggaggtcagccggggagctgggaggatcgtggggaacccgtggtggaaatcagcatggcgagagagtggaagcaggcagaggagggctttgaagaccaaaaagggtagttaggattgctgctctgtgtgtctgtaaacttggtgttgtctctcgaatttaaatgacatgctttgaaaacaaaaaaacaaacaaaaaccaaacccataaaatctcactaagtggccagagcaagttcccggggggtggcgcatagatgcagcggtctgggttctgtggctgggggagttggcttggggtccgtggctgggtcagtcttcaagagccaccctgggtggcactccaggtctcttggtctggggggaataccctgaccccagcggtttcacggcctcctccccactcagcctgggggagagtccagggtcggccctgtccccctccccccactcctgtcactatcagtcccctgtgctcagcttactggcagggttcctcctggctgtcccctctgcctccagcgctctttcctcaggtgtccacgcagctcgtcctcacccttttctgtctctgctcagatgccgcctgaggctcccaaaacagggtctcactctgtcacccagggtggagtgcagtggtgcaatcacagctcactgcatccttgacctcccaggctcaagcgatcctcctgccagcgagcttgttacaattcctgcaccaacacggatacattgttactaactaaggccctacaccagcaaagatacattgttactaagtaaggccctgcaccaacacagatacattgttactaagtaaggccctgcaccaacacagatacattgttactaactaaggccctgcaccaacacagatacgttgttactaagtaaggccctgcaccaacacagatacgttgttactaaataaggccctgtaccaacacagatacattgttactaactaaggccctgcaccaacacagatacgttgttactaagtaaggccctgcaccaacacagatacattgttactaactaaggccctgcaccagcacagatacattgttactaaggccctacaccagcacagatacattgttactaaggccctgcaccaacacagatacgttgttactaagtaaggccctgcaccaacacagatacattgttactaagtaaggccctgcaccagcacagatacattgttactaaggccctacaccagcacagatacattgttactaactaaggccctgcaccaacacagatacgttgttactaagtaaggccctgcaccaacacagatacattgttactaactaaggccctgcaccaacacagatacattgttactaaggccctgcaccaacacagatacattgttactaactaaggccctgcaccaacacagatacgttgttactaagtaaggccctgcaccaacacagatacattgttactaaataaggccctgtaccaacacagatacattgttactaactaaggccctgcaccaacacagatacgttgttactaagtaaggccctgtaccaacacagatacattgttactaactaaggccctgcaccaacacagatacgttgttactaagtaaggccctgcaccaacacagatacattgttactaactaaggccctgcaccaacacagatacattgttactaaggccctgcaccaacacagatacattgttactaagtaaggccctgcaccaacacagatacattgttactaactaaggccctgcaccaacacaaatacgttcttactaagtaaggccctgcaccaacacagatacattgttactaactaaggccctgtaccaacacagatacgttgttactaagtaaggccctgcaccaacacagatacattgttactaaggccctgcaccaacacagatacattgttactaagtaaggccctgcaccaacacagatacattgttactaactaaggccctgcaccagcacagatatattgttactaaggccctgcaccaacacagatacattgttactaactaaggccctgcaccaacacagatatgttgttactaaggccctgcaccaacacagatacattgttactaagtaaggccctgcaccaacacagatacattgttactaactaaggccctgcaccaacacagatacgttgttactaagtatggccctgcaccaacacagatacattgttactaaggccctgcaccaacacagatacattgttactaagtaaggccctgcaccaacacagatacattgttactaactaaggccctgcaccaacacagatacattgttactaaggccctacaccagaatggatacattgtacattgttactaaagccttgcaccaacatggacacatcattactaactaaggccctgcaccaacacagatacattgttactaaggccctgcaccaacacagatacattgttactaagtaaggccctgcaccaacacagatacattgttactaactaaggccctgcaccagcacagatatattgttactaaggccctgtaccaacacagatacattgttactaactaaggccctgcaccaacacagatatgttgttactaaggccctgcaccaacacagatacattgttactaaggccctgcaccaacacagatacattgttactaagtaaggccctgcaccaacacagatacgttgttactaactaaggccctgcaccaacacagatacgttgttactaagtaaggccctgcaccaacacagatacattgttactaaggccctgcaccaacacagatacattgttactaagtaaggccctgcaccaacacagatgcattgttactaactaaggccctgtaccaacacagatacattgttactagctaaggccctgcaccaacacagatacattgttactaagtaaggccctgtaccaacacagatatattgttactaactaaggccctgcaccaacacagatacgttgttactaagtaaggccctgcaccaacacagatacattgttactaaggccctgcaccaacacagatacattgttactaagtaaggccctgcaccaacacagatacattgttactaactaaggccctgcaccagaacggatacattgttactaagtaaggccctgcaccaacacagatacactgttactaactaaggccctgtaccaacacagatactttgttactaagtaaggccctgcaccaacacagatacattgttactaactaaggccctacaccaacacagatacattgttactaagtaaggccctgcaccaacacagatacattgttactaactaaggccctgcaccagaacggatacattgttactaagtaaggccctgcaccaacacagatacattgttactaactaaggccctacagcaacacagatacattgttattaactaaggccctgcaccaacacagatacattgttactaagtaaggccctgcaccaacacagatacattgttactaactaaggccctgcaccagaacggatacattgttactaagtaaggccctgcaccaacacagatacattgttactaactaaggccctacagcaacacagatacattgttattaactaaggccctgcaccaacacagatacattgttactaactaaggccctgcaccagaacggatacattgttactaagtaaggccctgcaccaacacagatacattgttactaactaaggccctacagcaacacagatacattgttattaactaaggccctgcaccaacacagatacattgttagtaactaaggccctgcaccaacacagatacattgttactaaggccctacaccagaatggatacattgtacattgttactaaagccttgcaccaacatggacacatcattactaactaaggccctgcaccaacacagatacattgttactaagtaaggccctgcaccaacacagatacattgttactaagtaaggccctgcaccaacacggatacatcccattactaactatggaggtgctttattcagatatcctcagtgtcacctgttctcctttggccgtctcagggttcctcccaggacaccacattgcattcagtcctgaggcttctctgggctctgacagtttctcagactttccttgtttctgttgaccttgacagttttgaggattactgctcagagagtttgtagactgtccctctgttggggtttgtctgatgctttcttcatgattcgatcaggttgtcactttggggaggaagtctgtgaggtcaagtgccattttcatcgcatatcggggcacacccatctgcacaccttcgctattggcgtcggtcgtcatcacctgtgcaggcgtgctcacccggtttctccactggatccagctttattttcctttctatcaaccatcacaacctgaaactgtgggcgtccgtgtgtctcttggagtctagtagaatgtaaggccctcaaggcagaggcctcgtctgtcctgtttgtcaccagagcctggtccgcagtggtgcctagtaagttagtccacccattcaccacatccttacagagctctggcgccaggcagcaagtgctggtgctgcggacagagccacagacaagccggtcatagcttctggcctcatagaccttggagtctaacaggggagagcctttcaaagatttgctcccattgctaatgggacaggatgagacagggtgctgggggactgagagctgtgatgggggatgctgcctggagggctggggtggtctgagctctggaggaggaagtgctgctcaggtagtgagggagggggtggtatctgggttaggggaagtggcgtgtgcagaggccccgtggcgcagatgagcttgggctatttgaagaaccccagcgaggaggcagggtgttcaggtggctgtggctgtggcccaggggcaagagggagatggggaggagtggaactggttaagaagtggacagaagtagggtgagaaggcaaagtccaggatctgagacaggaggatggtggccttcctgcctcccttccttcctgccttccctggaaaggagcacgcctggggtgtggtgagtcctgttagagatgctcacggaaccccctctccccaccccgccccgtggcaggggcatggagaggcgggccctgtgcttagggggtcctgggttagggacggcgctggaagttgcaggagggcagaaaccggcctctgaagagagtggggagggagaaggggagctgtccagggccctcaggcatgcatcatgtaagggtcaggggagtcagggaggatcccccaaaggaggctgtagagggtgaaggaggagggcaggaagccagtgagtgtgggggtctgtgggccatggggggtgggggaggcagctctttgggaactgagggggttcgggtgcagccctgggactcccaggccagtgctctccctccccctgccagccacctcgcagagagagcccggggtggaagcagggtagttggtgctgtgccctgaccttcagaggtggcattgacaagaccagaatgccacagggccatgcacctctccctgcaaactgccctttaatttatttttacctctgttccttgtgggcttgtgtgtcaggttcgatatttttatgttactgggaaaatagaatgtgcttcacagaaatttgccttgtggccaatattgcaggttgcagctgtttcagagtgacaggggacggtatattctggacttgtgcccttttgttcatctctgagaggggccataaactcccatttccgagaggttactgggaccaatgagatcatttattagttttccttgcacaggaaaatcacacactctgtgccattgattgagtccattttattttgtggaatagacatgtcagaagcaggattggccaggtggaattgtgtttggcgggagtcctgtctttccataggtactttcataatggaagcaatctccttctgaagtgtatcacccggtgaactgaatggaaaatctcttgtgaaaaggcttaagaggaaggctggcctggaaaaatgaaactcacatccacagagagacttgtacctgaatgttcatgtcagcaccactcacaatacctaaaaaggggtgataaccgaaataaccatcaaccaagggatggagaaacaaaatgtggtcccccatgagatggaatatgattcagcgtaggcacgaaagaaggacggaaacatgctataacatggatgaaccttgaaaacatgctcagtgaaagaagccacacatgaaagggcagacatcatcggctcctattaatatgaaatgtccagaaagccaaatccgtggagaggggaagtagatcgaatcacacacttttaaaggatgaattgtgtggagtgagaattctatctcaataagggtgcatacaaaatgcagctgacggtggtcacaccaagcctgtcagtaatgatgcataacttccctttgctgtcctgggttagggtgggttgagacttagggtgaccagggaggaatggatatcttgtgggtcaccttgactgtcttggggtgatgagagggcagtattaccaatgcttaatcatttgcccccataccaaggtgaacacgagatgctctggtcctagtggctgcagagttgtgcagcctctgtccctgtgctagctctggacctggtggtggccgcagagctgtgtagcctctgtctctgtgcttgctctggtcctggtggccacagagctgtacagcctctgtccctccgcttgctctggttctggcggctgcagtgctgtgcagcccctgtctctgtgcttgccctgtccttgtggtggctgcagagctgtgcagcctggccccagagctgtgcagcctctgtccctgtacttgctgtggtcccggtggtggctgcagagctgtgcagtctctgtttctgcactttccctggtcactgcctcattgccgtggcgctggtggactgaggccataatgcctgcgtctcctgcaggtcctcctcgactggattaatgacgtgctggtggaggagaggatcattgtgaagcagctggaggaagacctgtatgacggccaggtgctgcagaagctcttgggtgagttcacagcagggacagctctgtcccacccccatctccctgcagcggccctgggctgggccaggattctctgcatagtgacatcggccacaggtcctaggaagacactcaaagctgcagtgtgcatctcccaggtggtgcccaggccctgggctgtggcttcagggtcctctctccccttgccgtttctacagagcacccagccatggggcagcagcaggttggggacagcttccaaaactgcctgcggctcccatcctgttgggtctcaggcccactttgtgtccctgccaccctcttttgacttgaactccttcggttcaggatgggaggcagcaggagggaagcgggtctgcagcaatattctgtgagtgaatgtgtcaccaaatacatgatagctcatgttccctcaccaggggcgggctctagtgtctgcatttgctgggtgaaggcagtttagtgatcttcccgggactgactgatgcatggtttgatgtgcagacaaaccggttgtttattcatcagatgttggatgagtcccgagggctgggtaccagggatacggtgatctttgaaacagacgtggtccctgtcctcagaacttacagtctgtctgaaaagacaaatatttttgaatggttacagttactgttcagattgcttgtgatgagggccttcggagatgccgcaggttctgagtagaggacgccggcctggcctgggggtggggcggccttgcagctcatatggaagaacgagcgaagagttgccaggcaaagaacggaagagcagagttcgcagatgatgcatgagaggaattcttggacttgtagtgggttctcacgatgcctggcactgtcatgtctcattgtcacaatggtcctagggggcagtactgccatcgccttcgacaggtggggacgttggggcccacagtctcctggtgaacagccgggcagcctggccccaagcatagctcttgagcccggccgcggggcctttctctgacctgtctacggagcagccccaggtacagggcctgggtcaggcgctcctgcatgatcacagctggttctcacaacagccctgggggtctggctgaatgagcagatgtccctggttgtccccacgatgccttttgtttggatccaggagtgaatcacacatgaacgtttgtctcttcttttaggcttctttcatctggaaccgccttccctttccctctctccgttctgttctgtctttctgtcttttatgacgttttggaagggtctgggcctcttgtcttgtagaatatcctcccatcgggatctgtctgtctcctcacgatgagatctgggtcacatgtttctgctgagagtgtgactgcgctgcctgcttgtcctcctgggggcatcgtatcaggaggagcacacaatgtcaggctgcctgtcattggtggtgctgacagtttgatcactgggttaaggcagtggcctatgggtttctccattgtaaaggtgcttctttcctgttaaaaaaaccacttttttatttgttctattttggtagagtcaggatctcactcagttgcccaggctggagtgtagtggggtgaacatagctcactgcaccctcaaactcctgggctccagtgatcctcacaccttggcctctagagtagctaggactacagatgtgtaccaccacacttggctgttttttttttttctttttttgaaatggagtcttgctctgtcacccaggctggagtgcagtggtgcgatctcagctcactgcaacctccgactccctagttcaagtgattctcctgccttagcctcctgagtagctggggttacaggcacataccaccatgcccaggtaatttttgttttttagtagagatggagtttcaccatgttggccaggatggtcttgatctcctgacctcatgatccacccacctcagcctcccaaagtgctgggattacaggtgtgagccactgtgcctgactggctaattgttttgtattaaatttttaaatttcatttttttgtgttagagacagggtccttgctttgttgcccaggcctgttttgtactggcctgaagcaattctctcatgttggcctcccaaagtgttgggactacaggtgtgagctaccatgctcagcccttctttcctttttaatacatggtctctagaggggcagactctgggactttgtgaacgtcctgttcacccatgatgcgctccccatgattttatcatccgctgattatcattctctaaattatgctaaatatcatctctaaatattatgctggaggttgcaaaatagtgatttctgtatctttatcatggcttccccacttattagctggcattttcttctgtaaataagtgcttttcttctcctgtgtccttttttaaaaaaaaaaaatcccctaaaatagaataacacattcccctggactgatgaattattttatgttcaaaagagaatggtaattagatagcaaaatctgggccttatgggtgcttgtggctcctggggtgtcattgcttctagtctctttaagccaaaagaggtagcaaatatatagttttttaaaaattgtgagttcacactgctacttctaattccagttcaatgctacaagtttatcccttaactgtcagcattcagtattccagtctccagggagaaccttggttccagaaatatatttgctatttactctgattgcatacaaaaatagtgtcagaattacaataccaatacctctatcaactacaaacatgctaggtacaagatttctttgccattattttttaagtacaatatatccactaagagtatatagtcagaattctgtgttcagaacttaactgaattattttctttttgagtggtcatgtcatccatttaatgtataaataaattaatttgtttctctctgtatttagtttttgtgtatatgtttacatttaattttatttaatattacttttaaaaatgtaaagcatttacatgcttcaaaagtcaaaactatggaaatgacataccttgaaaggtcttagccaggtgtggtggctcagcctatcatcccagcaccttgaggggctgagccaggaggatcacttgagccgaagagtttgagaccagcctgggcaacatagtgggacctcgtctctacaaattaccagtcgtggtgatgtgcaccgtgcacctgtattcccagctgctcaggaggctgaggcaggaggatcacttgagcctaggaagttgaggctgcagtgagccatgattgtaccactacattccagcctaggcaacagagtgagaccctgtcgatcaagagagagagagagagagagagagagagagacagagagacagagagagagagagagagagagagacacagagacagagagagagagagagagagagagagagagagagagagagagagagaggtctcactgctttctctcccacgtatacactcccaggtaacaattttcaatggattctgattttatccttcttatgtttctttacaaaaatgtccatatacacacctactcatttcccttttattccttgcataaaaggtgatgtattttgtacattcttttacacaccctgcttgtttcgcttaatatgttctaggaatccttgcatgtggagatcacctttctttttctttatggctgcattgtactccactgtgtggatgttccttcgtttattcacccagtctcctatgtggggcatttttgtcatttctaatatttttctatcaccagtaatattgtgggaatatcctcgtgcagatgttacagaaactagaattgttgacctcaagtgtaatgggttgcttccttgagctgaccactgtagaggaaggaattctcaaattctgagaggcttcacctctctcacctctggccttcccaggtctgttgtgccttggttgatctttcctgtagccactttctgtcttccctggactgttcagtgtgcagacatgatgtaatatttccattaaaaaatggctcccttgctcctgcaacactccaatttctctgcatcactcaaatgtattgaccattagatttggcaccggatgggtcattggtggcccagatgagagcagttttggcgcagtggtgggggtaacacgctgatcggggagggtccaggggcagagaactgtgcctttgaggtacataattttgagagggagagagaggaagggagtgaacctgtggttgctgcagctgcttttcttttcaagacagggtctcactccattggctggcctggagtgtgggggtacaatcatggctcactgcagcttccacttcctgggctcaggtgattctcccaccttagccgcccgagtagctgagagtacaggtgcatgccaccatgcatgacttattttttgtattttttatagatacgaggctttgccatgttgcccaggctgatcttgaactcctgggctcaagcaatccacccacctcagcctcccaaagtgtggggtttacaggcatgagccactgcgcctggccaatacgaggctttgccatgttgcccaggctggtcttgaactcctgggctcaaacaatccacccacctcgggctcccaaagtgtggggtttataggcatgagccactgcgcctggccatagtagctccttttcatgtctgtccactgggaaccatgcaagctgcctgctgaaattacgtggatggagcccctggcacagtgcctggcacaggtctgtcgtcaataagcaggagttgttattgctgttgttttttaaacagacaaataaatgccaagagcagaactaaggagtatctggctcgctgctgggtaccccatccaccccaagtcccctgggtgactggcacatgacaaatatttgttgattaagtcaatgaaagaattcctgcagtttcattacctatgaagattgtggggtcctcttgtgggacatgaaagggggacagatagatgagtattgtttggatttttggtcctcagtgccatccacagactccagaagggatcagctatttgctgaacaatctttcagttctcatagagccctgatatgttttcagggtccacaaatgcctgtgacggtggcctcaagaacccagtgtccccttgtaggtgggatagcatacctcttaaaggtcagcatgagattccacccatgtcatccccagcattggtggggtcagcagatcctctctctggggtttcttttctgctcaacctccctgctttgatggactgcacagacaagccccatcttggtggaagggtctccccatgggctgtcctggagggtcactcccacagatatgccccatcctggtggaagggtctccctgggggctgtcctggagggtcagtcccacagacaagccccatcctgtgggagggtctccccgtgggccatcctggagggtcagtcccacagacaagccccatcctggtggaagggtctccccgtgggccgtcctggagggtcactcccacagacaagccccatcctggtggaagggtctccccatgggccatcctggagggtcactccctcagggcagggctggtgactggggtgggatcatgtttttctccgctgttgtgacagaggagtatctgctgcaggggatacgtggactgcggggggactgccacaaggatgtgaatgggtagggggtggggtgctgtttaggagagagagagactaggggagcccctgccagagaaacttggccctgaaaacacaggggtgcagcatctgtagctgcctctggacagagtttgcacactctgcacaaatggctcttacagaccagctcttggagggaaacctcctaggcttgtgacaggtggtggtgagggtggggggatgaggtgctggggaggccatgtcccataactcactctgaaggacacagtgatgcttggaccacattgtttgtccttattcatctggccctcagaaagtatatttggagggaaacatgtctgtgtttgttttggtcacacattcattcattcatctgatgaatgaatgttcattggcttacatgtgtcgggtggctcttggctgtagagacacagtgggaaacaagagagatgagccccgcaccctgcgcctgcccactcccccagcacacattctagcagagtgaagaaagagaagtattatggggtggagtggttcaacctgaaacctagatgatgttttaaaggaatgacaagtgctaggaggaaagtaatagaaggttatggggtacagtggtgggtgggggttggggaaggcaatccagggaagctcctctggggaggcgacatctgagcacatgtctgcacagtgagcttgggaagggcgttctgggctgaggctctaaagcgagaaagagcctgttgtgttggaggagcagtgaaaagaagcggaggcggggcccaggtggcagagagggagggagagagccaagagatgaggctggggccagatctcattcagccctgctagacaacagtctattccaagtgacaggaagccattggaggttttgggtagggctgtgacgtggattgggttagagtttaaaaggtcacttaggcttctgggtgcaggatggatggggaggagagtcaggagttggaactgagagatcagtcaggacaccattgccatggcccaggcatctgatgaagtagctcagcccccagagtggaagggcagacatggggaggtactgtacagttaaactgccataggaaccaagactgatggccaggtttgtggcttgagcaactggtaaatgggaagccgttgggagtagggtgggaggttgggaaggcgggggtctgtgttgtacatgctggggctgagatacctgcccttttggaggtgatgctgagcaggtgagcctggagtccaggctgcagtgtacgtgtgaacccagcagcactgagctgatgtttagcaccgtgggactgcacggcttcacccaaagagggtgttccaaattttatttggctgaatgccgaatgcccaagaattaacatctatatttggctaaggtgagaatccccatcttagaatgagatcccatggtacaagaataagtctgaaatgttcatcaagattgtgtcataattatcacaattttattattaaaaacgttagtggccaaagttttgatgttttgcattgcagtatcagtacagtcacacccagcactgttgggtaccacttgctcttgaggtcttcaaaccagacatttgtgatgctagatgctcactttcaactcagaaggctggaggagcacgtggacctttggctgatgctgtctgaagggatactcctcatgtgaagctgcccctgggctgtcagtttttctctctctgagtggctggttatggtagagacttacctcctctttgatcttggatgtgaagattgggctgttgctggtgatggccctctgttgaagcagtccccccaattggtactttgctccctacctgaagcagatattttctaatattttcagaagcaaacttgagtgttttgttcactttcattttttatttctgattcttttgcctgcacctgtggcttctcccacccaatgacttgaaacagtatgtcagcaagccttgtatctggcagcctggctgtggaactggccctcagaatctcaggacaggctctgaatttgcatctgcatctcagccgtggttgcctgtaaaccatgccagtgccttctatagagcagaattacaggggcatctttaaagctgcatcttcccctctcaaggcacatccttttggttccctcttcagttagtgctagcaaatgcagcacttactccggagttgctgtgattgtccatgagtcctgctatatcagttgtgttatccataaagtataacatgaggcttcctttggctcaagcagcctttttcttgtggagtagctgctgttccatcttgtttgaataatcacataagcacttgagaaggcaattctaaaatctcttgagtgtcaagtggtttgacatattaaaaccactttttttttttgtactgaaaaaaagaacagtggactagaatattcagatagtaacacagcatcagaatgtcttgcctcattttgtgaatgttgttacactgaaatgacataatatactgttgatgtgagatcctcttgatgtgatactactgatgtgatcacctgatccttgagctccaggatgccaggaatgacactgatgtaggcattcagctctttggctttccaaaggcagaagcccaaaccaaataggagattttagctgaataccaaggtcaaagccaacttctgtgcatccgtagtagagaagaggtctgaggactgggtctgggctgtcagccattagtggtcaggaagaggaagttctggcaaaggtcagtcacaagggagggggagccagaggagtgttgcattcaggaagggtaaaggaggtgtttctaggaggtgagaggaggaaagagaacagacttctggtttggccatgtggaaattgcccagagtgaaccagcaggacccctgaggagtccctcttctttttttttttttctcttgagatagtgtctcactctgttgcccaggctggagtgcagtggcgtgatcacagctcactgcagccttgacccctaggcttggatgatcttcccacctcagcttccccgggaagctgggatcacagatgcataccaccatgcccagataatttttgtattttctgtagtgctgaggttttgccatgttgcccaggctagtcttgaactgggctcaaacgatcctcccaccttggcctcccaaagtgcagggatcacagggatgagccactacacccagccgaatccctcttcttgagagaagattctggaagcagctgccgggttctctgccacatgccaggtttctgggggtgtagctcccctgtgtttgcagtgcagccctcaaggtagactgcatatggccagagtgaggtgcccgtgctgtgggagctcctggctgtcgtcctgctggtcactcacgggcacaccctctccttgtgaaggtgaagttcttcatcacatgtgtactcaacccccatgtggccatcactcagggtcacctgctacatgggagaatcctccccagttttctctctttctgtgctaggaagataggggtcctggccacaacagagccctgagctgctcctgcggcccccgccagtgggcacagtgatgtctgatgatgcaagtgatcatgtgccgtattctctgttgcacaggagtcacccaagacccagcctaaggcagcacacaggcatggccagtctctttggtctctgttgcctgctgtttccaccaccaaattcatattttcaagtcctacatgcagggcccacccatgtgacctcattttaccttaactgcctctttaaatacaggcacattgcaaggtatgagagcctcgcccactaggagagatgggtagcctggcagcctcccactgtccctgctaccagccagccctgcaggttgaacctcggaatgtgactgtatttatagagataataataggctgggtgtgatggctcacacctgtaatcccagcacttccggaggctgaggtgggcagatcacttgaggtcaggaattcgagaccagcctgatcaacatggtgaaaccctgcctctactaaaaatacaaaaattacctgggcgtggtggcacatgcctgtaatcccagctactcgggaggctgaggcaggaggatcgcttgaacctgggaggcagaggttgcagtgagctgagatggtgccattgcactccagcctgggtgacgagagtgaaactccatctcaaaaaaataaaaaaattaaaagaggtaatgaaagtaaaatgaggccatacgagtgggtgggccctaattcaatatgtctagggttcctataaaaagaggagattaggacacagacatgcacagagggagaccaagtaaggacacaggaaggagagggcagccatctacaagccaggagaggggcctcagaagggtctaccctgccggtgccttgatcttggacttctggcctccagagctgtgacataaatctccgttgtttaagccgcacggtgtgtggcatgcttcgttgcagcagcccagacaaacgaatccagtgtcctccgctcctctgccgactcctcttcctccaccctgggtgacgtggccatgttcagtctgcggggccggatggtggcaggtgcaacgggggcgcgtcaggcttcccatctccctggtgggcgaggctctcagaccacccagttctgtatgatcctatctctctccttccttctccaagctgccctgctctgccctttccatggttgttgaacacctgtgggacctacttgctctctacttccagggcgcaaattcagacagacagctgtggatgactcagcgaggagctgttagatccagatggagggaaatcagatgaataagcgggaatcgtttccactcccctgcaggatgtgttttgttgggctgctttgttttttctcttgcagtcattgccacccaatcagatgttttttacgggtgtttatctccccactagggacctctgttatctgtgccatatccagcacctaggacagtgcctgtcccatagtaggtgttcagtccctatctgtgagccaacaaacgcatgatcgaaggggtattccgagcccagcaggccttgctctagaattttattatcttgaaagggatgccaaagctgtttgttttctaattgagggaggggaggctgctggggagataacactgaagacatgggggcctccagctaaaatgttttaaacagaactttgtgctgggaaccacttgcaaaacagaaaccccatttgtgactggcctggacttgattgctttcatgatggcatgtcaatgccgcgtcactgacagcagctgtgtattgaaggctctgtgctgagtgcttgcagtcaccctcccagtgaaccatctcacgatgctctgtgacgtcgcttttgttgttttgcagagtggatctatcagtaaacactggagtcttagaatcgaagactagcagggaaactgggggtccttcctgctgtgtggccctgcagcgggcgtggggtggggcgctggtggccggcacctgccagtacctactgctaacaaaagggaaattgaaggaggtgcaggctgggctggagctcagtctcagtaattgaatcttgatgaaatgtgacagttcttgtctgtgctcctccggattgtttcctgttcattcttggtaataaaatcatcgccagttctgtgaatatctaatctaacttcctattgtggcattagaatgtttaagaaacaagaatgggagcctcaggtgtgtggggaggcagaggcagcttttaagaccttttttaaaattatctttatcagtcctctcccttttgggacccacagggacagtcttctcacctcctgactcccactttcattcttcccaggtaacctccttgcctctcaactacatcttattatgttttttccattttgtatgcatagaatgttcccgagtataacacccacagttttatccttaactattcttcccttttcaatctggcgtcattctctaaggaagattagtgacctggaagctcagcgttcatggttcaacatctcaagacgcccccatggccacatggtaacctgccccgcttcggggacctccttgaggctggggtcttggtggttttgagttcctccagtatatctctctccccttcctccctccctccctccctccctccctccctctctctctctctttttttctttcttctctctctctctccttccttccttccttcctttttctttctttctctctctctctctctctctttctgaggcagggtctcactcaggttgcccaggcttgggtgcaatggcatgatcttggcttactgcaacctccacctcccgggttcaagcacttctcctgcctcagcctcccgagtagctgggattacatgtgtgcgccaccacgcctggctaatttttatatttttagtagagacgggatttcaccatatttgccaggctggtctcgaactcctggcctgaagtgattcacccacctcggcctctcaaactgctgggattacaggcatgagccactgcgcctggcccttccagctttttctgaccctcttctcttgtgcttctcattgcagaaaaactggcagggtgcaagctgaatgtggctgaggtgacacagtccgaaatagggcagaaacagaagctgcagacggtgctggaagcagtacatgacctgctgcggccccgaggctgggcgctccggtggagcgtggactgtgagttccacgccacagggggagggactgtctggagggagcccgtcctctcgacattcgtcatccacatttgtcatccacattcatcatcatcccatctggccttgcatcttaaaattgggttcatctccctgctctgtaagaggtagaacattgcaggggagaagaacaggagaagggttagggagatcctagaaaagggacctggtcaggccacaattctccatcctccccatgctgcagaggagagaggcaatgtttatggatgggtggatcagagggactttgagagagagaagcagccttggggggttcttgttgggactcaaccccaaatactggtggcagcaacacctagtgggctgtttgtctatgaccctggcattatgagatgtgacatcacggtattttcagccaagacatgaacccggcaggtgaaagactaaaccaggagaagctggaaagttctcctcggtcctgcccactccttccccacctccctcccctggaagcagggccatgagggtgtggcttcagggctctctgtgctgggccagaggtctccgtgctttggtgagctgggctctcagtggtaggcaggagaccctggagcctggccttgcacccggtttcttggtatcgagaccttgggcagacccaggctgtctcgtgggtggctgggtccgtgggtggggaatcgggtgccttgtaaactgtaaaaccctgcaggagaagtggtgatgttgaccaaacctgagtccgcatgctgaggaagagagaggacagactcaggcaaggcaggggctaatgtctaatgtccccagagtggcctctgctcttggcagcctacccttgttgggatggttcattgcggagagggagcccttttttagtgccagagataataacgcacatccttgtgatgggtaagtggccgtgacctgctttccatgctcttttcccttctgtgctaattttactatcctgttcctttccctcatcactgcccaatttattgcttttaaaaacattgtgcttctaaaagtggttgcacaagtcaccttaggccaacaggaaaggagacagtgaagctagaagtaaattcaccaggttgctcatcagctctcttgatttgtccacacttcgctccatccttgtctcgctggggtctcatttagatgctgtgtctctgttgccttctgcacgtgggctcaggttcctgtgtaacctgatctaaagcgtctcccttcctccttcctcctgcagcaattcacgggaagaacctggtggccatcctccacctgctggtctctctggccatgcacttcagggcccccatccgccttcctgagcatgtaacggtgcaggtggtggtcgtgcgggtgagtataaccgagtggtcggcctgcctgtaactccgccagagaggcaacatcttcctcctgcagttttcctgccctccccctccttttttccccccaggaggctaccttctatttttcccttttgacaaaatgtgtgtctcaccctggctccgagataaatgattggaacgggaacaatggcattgatttgatgagaggcagaagcagaggcatgagggtgttgaggtttaattttccacatttttgaaaagaacattcatttctctccaaagccaactggttggaattcaatccccttgaatgtgcttattactcattggaggaggttggccccgcgggatgaaacagacacccaaattaaagccgctttgcattcgttggggattattcatcatgccccatcatctctttttttgggttcatttctcttgattcacttggagaaatggaaccagaacccaggtccttctaacagagggtgaagtagagttacctttctcttgctatttcccttacatttattttttattttattttatgttttgtgaaagggtttcactctgttgcccaggctggagtaccatggtgcagtcatggctcactgcagcctcaacctcttgggctcaagcggtcctcccgcctcagcctcccaggtagctaggactacaggcacatgccaccgtgcctggctaatttcaaatttttgtagagacaaggtctcgctatgttgcccaagctggtctcgaagtcctgggctcaagcgatcctcccatctcagcctcccaaaatgctgtgattataggtgggagctgccatgcctggccttatttcccttacatttaagtggacagtcgctgcctagggttcgtgtgtgcagtttccctcagtaaatgtgcaatgagcgcctactattctctaagcactcagcataggctgccgagccactaaaggaggaacacatgcctggcgtctgtgggggtgaccactgcggccagagttgaggtcacgctcggaaccttggatgcctctgtgtttattttactcgagacatccggctccactttcctctggtttttaaacttctcagtcccgtggtctctgtggtcggggaggacctggctgtcactgtgttttccgaacccattctggcccctctgttaccctgggagctcagtcttgaccggacgggaatgctcctctctggcatccggcaagggccacctgccatgtgtccatgtttccttcctaaggaggatgtttgtggctggtggtggtgactcgggacctggggggccattcctatggccccgtgtcttggccactggttcacaggcagccggcctgaaaaggcttccctaggacacattgggatgtggttcccaagcctacctacgtcagctcggggccccaggagccctgtgcaggctcagaaactggagtatttcctttcaggcttgcacttgggtccaagataatctttgcggtttgcagaaagtttgaaccaggcaagcacttgctggtgcttcctgccataacgggttagaggagtgttgtttggccacgaccaaagcagaatgaaacgggagcagggggtcctgtgaaccgggcgcagttactccccagaccttagagccgccttctgtcttctctgcagccccctggcctctgagcttgctcaggggaccccttatctaaccccagatggaatggttggtgtaagggatgtggcatttccagggtggaaggaaggaaggaaagggccttatttactgcctggccacgtggctttgggctgatcacttgcttttgctgagctgcaatgcttttccccataaaaccaagattttactacaaacctgtaaaacatccagcttcatgtctacaatcctagacctgggcccagcacctggtgggtgcctcaggcatgtttgatccttgactaggtgaacacaatgtctggaccttccttggcaggcactcctgagaatcaggataaatgtcacccacactgttgttcaataacaagcaccaaccctgagtattccatggaggtcaaactcaggaaagggatggaagcccagatcttggtggtgtccactgtgggctggcccagcgggaaatgagttcccagtcccttgaggggttcagtggtggttggattagccacccaggctccatctggagctcctgtgacaggcgggctgccacccctaccatcaccactgccatgcccccctcactaccatcattacttttttttttttgagatggagtctcactgtgtcacccaggctggagtgcagtggcacaatctcagctcactgcaacctctgcctcctgggttcaactgattctcctgcctcagcctcccaagtagctgagattacaggcacatgccaccacgcccagctaatttttgtatttttagcagagaccgggtttcaccatgttggccagaatggtctcaatctcttgatctcatgatctgcctgccttggcctcccaaagtgctgggattacagctgtgagccactgtgcccggccatcattgcttttctatacctgccacgctctgggagaagtgtgacatatactgtgtcagtttcctagggcagccataacaaagtaccacaaaccaggtggcttaaaacagcagacatttattctctcgcaattatggaggccagaagtctgaaatcaagatgttgtcagggtaggatgtcctccctcatgtctcctcctctaggggaggggtcttcctgcctcctccagcttctggtggtggctgtcagtccttggtgttcttggcttgtggccacatctctccagtctctgcctctgtcatcacatggcctcctccctctgtctgtttctgtgtctgtttcctcttctaataaggaggtgagccatattggattaaggaggggctcaccataatccatgatgacctcatctgagctagtatctgcaaagacccttatttccaaatgagatcatgttctgaagtttgtggtagatatgaactttgggggaccctcttcagtcccgtgcacacacatgattgcaggggatgttccctgttatttatgttccttccaattgcatgcctcacctctcctggctgcaaagcatagaggatccctttggggaatcctgacctggggtgtttctcctgagacccacacaaatgccaactctcaaggccacgtggagaccagagggtggggaggaggatagggacaggttgtggtcgctgaaaggcaccctgcccagggtcccctgctgtgtactcacccaggcctggcatgcgtgttcaacaccacccctccttctcctgttgctcttttctaagatgatctccggccccgcagcttcgtctgccctgtcagtgcatctttcctcaactctccactgcctgattttgtatgtttattttggggttttcagaaacgggaaggcctgctgcattccagccacatctcggaggagctgaccacaactacagagtaagtggacccctgtcttgcccttccaggccctgctgccccgagtgagtgggaccccaggctgccacttcagccagggacaccagcgcccatggggctgctcccgctccacaccccttctctgtagcatgtgattctcatgctggttcccaccccagctctcctccctctgcacactttcttcagagtttttaacattagaactgagttaccttccacagactttgaattttttcattcctatcttaaaaggtgagctgtaagaacattgcaaagtggggcaggcagagagagttcaggatggttagagagaaccattgtctcagttcatttatccatctacattagccccatcagaggtgggagctacatctttaaaccagaactttcctttgacagacactactaagccatctgttatctcctagagaaagccagagggcaggtgttcagaagtctaaaaggcttcaaatctattgaaaatagcaaatcaaacagtatctgtggtatgtggttttaaggactccttgtgataacctgctaagaatctttagaattcactgcatttgtgcctcttgactaaacctgtttcagatgaaacagaacatttaaaaattgattgtctcagctaatccatcagctaagttcacagagtgattaattactgtgttgtgaattcatggatggtatttcaaaaattggagctgacacaggaaaccactcgtggcttgcaagctctcagggaagatgatgggacagtggagtgcaggctgatgcatgtgcagaggcccatgaagaggcctcccagtctgccccaggcccacgaagggaacagggagagctggaaaaggggaggatgagaatgtggttctttgcccagcacagtgggcctttggcagcagctctgcctattcagcagtaggagaagggctgctcgtggggaactgggattgggctggtgtcttagttgtttattgttgtgtaacaaatcacccccaaagtcaagtggcttaaaacaacatctgtttcatttgctgctcacaattctgtgggtcagcaatttaggctgggctcagctgggcggttgttcagccagtctcgcctggggttgctcatatgatgcagacatctgaaggctggatggaggctggggaggctgagatgggctccccctacctctggtggttggtgttggcctcccctgggtctctttcctcctcacagtgctgggcatcttcccagggtgctctcagggtcctgagagagtgagaatgcagctgcagtccccttgaggccttgtcttggacatccatacctatgtcctcaattctgtgagtcaaagtgagtcacaggtcatcctggatcaaggtgcaggaaacagactctgcctccttgtgcaggaatggcctgtgcacattgttgggtggtgggcatgctgtgataggagttcccctctaggtgagggggtcccatatgaggacagcaaggaggagctgggccccctgccataaaactagaatggtccagagacagagaatgagcaagtgggtgggagaattgtctcagctattcatcagcagtaagtggccccaaggacctgctgcatgccagcctccttgctggatcaacagagacactgagaggtgggctgagtgcagttcttttcctccagggcgacccatcctgctgatgagaaaggatgcatccacagacatgtacagtctaacacaggggcttgtgggaagtgcctcggggccctaagggaatttccaggaggaggggagcaccccaaagtcagggaaggggagatttcagtgaaagccacctcaatcagatatcagatggccctgagcagtgaggaagggagttgggattttctagcctgagtcagtgtccctctgccagccagggtcagggtaaaggagaggctgggtcacctctccaggatgatgccccaggtaggttctcctcagggctggtcatcccatccttgtctcctgttccttcccctccccgtggctgcggaggctctgacggaacatttgaatcattggatgtctgctgaaaaccagcggcccaaagatccacattcagtttcctaaggcagcattgccacctcctatccagtctcagtgttcccctttctctttcaagaggtggctatgaggtcaccccttccaggaagccctcctgtctgccaagcaggagtgcttggcttcctgttagttcccttagcctctggacacatgtggccaacattgaaatattggcttatgaggtctgtcactcccaggcatcctgagggcagggccacatagtgtttatctccaggggatgttaatttctgtatctgcacagcctgcacatagtaggtactcaagtaagtgcttgttaaataagatggagccaaaggacttgagcctagagggatttggggacaaagtaaagacttccttgcctctcaggaaggcagtgcatggaaaggatctgtgcactcactcactgggaatctttgaggagaagctgctcaccactcccgtctcccccattgcttccgctgccgcctgcctgagatcagggcctggcctcgtggttctccaggatcctttagttccacaagtcctgcaagtacattgtgtttactcctggaaacatgagtaacctgcaaccttgtgtgtgtgtttgtttgtttatttatttatttgagacagggtcttgctctgttgcccaggctggagtacagtggtgcgatcccagctcagtgcagtcttgacctcccaggctctagcgatcctcccacctcagcacctgagtagctgggactagagcgcacgccatgacacccagctaattttgtatttttcttagaggaggttttgccactttggccaggctcgtctccagccttgcatttttttattgttttgtttgtttgtttgtttgttttttgagacagagtttcactcttgttgcccaggctggagtgcaatggtgcaatctctgctcactgcaacctccacctcctgggttcaagtgattctcctgactcagcctcccaagtagctgggattacaggtgcctgccaccatgcccggctaatttttgcatttttagcagagatggggtttcgccattttggccaggctggtctcgaactcctgacctcaagtgattgacccgattctgcccctcaaagtgctgggattacaggcatgagcccctgtgcccggcccagcctgtgttttgagcgttccacggctgctggaagacctgttgtctgctgaaatcttcatattaaccactcttctgatttaagtacctcccctccaaacaacattaccagggtggttaatgtgcaaatagagatggtgatttgctgctgaccttgtgcaaacattaataattcacacaagcacctctcgtttataattagagcaggctggaacacagcaccatgtgacttgcgttcttatcagtaggcctttacctgggcagcgagggcccagctttctggctggctctgtccctcatcctccattgtgctgcttgtgaaactgtgttctgagtgacccatctcatggctctctctgtgttcttgtttgcaggatgatgatgggccggttcggtaagtaaccccagggaaagtggggagatggaggcatgttagggctcccccaggaagctcccagagagtgtacatggttatctggagggagtgggaaactagatgggtctcactgcccccatagttctggaatcctagagaaagtgcacagcccacccccacctttctgtataatgggcttgtttctcagagctgagagtggctgggttgtgctaggaggagtggggtggaaggctgggtgaccagctaggggagcaggaggggcctgggatgtaacactggctggaactgtcaggggctggagcaagagtggttgagggtaaaagggagggaggagaggcagccagcacatggagcgtcgttagctggctggaagagagtggctcagctctgtggatgtccttccatgtgtattatttcctcctggaaaccactggtttagcagacttccttagagtcaggcagccagggctcattcctggctggtggcttgtggcctgccccttcctctctctgctcctcatccgtgaaatgggagtgtaaaaggctctccccaggcaggggctgctgtgagtattgggtgagatcacaggtgagtgccctgcttggccgggggacagccctctatgtgggctggttttattagtgttggttttcagtggctcttcccaaagagagagaggtaatcactctctcttccctcatgaaagcctgagacctcatcttcatctcggtgagggatggtaacgtttcaaccctcagtaccaggataccccggccctcggcctggccagcctcagtgctttgggaagcatttcaaaagagaaacctcttgacccccagataccctgttctccagtgagcagggaggggagaacagctcttaaaaggaaaaatggaaaccagatagaagtctcccacctgcctctctagcggagctgatatctgtcttttgggggccctctgggtgggggtgccaccccctgagtcctatacaatgagggctgggccagcttggccatggggctctgtaacctcaagttattatggggaccagctaggatgccattgctgcttatctattgtattagggttctctagagggacagaagtaatacgatagatagatatatataaaggggagtttactaagggtattaactcacacgatcacaaggtcccacaatagtccttctgcaagctgaggagcagggaagccagtttgagtcccaaagctgtagaacctggagtttgatgttcgaaggcaggaagcatccagtatgggagaaagatggaggctgggagactaagccagtctagtcttttcatgttcttctgcctgctttttattttggctgtgctggcagctgattaggtggtgcccacctggattaagggtggtctgccttttccagtccacagattcagatgttaatctcctttggcaacaccctcacagacacacccaggaaccacgccttgcacccttcaatccaatcaagctgacagtattaaccatcacgcctgtggagaggggaagtggctcagatcctgcggggcttgaattgagaagatgcagccagcgtgtcccccctaggctttctttactagaccttaagctgtgctgggaacattcacaggccttctctgttttttgtttgtttgtttgtttgtttttaaggagaattccagctcttttaaattgtctctattattaaaaaacaaatgcaggaagagaaagagaaacatcctgtatatagttgctgagggaggcgaaaccgcagtggggtcacagctcatgggaccggggtgaggcgtctccccaccctgcgtctaggtagaggcgcgttttgggggcccagtgcccccctctgtcacctcttctccatcttttcttcctggaggaggctcagaacccctttggaattgtagaggcctaaagatgaggagagggccgggcgcggtggctcatgcctttaatctcagcactttgagaggccgaggtggatggatcatgaggtcatgagatcgagaccagcctggctaacatggtgaaaccccgtcactactaaaaatacaaaaaaattagccgggcgtggtggcgggcacctgtagtcccagctactcgggaggctgatgcaggagaatcgcttgaacccaggaggtggaggttgcagtgagccgagattgcgccactgcactccagcctgagtgacagagcaagactctgtctcaaaaaaaaaaaaaaaaaaaaaaaaaaaaaaaaaaaaagatgacagtgggcccctcaagcatttttgagtctttttgttttttttgtggcgctgtcacttttgtgtttggttcgggccttgttggaggtttagggaaaagacagtctgttcagttcagttgggagcacatgggcctcaggctgtgtatagcaccctgtggcccgagggcccagaagcctggccccggagcccctgccaccccatgaatgagctttagggtctgatggctggggcagtggctccctaggtaagagccaggtgtcacatgtgaaaagtggacccagctgccactccaggggtgggaggactgtggaatcgcaagaccatgtacaagaggccgatggaattgttctcgttactttgtaggctttatgtgctgtgcttgagaaaatgcaaacaggctattagtcggtgacaggcaattagttccacccccggccttgctgcttctgctgacgcaggttccgaagtctcctggttacccagcctggcaccctcaggcacagcagggtgtctggcccggcacccgcccctgtgggggcagcagcacgccttgtcttcgcttccctgccatgccattcccctccttcagcccccgagagcaccccagggtgctccctcctccagcaaccttcacctgaatgctctccctctagattaccccatggctcactctttcagctctgccagctcttggttcaaatgtcactgatcagggaggccctctctgactccactgccccaaactggcctccactggctctcctccccacccctgccttagttctttctgtactcatgtgacacaccaagcagcactcagctcatggggatggcctggctcctcttccctgtgccagtgtttacacaacgaagcttgcacgtgtctggcagacactggtgccagcaaactttcaggggcacccacagcccctgcctttctcctttcacacatggctccttgacccagaggtgctctgtgggctggagctgacctttcctcggggtgcaccccaccccctgccaaagcagccagccctggccacagtctgcacgcagctgggggcagatgttttaggagcttctggaaggccgggcagaccctccttggctaatgtgctgggctttgccaggagtggtcttctgggcctcagtttccccacgagtaccctgagccagggagggatggggactccattctgcccactccccatcattccggggagggaggtggctccacaggtcctcgctgcctcctgacagcatcactgtcctggatgaggtgggtgaggaggcttctctccacggaaacaagtctcaggggttccagggaggttgcagcctggtctccatggcaatgggtgagctggtgcggcttctccgcgggcggcccttccccctcctgggcctgccctgggctggaggctctttctgaggcagaggggaaagaagggggatgtgccttcctcactctcttccccctcattgtaactcctagtaattccccttcacgtctctcccatttctgccaacagggcttgttccaaaacctctggctccatcccatcacccgtggctcctgactgtgccctccataactcccacgttgcaggccacagcccctgttaacccctctcacagtccacccggctcttgaacctgcgctgggctttctggcatctctctctccttgtgcctgctggtccctcggtggagcgcctttcctcctcctcttgccccagcaagcctggcttgaaccccaggactgctttgtgaagccttcctcaggtccccccagcccttggttcatgggtcccagactcaggtgtctccagggaccaggctgataatataaaagaggagagtgtctagattatgcaatgataatgtcatctgccccttcaccccagggctgggtggcagtggggagtggtggggtctggcgcaagctggagagtccacacccccatccccaggggcagcttattgctgccaggtgggagtgcaggctcactgttgccacagcctccagttcttcaagagaagccagaagttaagaacttttggacaaactttccaatttaagaactgttcgctctcgccgggtaccgtggctcacacctgtagtcccagcactttgggaggctgaggcgggtggattacttgaggtcaggagttcaagaccagccttaccaacatggcgaaaccccgtctctactaaaaatacaaaaattagccaggtgtggtggtgcatgcctgtagtcccagctattcaggaggttgaggcagaattgcttgaacccgggaggcagatgttgcagtgagctgagatcatgccactgcactccagcctgggtgacagagtgagactctgtctcaaaaagcctaaagaccaaaacaaaacaaaagaaaacaaaacaaatgaaaactgttgactcaaatcaaaacattacagcgaccaagctgagcattcctgcagattgagcttgggcagccctggcatatggtcaggtcggttggccccccgtctggcttcgtcttttctgacactaacagggttgcactatcatagtttactccctctccaggccctcccccaagtctgtgcctcttccaagagaggagtccctccttgtttatctctgtgatgtccccagagcctgcggaggctctgggggacaggacgagcgggagctgtaaggactgaggaccgacaatgctcctgccaggctccatgctcctgcctctactcactgccccacttagttccacaccaagagcgaggcaggggctgtgagaatgctgcctttatggaggaagaaagggggtcggagagggaaggatttgcccagtcatggggtgtgaagtggggcagctagaacaaaataggatctattttcgttcccaaggccaagcacatcacaggggtgcagtatgctctctctgtctctctctctcccctaggtcagggtggtccctggggaggcccctgggttaccccaagacaggtgggaggagcttcctacccgaccctcttcctgtcaacctgggctctgcggctcccagggctgctccttgtattggggccccagcctggctggtaacagagggtccctccactgggctcagtcttctgagcatgctctgcccccaggaacctggaggatggaagttgggggccctgggtcccttccaaatgcccttgggtcctgtgcctggtccccagtgcccattttcagagcccctggcccctccctgccttgtggactgtgtgacgtgatgccagtcccctgggtccaggggcatggcagccggcggagaggcctctgcggccccgatgtctccttgagtggcttgactctgccagcccagcggtggcccagctaaatataccctggctgacgtcaagcactcttctgctcctggggtttttcttaagctgcatttatagtttgcgtattgctttgtaaagatgtaaaaatttcactttttttttttgttttgccccttagcagactgtcttattgagtgtagtcttagatgattatgaaaatcatttacagctgccgcattaggaagctggcgtgtgtgcagaggcagggcattttggtcaatgttggtctttaggtgaagaaaacttccctcccttcccccagtcacgcacatgctcacacacgcacacatgcgctcacacaggcacacacacgctcacacgtgctcacacatgcacacacgtgctcacacgtgtacacacgctcacaccgcacacacgcacacccgtgctcacacgcacacatgctcacacatggacacacgctcacacacgcgctcacacgtacacacgctcacagcacacacacatgttcacacacaacctcacacgcacacacgtgctcacacacgcacacatgtgctcacgtgcacacaggtgctcacacacacacatgcacacacgtgctcgcacacgcacacatgctcacacacgcaaacacgtgcccacaatgcacacacatgctcacacgcgcacacacacgtacacatacactttccttctctcctttcctctttgtttctcaccacctccacaaggccacggaaggggctacttgggctgggctgggcaggggggtgtgagctgcctcctggggcccagcctgggaggaagggtcagcatgcttcctctgggaggaggcttggccaacttctctccgtaggtctctggcttacctgggcctaatcccttctttctttttctgggctctctttgtctctctcctaggccagggcggtccctgaggaggctcccctaggccacccactagacgggtgggaggagcttcctaccccactctctccctgtcaagctgggctccgcagctcccagggctgctccttgggttggggccccagcctggctggtaaaagagggtctctctgctgggcttggtcctctgaacatgctctgcctccaggaacctggaggatggaagttggggggccctgggccccttccaaatgccctcctccctgtcttttctgccctggcagtgatgccccacagctctgtgtctacctggagacctcagccctctgcttggggtccaagtctctgttccatatgcccctatggaactcccccctccatggcagcaggagcaaaggctctgaggcaagtgtgcaccagtgtcagcaggagcagctgggaggccggttggtggagtgaagtcagggagggtgcatgtaggaggataacgctgagtctgagtgtcccatggcacgtgggagagaggatggattttatctgagtgtcccatggctcgcaggagagaagatagattttattctaagcatgataagaagcagttggagggttttagttgtggtgggagtggaggggggaaacaaatgatcctgtttgcacttggaagggctcactctgcctgctggggagaagggctcaggggccaggagtggagtaggaggctgcagctgctcccaggcgaggggcagtgaggcgtgagcaggacatggccaccgtcgcgggggaagtggttggattcacaggtgacatttgccagtagacaaggagtgtgggaacagggagaattcaggacgcctcaagtcctaggacgtggcaggtgcagatgccagatgccatctatgtgtttcatatgagaaggtaaaaagcaggtggaagggaccctctgcagcctctagtccacgctgttctggttgttcccaagcgctcttgctcgccttggtttggccgggactgatcatcagggtcagccctttcattctggtaggaattggaaggattctaggcaggtgtgggagttgaggctgaacctcctgagggatcagaagctggcagggccctggattagggcagcaccacgggtttccataaacgctccttcgtgtctctctttgcatgtcctcagagcgggatgccttcgacacgctgttcgaccacgccccggataagctcagcgtggtgaagaaggtgagctattggtgggatgttggatgtgctctcccctggctcgcggctttttgacagcacaaacgccccgctgggaagaaggtgggaaaatgtttggaatctcagaaatgtttgccacatggattgaaatgtaattacagtcaaaaacctaaccacagtgcataaaatcagcgccttttaactcaacctcgctgctccctgggtgtcttcctgcccgcccgctccgcttctgttaagtgaattacccagcccccatttctttctgactcgagaccttttttcaatgtggaaatgtttttaagcatgtcagcctgctgctctcgctggcctcatttaccatctacagcctgcccagtaaacacgcaggcctgtgcggctgagctgtgccatacatggatttggcccgtttccctccagacagagaatgggccctcactagcccaggcagcctgctggtcaatctgtggatggaaaaatctccgaggctctggagttgggggctgggtgtgatcagcttctgggggatctgccagggaggcttgttcccgtcaaaaggaactggagcccactggctgctcattaacttatccgagtgcctgcaggcatcccattcaggaggctgctgcatccctccttcccataacatcggaggagcgctcatttcaacccatggtgcaggcaagagagttctcctttgtctaggacagcttacccaaacagctttcttagtgcaagacttgtcagaacctttaataggctgacctatactgtacttctccaagagggagcttggtaggaagcatttttcaaacttgtttgtttatagtgggatttatttatctatcaattttggggtaagacgcattgtattttagtggaacccacttttggaaaatgttggcctgggtttggacgatgagatcattcatttttggaagcattttgcaaaaggctgttggaaccgtgctaatggtccttctgggacaaagccttcctagcactcttgggtggtgagggatatacttggagcatcagagtcccccacctccacctcgtcacatgtggcccccagggaccctgacagaaccggttcagggaatgaatcaaatccagcttccccacttatcagctgtgtgacttctggcgaagggcgagattataccccccagcctcagtttccccatctgtcaagtggggacagagatgttacccacctctcagggcactgtgaggataaactgggattctctctgtgcatgggcttagccggcagcgtatagtcactggtagcattgagaatggtgtggcctgagattgctttcatctctcggtagataccatgttaattcattctgcgaaagacacattttcggcactggagccaccagcaaggaagaagacagaatcctttgatttgcctggtagcttcccactccagcctgtcccttcctcacctccacattgcaagtttaggtgtctgtagctctctgtgccccagaatgaagtcaggggcccctgcccacctctgcaggtttctccctgggtcgtcccctcctactccttcccatcccacccacatccagccacagcctgaagaccccaaagggtttgcagatgtgtctgggtgcccactcggctcactctcaccttgcactggcccaccctcaggcccagctccaatgctccctctccatggtcttaacgggggtccgcacacccattaatggctcatgaaatctcccttgcattgcgtgtttccctgtagtgccctatctcttgacttctccgtcccaccactacacgcatatggagaattacatcacaggccctttggcgggggccaggggtggagctctctgtgtttgtgtccttagcaccaagcagcatgcctggcacatagtagctgctcagtaaatttgagcagaatgggtaagaaatcatatcatgggcaggctgggcgcggtggctcacgcctgtaatcctagcactttggaaggccgaggtgggtggatcacaaggtcaggagatcgagaccatcctggctaacatggcaaaaacccgtctctactaaaaaatacaaaaaaattaggtgggcatggtggtgggcacccttagtcccagctactcgggaggctgaggcaggagaatggcgtgaacccgggaggtggagcttgcagtgagccgagattgcgccactgcactccagcctgggcaacagagcgagactccatctcaaaacaaaacgaaacaaaacaaaacaaaacaaaacaaaacaaagaaatcatgtcatgggcagtggtggatgatattgagtttctatcaaagttggctttggtcactgaggaattacaggtgacaggttttaagcttgtgccggagagaagccagtgccccttggtacttacataatagggctcagagagatcaccctgggtggatctccccatgtattgcaaatcgataggcaggctgggcgctgtggctcacacctgtaatttcagcactttgggaggccaaagtgggtggatcacctgaggtctggagttcgagaccagcctgatcagcatggggaaactccatttctactaaaaatacaaaattagccgggcttggtgacgggtgcttgtaatcccaactactcgggaggctgaggcaggagaatcgcttgaacctgggaggtggaggttgcagtgagctgggatcatgccattgcactctagccggggcaccaaaagctcggatgatcctcagtggtctggggtgcaggcttcaaacctgtagctgtctagtgacagagtggttcaattccacctttgtaggcccggcgcagtggctcacgcctataatcccagcactttgggaggccaaggcgggtggatcacgaggtcaggagatcgagaccatcctggctaacacagtgaaaccccatctctactaaaaatacaaaaaaattagctgggcgtggtggcaggcgcctgtagtcccagctactcgggaggctgaggcaggagaatgatgtgaacccggtgaacccgggaggcggagcttgcaatgagccgagatcacgccactgcactccagcctgggcgacagagtgagactgtctcaaaaaaaaaaaaaaaaaaaaaaaaaaaattcagtaggtgtggctcaaggcagcactttcctcagtcttctgagtatgccgtttattgttccaggtcacacctaagatacatttgcaaatgtaatgatcctcccctggcagtttcatctttcttaagagcacagggtgctctccagtatgattgttaaatatgtcatgcgtgcacggattggcatatgtgtgcatgggttggtgagcagagacgtgtagccaggatagatgtgggcattatgccatgaaaactaggggctactgtcaggatattgagtttgaaacatgggctttttattttagcaaacaggagatgatgaaagcgtttcacagagctggggctggcaaatgtcaagcctgcccctccagatgggacctgcatgcgggccattcatggctcctgtgtctcttttattcttggcagtctctcatcacttttgtgaacaagcacctgaacaagctgaatttggaggtgacggaactggagacccaggtatgtgctgctttggcttgaaggatcctttgtccaccgccattttcagtcagtgttttgatcccaggtggggcgcgtgaacaaagctggcgccattttgttcatctcacaaggaactcccgtggtgcaggcagaaataaccaccgtggccttctcagcccctctgtcttcctttcctggggctgctgccacaaagcaccacaaacctagtggctgaaacaacagacctttgtgtcctcgaagtgctggaggcctgaagtccaaaatcaagatggggcctgggtgggttccctccaaggctgtgagggaggagctgttcctggcctccctcccagcttctgtggttttgccaggatctttagcattccttggcttgtacacacatcactcccttctttgccttcatcttcatgtggtgtcgtccttgtgtgtgtgtctctgtgtccaaatgtcccccttttatcaggacgtggtcatgttggattagagcccacccatggcttcatcccaacctgactgcatctatgtaaaccctgtttccagatacggtcacattcagaggtcctggtgattagggttccactgtatcctttttctttctttttttttttttttaaagacagagtctcgctctgtcacccaggctggagtgcagtggtgtgatctcggctcactgcaacctccacctcccgggttccaaccattctcctgcctcagcctcccgagtagctgggactacaggtacatcccaccatgcccagctaatttttgtatttttagtaaagacggggtttcaccgtgttggccaggatggtctcgatctcctggcctcatgatctgcctgcctcagcctcccaaccactgtatctttttttgggagacacaaaaccccaaaacacctgagtggtgttattcaacccataacacactccagggctccaccccagcccaacacagggcctttgcacacgcagttcctctgtctagaacgtgctggccccttcagcctctgctcagtgctgctgtcacactgtggccaggacctagcaaatgtccccctggtaggtatgtacaacacatttcttctgcaataagtatatcaagtctacttccccagccccgacccctactcaaagctaaaggagcatccttaaattatatttttgggcactccgagagcattaaagacaaaatatgattttcccaggattagcagggtgcttgaatgcggaggtttttgagctcttggtacagacatccctaatgcacagctgatccttcttaaaccccaaggtgaatgcattcattcccttctctttctttaactttcctcatttgcttttctaattaaaaaactaattcaggttcattgtagaaatgtctgaaaatgcagataagcaaaacaaataaaaatcacccataatcccgtcacccggagatgaatgcacagagggttttgttcaggccttttctctacacatatagcgagtcatggacagtgtgggtctgtatataaaagcatcacggtctgtttttaatgtatatatttatttgtgtatcgttggccaacacatttcttattttccgcagtttacaaatgttgcacatttagcctcagattattttctgtttgagacgttagcaccccagaagccactgaggtgaaaagtaaaaatcttcctttctctttttctggagacctcccccttcagactctccaggggcagctaactgcagttcatggttggatgtgtatttttctagatattttctttttctttctttctttttttttgagacagagtctcattctgtcccccaggctggagtgcagtgacacaatctcagctcactgcaacctccacctcctgggttcaagcaattctcctccctcagcctcctgagtagctgggactacaggtgcgcctcaccatgcctggctaatttttttgtatttttagtagagatggggtttcaccatgttggtcaggctggtctcgaactcctgaccttgtgatccacctgcctcagcctcccaaagtgttgggattacaggtgtgagccacattttctatgcacaaaggtatttttctaaataacagtggatcttaccgcccactgttttgtaatgtgttttgtgtcactaaatacactgtgggcatcttttggtgtaagagaaagtgtgtgtgtgtgtttctatctgatcctttttcccttgctcgatctatcggtctgtctatattttgtcacttttaatgggaagtgtatctcatcagcgggaaggctgcactgcacctcattaaaccagtgcctcacgactggatgtttttctgctcctgtaaacagcagtgcagagagcagctttgtgcacggctgtctgtgctcgtgcctgcttcctcggaataaaagcctagaagtggagtcattagagcgaagcctgcaccgcacactttgaaggctcaggaagatttgctgtgtgggggcccctggtactgtcatggggcgtgtgaggggcactgctcccccacatccataccagctgtccccacagcccttctcagaggtgtctgcacatcagtattagcagctgagcctcttacattgagactctaaaattaaatttgcatttgtttttatttactcaatatcttcatttttttccccccgattaatcgtactatatagagtcttaaaagtacatttaaccactggtcccccagaaaaggtcgctggttacagaaatgcagggatttttgttttgttttgttgcaaaggaatttgggtatttttataaataccatatatcatttatgaagactgtaaatcattaacgtcttgatgccctaggagtcggagaggccctggtttaatttcttcaatttctatttgtgtgtgggtgagtgtggtttatgtagtctggtatgtgtggtttatgcagtctgttgggggtgtgtgtgtgtgtgtggtttatgtagtctggtgggtgtgtgtgtgtgtgtgtgtgtggtttatgtagtctggtgtgtgtgtgtgtggtttatgtagtctggtgtgtgtgtgtggtttatgtagtctgtgtggtgtgtgtgtgtatttgtggtttacgtagtctgtgtggtgtgtggtgtgtgtggttttcgttgtctgtgtggtgtgtgtgtgtggttaagtagtctgtgtggtgtgtgtgtggtttatgcagtctgtgtggtgtgtgtgtggtttatgtagtctgtgtggtgtgatgtgtgtgtgtagtttttgtagtctgtgtggtgtgtgttgtgtgtgtggtttatgcagtctgtggtgggggtgtgtgtgtgtggtttttgtagtctgtgtagtgtgtggtgtgtgtgtggtttatgcagtctgtgtggtgtgatgtgtgtgtgtgtgtgtggtttttgtagtctgtgtggtgtgtgtgtggtttttgtagtctgtgtggtgtgtgtgtgtggtttttgtagtctgtgtggtgtgtgtgtgtgtgtgtgtgtggtttttgtagtctgtgtggtgtgtgtgtggtgtaggtgtgtgttttccctccttttccaaaccattcttacattgcggacagcgtcccagctctgtgatggtgagtgaactcctcagcctccctgagcttctgtccacagaattaaactggaggcgatgggcagtgtgaggactgggtgagatggcgcactgagatcaagtgggcagggctcggcaggggttagcactgcggatgaggaggcggtggtggggcctctgggcctccgtggggattctgctccctgctgagctagacagcaggttgtggagagagggcaccacgctgggtgcttgtgaaagtggagggtcacccgctcgcagctgggccccccagccctgccctctccttgtggccgtccctccctccttcctgtgagcccgtgtgctgggacagtgaggagacaccacggaaggaagaaaagactcagcaggctcagggcctgcgggagcagcggcgtggccaccccagacctcctggggagaggtgtgggttggtgccttcattcacgtggcagcttccattccctggaagttagtccatggagacgtgggcatggcagctcaatgttgttctgctgggaaggtgccagcacgcttaaccagggtgctgtgggcatgaagcttccatgtggagacacacttaaaagaattcttcaaacccgtctgatctccttaatgataggagtggctggctgctttgtggtgtggaaggctgagggcatgtgacatggaggccaagtgccatttgcccatcaactgacagcgtgttgaatttccaggcgcagtggctcatgcctgcaatcctagcactttgggtggccgaggtgggtggatcatgaggtcaggagttcaagaccagcctgaccaacatggtgaaaccccatctctactaaaaatacaaaaattggcgggtatggtggcacgcgcctgtaatcccagctactcaggaggcggaggcagaagaattgcttgaacccaggaggcagaggttgctgtgagccgaggttgcagtgagccgagatcgcaccactgcactccagcagggcccagaccctgtcctgagtcccttaagggactgttgcccactggcactagctttatgctttacagctctagctgcagctctccctgctaaaggtcagggcttctgatattggatgtttgtgattttgacttttcatctttttttttttttttttttgagacagtttcactcctgttacccaggccggagtacagtggcgcgatcgcggctcactgcaacctctgccttccgggttaaagcgattctcctgcctcaacctcccgagtagctgggattacaggcatgcaccaccacacccgctaatttttgtatttttactagagacggggtttcaccctgttggtcaggctggtcttgaactcctgaccttgtgatccacccaccttggccacccaaagtgctaggattacaggcgtgagccactgcgcctagaagtttttacttttaatttttttaaaaattcaaatttaagaattctggagattgtttgtacaataacgtgaatgcacctaacatgattgaactggacagttaaaagtagttaagatggtaaatgttatggtatattttatggtatattttaccacaatttaaattaattaaagagaaaggttagcataagcgagacacaaaagataaatggatatgcgattccacttacgtgagatacccagaggagtcaaattcatagagacagagagcagaatgattggtggttctcaggggctggggggaaggtagaatagagaattgggggacagagtgtcactttggtaacatgaagaagttctggagatgggtggtggtgagggtgacccaacaatgaggatgtacttaatgctactggcctgtgcgcttacacacggttaagatggtacatttcagcttatgtatattttatcacaataaaaaataagttagcaacattcaaacaaaaacattttaatttaaatagctgcatgtggccattggctaccatgttgaatagcagctccagaggccccctggagaatggggccacagtcactgtggtctctgctgcaagacagagtggtgagggccaccaggtcccagctctgcaccctgcagatttgaatgaatccttccagcagctgatgctgatggagcactcacgtgtgccaggtgctccctcccagccgtctcgctgtgtcttcacgacagccctgaatgatgggagtcactactatccctggggtcaggagtgggggacagttccagaggcacggtcctagccaggcagctgcactcagctccaaacactcatcatatttggtctttgcagagccccatgtgttagagccccctccccttttgcttttttctaggttaggagccaggtctcaaaagacttcacattcaggccttcacttgattccagattctcctgcctaaagtgagaggagggatggattgctttactttaaaatatttccagctgggtacagtggctcccacccgtaatcccagcactttgggaggctgaggcaagtagatcacttgagcccaggaatttgagaccagcctgggcaacatggtgaaaccctgtctctacaaaaaatacaaaaattagccgggcatggtggtgcgtgcctgtagtcccagctacttgggaggctgaggtgggagaatcgcctcagggaggatcacctgagcctgggaggccgagctgcagtgagccttgattgcatcagtgcactccagcctgggtgacagagtgagaccctgtctcagaagaaaaaatatgccccccttaagtttgtgcaaagcatttgccaactccttaccctgcccggaaacatcacaagtctttctctgcagtttgcagatggcgtgtacctggttctgctcatgggccttctggaagactactttgttcctctccaccacttctacctgactccggaaagcttcgatcagaaggtatgtgcatggtctccatccttggtaggggctcaagaaatgctcattgaaatgcagagcatagactatcccggcagctcttcctgcagcctggctgcattcttcagaaagtaaaaaatgcacaagtgatattgcaattagatgtaactctcagcaaaagaaataagaagcccatcagccgtccacaacgcatccgagttttgtttgccacattttctttgcggtcttttccatgggaccgtgtagtttttaataattgtgatcacatctcggtagagttgtaaacccttcccccattctgctgcagctccaccacctgtggttttccctgctgcttcccaagctttccaaataccatctccagtggtggcacgaagtcccaaggatggctctgttaccagcgtctttccattccccattcttgggcagtcaacttgaacatgtttctattgtttttccctactgaaacaacagagcatctttttgatacagattttttttttcattcctgtggattgttttcttaggaaaatttctcaaatagggtcaaatttggggcattcctttcaatctgggctggcccacgccacccggtcccgctgtcactgccctcgtgcgtgggcctctccctgctgtctgccctctgtccagggcttcccgcagccaagcctctcacagcagtatttagcacattgcctttaaaaacttggccatggatggtctatgttgctttggattcatgggcatctgtcattttattttcccaaagtgttagacccatgagtcagggaggcagacaatgtaagctggtggcgacagccagagaaatagcagaaatggggccagtgtttatcaatctgcccacttctggcacgttgcagtctgtttgcttgtggccaaatgttgttcctatcttgcctgctgagatggaatcaggacagattagagaggtcttggcacatggagtccatgttgaatcgagagagagagagcgagcgagcgagcaagagggagtgcagagggaatgagcagaattgtgcagaactcaccaggaaactcaccaggtgcctgtgctgtcatcctggaaatgaaaggtcagaccatccagcgaagaagcgcatgcatttccaggccccgatatggctggttgcagacacattgttttggagagatcttttctttcttcaaactagtaagaatgctggcgagaacagtgagtttagccaggagacctagggctggtttctttccaagacaaggctttgtacaaatgtcagaggcatcatctcctgggccctggccttcttccctttgaaactgggatgaaagtctttgacaattgctgccctggcctgcgaggcttgaggaggcttgagtcatctgccttcccctctgaatcggagcgaggaagggaaggctattttcaggtatagcatgcagcacaccattcatcctgttcactcaggagaaagggagcctggggtggcggtgtggctctgcgggtggctggaacactctccttcggaggatgggaggctgtcagtagttcctcctccagcccctgccttttttccctttctcctcatggcagctgctggcaaggtcttcatgagcccatagtatttattatctaccttgtagtcttcgtgaatcctggacaggtgggtggtccctgctgtggaggactcacccacttcaggctgggcccaacacccgtgtactcaaaactgcttgcggatgggatgttgatggcatcccttgctaatgtctcctgtgggctgagaccccgaggtgcgtttgctctggccctgggaatcctgacagctgctccacatttttgggaggagggactgaggttcagtgagcaaaaccagagatgcgtcatgagctgctgtccccgagggtagtaatgacttatggtttaaaacaattgcattggatttaaaaaatatcacactggacagctcagagcctgtaggctcgtgccccatgagctatctcagaggcatgagtgtggccttcagtttttttgttgcaaagccactgtttgagccttaccctgcactggccacgtgctgagcaccttgcacccattggtcatcattttgggagactctgcaggctccctctctctgtcgagtggggtgcatcctggagacgtggagatctttcctagaagaagacacgagttgcttccccctcagcattactggatgaggacagggaatctcaggaaggcttagagaccagcccagggttgcacggccagcaagggcagagccaggagggtcgactcctattccagaaccctctattctttcctcacctggccaagttgattaaaaccttttgaattgcagagagaaaggatttctgcccatgtggctggctcgaagcaggtgtgtatatggcctggtctctgctgggccttggggcctcctactgcagtcacagctggggtgagcggtccccaggcctctccgggatccatgtgctgggtatccagggatctaggctcaggggacacttctctgcctggcatgaaagagggctgggggaggaggcatggccttgagagataacaggcatgggagggtggcaatttcctgcctggcatttcctcagcctgagaagaaagcagaaggaaaatctcacttcaaaaccacttactgtggggccgagcggctgcagagcaatgaggcttggaaggggctttgctctccccttaaactgttctctcatggtgtaggggtgaccacctcgtcacccgatcacactctccagccgtctctgagtgtctccacgtgtcatgcatctcatccccagcccctcctgagcatccactccctcagcgtggaagaggattcctcaggcttaagaggtgcacgggagaggcacgtgaaaagaccggtccaaattggtgctgacttttacaatggagaagaatcttttcttaaaagaaaaatcttttctcgctattccctctctttgctatcctgtctccatctcgatttggggtcaagcctgttgtgtgtgtgtgtgtgtgcacgtgtgcatgtgcatacgtgtgtgtgagctcatttgatgatatggacggtggtcagctaaagggacctgtgttgctaggggagtggaggtgggaggctcttggaggagaacgggcacagattctacgtttcagtcctggttccatgcctgtgagccccgtgccttgtttttcttttcttttttttttttttttggaggcggggaaggaatctcactctctcacccaggctggagtgcagtggcacgatctcggctcactgcaacccccgcctcctgggttcaagcgattcttctgcctcagcctccttagtagctgggattacaggcacatgccaccatgcctggctaatttttgtatttttagtagagacggggttttaccatgttggccaggctggtcttgaactccagacctcatgatccacccgcctcagcctcccaaagtgctgggattacaggcgtgagccactacatccagctgccccatgcctttttagggcaccgatgtcctagcccatctcagcccagcaccaccctcctttgtgaaggaagatgatattcacctcgtacagggctgggaggggaaagggaacctgtatggaatacactgaccccatggtggatgcacagcacccgcaggtcgctccctgctctctccttaggggaactgcgttctgcaccctccgcacgggccgtcctcactcctcccccattgccagtgtttggccatcctcaggcccagccctggtgcagcactcccgcatctccaggcaggctgtcctgcagggttggggtgtctgccatgtggcccagtgttcccattggcagtttctgagttggcctctggagcagggtctccgtctgctgcacccccgcccctgggtggacatggcctgccctcctgccgggctgtgtcttccccactgaccctatgactagccagaccctcttgcggttggtgctggcaggtcattcgcccctttgcttctccgagcacaggccgtgtgcactgtggaagcttttccaaagcaccccacactgttttccagtgttgttcgtttgattaactcagggaagcctctttttcctggttaattattaaattacattgcaagtaaaattgttcttgtttctgattcattggcctcaaaatcatgaaaatatgatcgttgaaaggattttttgtttgtttgtttgcttgtttttttgagacagagtgttgctctgtcacccaggctggagtgcagtggcacaatctcagctcactgcaacctccgcctcctgggttcaagcgattctcatgcctcagccacccaaatagctgggattacaggtgtgcaccaccatgcccggctaatttttgtatttttagtagagatggggtttcacccattggtcaggctggtctcgaatgcctgacttcaactgatccacctgcctcggcctcacaaagtgctgggattacaggtgtgagctaccacgcccagccaggatgtttgattactaagagccctgaagtcccttgcactgtgacatctgtgcttgtttgctgtttgtttgtttgatgtcccctcctcccatcagccttggcttgcggcaggtgggtggctggatgtaatctggttcattgccggcatccctctgagtggtctttaaacacagcccagaaggcttttattttaaacctgttcagccatcattagcaggataaaagcttcaggtacatttgggggctgaggagtaatagaccctttaatttcaggggaagtcacggtagggcggaggtggccacgtttctgtagcatctaacaggaccaaggtcctgcaggctgacgcttgcagccaccatcgatctgacttccgttctgactggtccactgtccctactcagtgctaaggccctccctcccctgagggcaccccatcctgcagagacacagcctcacgtgcaggtctttacagcccttcctggggcagtgccaggcctgcgtgcctctgcacgggactcatcctttctgggcctcagtttccctgtctgtgaaatggggtcactgtgggccaggcgcagcggctcacgcctgtaattccagcactttgggaggctgaggcgggtggatcatttgagcccaagagttagagactagcctgaccaacatggcaaaacccgtctctaaaaaaaataataataatacaaaaattagccgggcacagtgatgcgtgcctgtagtcccaactactggggaagctgaggcaggaagatggcttgagcctgggaggtggaggttgcagtgagctgagatctcgccactgtgcactagcctgcgctctagaccctgtctcaaaaaacgtaaataaataaataaacaaagaaataataaataaaatggggcccctgtgacttctcatcaggtggctggcatctggggcagagcaggctcttggtggccgtgagccctcgagagcaggccgggcacctcatccttccatctctcagcccagatcactggtgtgaggggtgagaaccacctagtaagcgcacatggccctccgcagacttcctcacccgtgtctgcccaccctgtggcccgccccgggctcactgggtccttgtggacgtcagcgttgcagaggctcggtcctgtccatgccggctgtcctccagcagtgggccgtgtgtgggaacgactgttggaccctaacgctgacccaccccccttccttggcaggtccacaatgtgtccttcgcctttgagctgatgctggacggaggcctcaagaaacccaaggctcgtcctgaaggtaatgcccctggctcaggttcccccgggagaggtgcgcacggaggggaagaaaaacgggtcctagaagtggctggaaggctggcatgttgttccccagatgggccccacgtctctggctctggggcaagggtctgccaaccccagctcctcagtctcctcattttgggaaccaggaggacttcgctggtggagctggcagtgccggttctttaataaccacttgactttgaaggacgtggcctctgcccacagacctcaggattaagtgcgtctctagctggccactcaggctggaaatgcagcttcgtgccctgagaagaaattaaaggcttactcaactgtaatgactgttgggctggaggtcccctgatgctcagccaaaggcagtacttggtagcagggacttggcatgctctgcgtgggtcggagctggaggcaggaggccagcagagctggggcgggcggttgcttccctgtcccccccccggctcctgtgccaagttacctataggaggactctctaacctgagtgagcatcacagttccccaaacacacttcctaggtgtttggggacagccaggctcagcagaacatgggtggcactgcctgtgaaccctgctggaaagttacagggcagagctgaacattaaaggctttgacaagtcctatatgaagacatctgtttgcctccatcaaaacctttgccatgcaggaggagcccacagaactcagacactgtggtttagtgccctgggcccccactttgaccgtggccccctacctagccctgctccctctcctgagtcccccatggtgctatatgagttgggagcccatgatgcttcctacacctgttgccagcatccgctcaacggcgggctttgtagagtctccaaaatagctagaaaatggatcctgtcccttccatctacccactgcagccaccgcttcctgccagtccacgcggaaggttcctggccggtcccttcctgcctgttcatcctcctcttggggtttcacaggacaatttcacaccctcctgtctcgtgtgtatggctgtttattcttttttgttttgagacagggtctcactctgttgcccaggctggagtgcagtggtatgatcacagctcactgcaacctcttcctcttgggttcacagcatcctcccacctcagtctgtcgagtaactgggactaaggcgcataccaccatgcccggctaatgttttaacttttcttttttgtagagacaaggtctcactatgttgcccagactggtctcgaacttctgggctcaagcgattcgcccattacaggcacgagcccccatgcctggccttgtttattttttattgtccctccctccccactagaacagaagcctcaagggagcagggctttgtcccctgcatgccggtgctgagaatggtgcctggcctggaaactgctcgacagcacggatcaaagcacatgtccagcagggagtgtggcgagctgctgcctgtagataccggcccggcctgggtctctgggacccctcgttgctgctgccctgcagcccttttgttgctgtgaggcagggccatgagggagtggctagaggcccgagggatgctgctttgcctctccccagctgtgcatccttgaacaggttactttgcctttctgtgccagggcctcctcctctgttgaggggagtgatgatggcacctgcctccacgcgtcatggggtcgctggatggggggcggatgttcatcacacaggacttgtcagagccttcactgttcaactctgccctgtaactttccagcagggcccacgggcagtgccaccacgtgctgctgagcctgactgctcctgagcacctattacgctcaagtgagctgctcccatgagcactggaagagggtcctgcccacagaacacaccaggtccctgctgatggtggctgctagctcggcgttagtgtctggtgggtcgcacactgtcagggaggagaaatccttgctcatgtccactgtgggcttggctggggcttcctttagtttcctgtagcccaaagcctgggccctatctgcagcatggggtgcttcccccgtaccctcagaagagcccctggtggccctttgcctctgagctgctgagggagccctgcttctttgtcctcccgaacccacgactttttttttctgagacagagtcttactttgtcacccaggctggagtgcagtggcgcgatcccagctcactgcaatctccgcctcctaggttcaagcaactctcttgcctcagcctcacaagtagctgggattacaggcacccgccaccatgcctggctaatttttctatttttagtagagatggggtttcaccatgttggccaggctggtcttgaactcctgacctcaggtgatccacctgccttgccctcccaaagagctggggttacaggtgtgagccaccacacctggccctttgtcccgtttttgaggagtgaggcaggagcctgtccagaggccaggatatcctctgacaggccggcctcctaggagggtgtttgcccctgagcccggatgtgtttcctactcatctgccgctggacggcacgttagggaacccaccacggacgtgtggaaaccaggccagaggcagaggcactggtccagggcaaatagcaagttctgcagcctcccaggcagggtcccttgggtgtcccagggcctctgtccagcccaggcagggggcagagctggtctgcagtgctcattagcaccttcgctgggccagcactgggcaggggccaagccgcagagatttatgagatggggtccctgctgggcctctttattttgtggctgatgcaatgaatgagagacttttccttcttcattcaaaatcagctggggagcaagaatcaggaggtaacagagataagaatgacacggagaatggggtgcagtggctgcggtctccctgacaccctcctctgagctaggcagacttacccgggtacccagggctggtggggagggaggcagtggctgtggcctcccctgcaggcctgagactgccctgttggtccccacccggaggaagcagagcagtctcacaccccctgcacgtgggcgggtctgaagagccaggcctgcacctggttccctaggcccccagcaatgatgggcatcctggccccctgcccccttgtggggacctggcggagactccagtggggtccccgaccctgctcttaaggaggccccttgcctgggagaaaggcttgtggctcgctccaaattcacagagccgagtgcggagctcgatggtggggtgggtgtttggggagcacagagggactgaggttcatgggtcacagaaggtgattcctatccctgggcgcaggtgctaaggggtggctgtggttagcaggtctggcaggggtgtgagggttaagttctgtttgtccagcgaggctgtctggaagttctcagagctcagacctgggggctgctgcgtgggggcatcggtgtcaggctgctgctctggtctccctgtgagtccaccatgggagtggagtcagagggggccaggaggtgatggcccccacccctgggagctcctctgtccttgctgcccccctcgccttggccacctccaactccatggccgccattctccctcccctgcctccactgggctgttgggagctggggtggactcttcaggtcagggggagaccctgggatccctgacagagccccgggtgtgtccccaagcccgccgagccgagttccccgacagagccccgggtgtgtccccaagcccaccgagctgagttcagccctgcttttgctctgacagcacactcgtgggcaggtcatttctccatgtgagtcttggtcctctttgtaaaacgagagggaaggaaaggaggctgtgcaggctctgatgagggtgtgtgagtcgagaaactccatgcccagtgacaaggacagttgctgattcttagcatccaccccacctgctctctcagtaaccgatgtcgtttcttactcttgtgatcaggactaaagcacagggtcatcccatggctgcttttggatcacagggagtcaggactccaagggcctcgagcgttacctggtccaggcccattttacagatgaaggcactgagccccaaatcacggaagtcacttagaggtcacagagcaagtgaaatgaacaaggtgtctgattcccaggaaggttcttgtccacataaagaaagtggcccaagacttccagggccccagagggagctgtcgggtccattaagtgttactggggtttttggtcccggtaagtgtcattagccatgtcccccaaccggttcttagacatgtcctgatgcagatccaggaggggctgtgggagtgtctctgttcttgtcaccccaggtgcctgtccccgcagggtgtcagcccgcgccaggagctctcacaaaacctgtgtgtctggggaggcactgcccagagcgtcctggacatggtggtggccagtctttaaggggaagcgctgtgtgtggatgcggcagctggtgtcatgctggagacgtggcttctgagagtacctaccgcaatgacaggaggatggcacgcctctgaagtttctctgtttccttctgcagacgtggttaacttggacctcaaatccaccctgagggttctttacaacctgttcaccaagtacaagaacgtggagtgacgggggagctgtggatggtggcaggagtgtcccagcaagaaaggcggcatccgtctgtgccctgtgcctttccagggagccaggcgccatgggcttctggtccaagctgtgttgactgtcatccccaccccacccctacctcacgcctgccccaccccctgcctcttttggttgttgttcttaatctcctctccatgtagttcccagtgggcaagagcctttgaaaatgcaggattctaaacactcgtgcttgcgtttgaagcctcgcgtcactcagtcgcgtgggatgatgagtccgttgttgtctgccttggccgaaagatgaaaaaaagcctgaaccccaacccccagctggttgagagcaccctgcattctgcctcatggtgcagttagcgatcacaggccttcagaagtacaacatcagctcagcaggaacgccggctccccgaggacccaggcttgacgattcaccggggatctcctgggctgggctctccttggaagtgaggccttttattaaaaataaaagggttttgcagtttgaaaaactttaa

SEQ ID NO: 518 - DNA, 142930 bp, Homo sapiens
tgctgaatagaacgggcgtggaggcaggaggaggagcaggacgccgggcactgctgatgctgctttcgctgggggtgagctgggcgccctgcctcggttctcagggttggggtgcctggcaaacagagggccacaaaccctccttggatctaggcacaggaattgagggacaggctggattgggaagggtttagcggcttctgtgtggtctcctgggaagtggaagagtcaggaagactggataatgagggcttgaataattgagagtcgctggtatttccgcaagcccatttgccttggcaacatgcgcttctgccactccagggtggagcagcccctggccctgactttgggccgtcagagctatgctcggttgcctaccagggagtgacagggcgcttgggaggtttccacgaccctgcctgctgcaccgtcggcttcatttcctcctttgttagaaagttgagggtggatttgggagaacggatgtggctccgacatgttcctgagttgaggactctaagggaggagggggaagctgggggaaggggcgggctcatcggtgaggttccagattcaggcaggggtgtgacaaggcacggagggacttttgggagggatggttgggatgagtgacgtggcctgttccagaggagaggggttaggaaatgtggggccctggggtttggaggaagcagtgcaggaagtgtctgagaatgagcttcacggtgggcgtgattaaggctgatgtgctacgggaggcgtgtcacgtggtggcctgggtcagaaaagggaactgtgaccaactgtgggcattcagaaaatggaaaggaacgccggaaacccccagggctccccacagaagctctggggacgtgaaaggacagcgtgtttcaaacttgggttcagctttactggggcttggaggagcccgtgtgcagagaagaccaacaacacacagggttccccactgtgaccatgtgatgagaggccctgtaggtccagtgggccaggatggaggtcggggacagcccagctgctgctggaagtcctcagaggcggatggccggccctggccagtgtggaagaggtcgggtggagtgctccacacatttgccacaagaggcctgttctgtgctgcaccaggcactggacctcaggcgccactgcccagtggccagggtcaggtttctcagagacagctgaaggcagcggggcgagagcagccagtctggaggttctgtccctcttttctgagcaacacattcaggaagtttctatcccctgattaccttaaaaaatatgtatgtgtgggccaggtgaggtggctcacgcctgtaatcccagcactctgggaggccgaggtgggtggatcacctgaggtcgggaattcgagaccagcctggtcaacatggtgaaaccccatctccagtaaaaacgcaaaaattagccgggcatggtggcgtgtgcctgtaatcccagctacttgggaagctgaggcaggagaatcgcttgaacctgggaggtggaggttgcagtgagctgagattgcctcactgcgctgcaggctggtcaacagagtgagactccatatcaaatagaaaaaaaaaccatatatatatatatatatatatatattcatgtgtgtgtatatatattcacatatatatattgacgtatatttttaaagcagttttaggtttacagcgaaatctagcaaagaatacaaagtgtccccacctatcccttctcacctccatcagtgccccccggctgtgtggtagagtcgtgagccaacgctgagacatcattatctccgcaagctcatagtttacattaggggttgctcttgccgttggacattctgtggctctggatggatgtagagtgacatggacccaccattacagtcacctctggagcagcgtcactgaccccagaatcctctttctgctgcctatgcatccctccgtttccccaaatccctggcaaccacggatcatttttttgttttgtttttttggtttttgtttttgttttttttactgtatctgtgtttttgccttttccagactatcatctagttgtgatcataaagtgtacagtagcgttttcagattggcttcttccactcaatgatatacattgaaggcccttccatgtcttctcagggcttggtagctcattccttttttgactgaataatattccgttgtctggatgtgccagtttgttgatccattcacctgctgaaggacatcttggttgcttccaagttttggcagttatgaataaagctgctgtgtacatctacgtgtaggtttttgtgtggagataaggttttaattcatttgagctcaattgctggatcgtatggtaagagtgtgtctcgttttggaagaaactgccaaactctcttccaaagtggctgtgccacatttattcaccggtggcgaacgagagtcctggctgctctgcatcctcaccagtatttggtggtgtcagtgttctggattttggaattctgttaggtgtattgtggtgtcttgttgctgtttcaattcgcatttccctgatgaggtatgaagtggagcatctcttcagatgcttatttgccatctgtgtatcttcttcagtgaagtgtctattaaggtcattggctcatttgtattttatttatttttatttttattttatttttgagatagggtctcactgtagcccaggctggagtgcagtggcacgatcctggctcactgcagcctcaatctcctggggctcaagtgatcctcatgcctcagcttctggagtagttgggactacaggcacataccaccatgcccagctaatttttctattttttgtagagatggggtctcgctatgttacccaggctgctctcaaactcctggactcaggagatccacctgccttggcctcccaaagtgctaggattacatgcgtgagccacagtgcccggccttggcctatttttaaatctgcttgtttgtttccttactgttgagttggaagtgttcttcatatattttggatacaagtcatgtgttttgcaaatattttctcccagccagcggcttgtcttccctgtctcttgatcctgatatctcctaagcatttgatgtagagttaatgattaatgagcaagatattgagacctcatcaactagatctaaagaaatcactaggccagacacataatcccagcactttgggaggctgaggcaggtggatcacctaaggccaggagtttgagaccagcctggccaacgtggggaaacccggtctctactaaaaatagaaaaattagccaggcgtggtggctcacgcctgtaatcccagcactttgggaggctgaagcggcagatcacctgaggtcaggagtttgagaccagcctggccaacgtggtgaaaccccatctctactaaaaatacaaaaattagccgggcgtggtggcacacacctgtaatcccagctactcaggaggctgaggcaggagaatcactcgaacccgggaagcagaggttgcagtgagctgagatcgcgccactgcactccagcctgggagacaaagcgagactctgcctcaaaaaaaaaaaagaaaagaaaagaaatcactaggtagctgcgacattgaactgaaggttgaaagtattaagtttctttgtggactttaaataaccttcaggagagaaatctcaaagctctaaaccagcaaccgagaatttccttcagggcatccatcttttacacggagccatcagttgtgtagatgatgggttgccccaaaacactaagacgcaccagtgaagggaggggagctgtggcaggggggcctgcactgcccccgcctttccccccagcaacgcctgggctgggagctgggggtgggtgagaccctggctcaggccccactcaggacagtttgagggacaggcagatggggggactgagccatgggggtctcaccacccagacttggggttttgggcctccctggaggaagtggtcctggctgaatgtctaggatggatgtaaattagcccagggagggggagggggctcctgaggagacccccaggcaggctcccagtggctgagcaacggtgcagcctgtgggctgtggccagccctggtcgggggctggagaggtgagcagccctggcgtcccacaaacacaggagcttggaacccttgctggggcttggcaggggtggccgatttcagtggtgctttggggagtggggaatggacggaatgggggaacggcggggaggcaggctggcaggaatgtggcacggggcacaggcagtgccccgaggaggtggcgtgggtgggcgcaggcgtggctgtgatttccacgctgttttctagcgggctgcagcccctctgatgctgaaatgaaaaaggacccagatccttgtttgtgggaggggtgggaaaggatttgcaaggagtgtggtctcttttggacgatttttcagacttcttctcgtttccaggccctctgtgctcacgtgacccctctgatagcgtcagggcccgtagaaaagtggctgtggcatgttgggaaggccagcgggcctcctagccaacgaaaagggggagtggctggtccgaagttgggggatatagacaggtgagggaccagggccatagtcactgtggtttctatggggaagaggggatggtggaggtcctatttggagctgttgtgttgtgaggctctttacagaccctgccaacaaagagaaagacaattccacactgttatctctaaacccaaacctccttcgagcagaggccgtctccgtttggggatggacagctgttggtccaagaaggaaaggcacagtgaggtcactgcgacgctgcccagcaccttcatgggaaacgctcctcagggtggtgagtggaactccctggagaccattttccagtgagggcctatctctttcctcttgggctgagaggaagtgggtggctcagctacatttcctttgattattattctgactataatcttcaaaccctacatttctcattgtgtgttccgcccatgcgttctgttgtccggggcagcaaagtcgacctgcaccacgtgggtgtttttgttttcttttgttttgttttgttttcttgaaggcctactaagagctgtcggaaactctgcttctgtagaaaaggtaaaggcactgcttggccacaagtgatgactcttccctgcctttcggggcttggggaggaagggcaggttctcggtggttctcctagcaccttggttacaaacctcccagcagagtcagatcaccttggcaaccccacactcatcaaagggactctgccttgattccctccccaccgctgtggaattaatatcgattgcacatcctgaaattgcttaccctcgcgctccctgtccagtcgtcagaataattaaggggtgtttattggatgtaagtgggttcatccctgctgcgagtatggattttaagtgctccgttggattgattcctccctgctgtggttggcacagggcaggtacctttaccgagctgttttcttcttttcgaacatgcggttccatcacataaaagacataccctatgaaaatgtctctgccttagctgtacatgttacactttaggtttcaggtgaaaaattggtttatctcctaatatgtctgctatttgttacatcacatagaggctgcaaaacagattaataagctttggaggatattataagcatacgttggcccaatggtattaatttgcttatccatactaattgctgtcttggtaaaagaaggcggacacaatgcaatcaatcctagaagtgttctgtggctttgcaactttgagatacctcaggctgacatattcaaatgagagccttctctctggttacaagaaaaaaatggaatgagcagcagttttggcctcgtccagtctctagggctcccagcatctgggtagtaacatgatcagccctgggaaaccagcggagtcttttacctcctctgatgttctgactaagagtgtctgggccgtggggactgaacgcaccctttgaggctatgtgtgttaaagtttgggggcccatttcttcatttctaatatggggcagtgtgggcagatcccagctctgcgtttctgagctgctgagtttgccctggttctgagaatgcccgtcgcggtggtgcagtccgcctccttgcactggatctgttgcttcttctctctaagcctctgttcctgatggtcccttgtggagcaaagcagcacttgtggtgtaaggaaggaaagcctcatcagcaattgagtgagcgctcaatcagaattcgttatggatgaatgtggatgactggaggcattgacgcagacaccagagtccagagctggtacgtggtacagcagaagtggcaagtcagctcagtttaggacaagtacctaaccctgtgttgagaaggattctgtggctgagtctgggcttagggaaaaagaatgctgggaccagtcagccacactaccagtgtgtatggagggttagttgctgagtggctgtcacccccagaacaggagccttttccagctctagtgctgtgtcatttcagcagcactggctgctttattcccattgagtgccgtgcaacagctagttggctgttggtaacaaaagttgtgtgaatcgtttaagatattgcagtgagaatgttggtatcttaactcttcccctagctgtctgtggctaggaagcatctccagtgctattgtttttttcttgagacagagtcctgctctgttgcctaggctggactgcagtggcatgatctcggctcactgcagcctctgcctcctgggttcaagcgagcacatccagctaattttttatatttttagtaaagacaggatttcatcatgttggccaggctgatctcaaactcctgacctcaactgatccgcccacctcggcctcccaaagtgctgggattacaggagtgagccaccactcccggcccccaatacttttttgaggtatacttggctgagtaactgtttagcgtgtgcagagaagcaggtgtttctgagctggaattccttgtacccagaaatgtgagggcaactcacatgggcaccaggaggcatttttgccttcctcaccagcctacggcatcagagaacatttggcagtctctgagtgggagttctttacgcttgcctgatagtagttggaggcctgctcctttaagctttgccacttgaagtgatgagcttggttttggcctttgaacctttacctgccagccacccacaatcagtcggtaatgttggtttccccaagcaacgccatcttaggaatttctttgcttgttctcttacaaagtcatgcattattatacgtgttttcatttgaaaaattacagttccacaggatctagacttgaatgttaagctattaaaaagttaaagagggagtgaaaatgttagcactcctagggcctgcgtacgttgcttgctcaaatccagacgctcctggaagcagctgtctcagcggagccctgtctgcccttgttgttttctgcttctcaagttactccagactccagggaactagaactgaccaggccccactttaaacatgtggatggagtgcccctgacaaggctggagaaagggggaggtccggggcggggcctcatgcgcatatggtattcagagtttatttttgctataaatggaatttgaagaatatatatatatatatgaacatacaaataaaaatatataaagaatatatgtataaagaatataaagaataattttggaattcattgcattgtgtctgcattcttttactgcaacagcaattataattataattatattataaagaatatatattctttatacatatatatttgagatgggtgtctttatacatatatatgtttgagatgggtgtctttatacatatatatgtttgagatgggtgtctttatacatatatatgtttgagatgggggtctttatacatatatatttgagatgggggtctttatacatatatatatgtttgagatgggggtcttgctgtgttgcccaggctggagtgcagtggctgttcacaggccagatcatcagacactgtagccttgaactcctggcctcaagggatcctcctgccttagcctcctgagtagctgaaacaataggtgcacaccaccatgcccagctcttgagaagcatctggcccatagcttaatttgaagtgtcttcatccctgtcttttttctttttgttttaaaattaatagaattgacccttgaacagcacagggggaaagaggcactgacccccatgcagtcagaaatccacgtgtaacttttttttttttttttttttttgagacggagtttcgctcttgtcactaggctggagtgcagtggtgcaatcttggctcactgcaacccctgcctcccaggttcaagtgattctcctgcctcagcttcccgagtagctgggattacaggcgtgcaccaccacacccagctaatttttgtattattagtagagacagagtttcaccatgttggccaggctggtctcaaactcctggcctcagttgatccgctcacctcagccttccaaagtactggtattacaggcatgaacaactgcacccggccaccatgtgtaacttttgactcccacaaaacttaactagtgatagcctgctgttgactggaagcctcactgataacataaacaattaacaatattttgtatgttctatgcattatgtgctgtattcttactacaaagtgagcctgaggaaagaaaatgttattaggaaaatcataaggaagagaatatgcatttatagtactgtgctgtgtttattgatgctgcacgtttacaacatgcgtttacaagatgaatgctctgaagtggccggcaactgcagctgcagacctcaccctaccatacaacatctcaagctattcagcttcttggaatgtcacgcttttcttcttttctttttccttttttttttttttttttttgagacggagtctcgctctgttgcccaggctggagtgcaatggtgcgatctcggctcactgcagcctccgcctcctgggttcaagcgattctcctgcctcagcctcccaagtagctgggattacaggcatgtgccaccgtgcccggctgatttttttgtatttttagtagaaatggggtttcaccgtggtggccaggatggtctcgatctcctgaccttgtgatccgcctgcctcagcctcccaaagtgctgggattacgggtgtgagccaccgcgcccgtccgtcaaggcttcttgggagcacttacagcaacacaagtggtgctttgtatgagtcccatagtgttattcagggtttacggtattgcactaaacatgatgaaaaatacgtgggaacccaaacagatcacttttttttttttttactatgatatggaatttactggagcggtgaactgctcaagtggagataattaacatcaaataatgttctaagcaatgcaatagcaacaggaggcggctactattacagtggtgcagtatggactgcagttaattttatgcagttattattgaatactgcatcttggctgggtgcagtggctcacgcctgtaatcccagcactttgggaggccgaggcgggcggatcacttaaggtcaggagttcgacaccagcctggccaaatggtgaaaccttgtctctactaaaaagataaaaattaaccaggcgtggtggtgggcacctgtaatcccagctactcaggaagctgaggcaggagaatcacttgaacccaggaggcagacattgcagtgagccaaaatcatgccactgcactccagcctgggtgacagaatgagactgtctcaaaaaaataaaataaatacaataaaataaataaatacataagtactgcatctttacatttgtttacatttctctcaactgtgaacacagtctgtgtgtgtgtgtaagttttgatacattttaactttttatagtagatttgtatgtattttatggtggtaaatgataaaacagatgagtatctacatatattttatgcatttgtcgcatatctaactttttcttaatttttaaaaatatttctgggctacgtggtttgcagttttttcaaattgtcacaaatctccaaaaaattttccaatatgtttattggaaaaaatctgcatgtaagtggactcatataattcaaacctgtgtttttcaagagtcaactgtaatgtctttcaaagtaaaatctaaatgagtttatacttgatatatataagtttaatagaaggagtgcgttggctcatgcctgtaatcccatttctctgcgaggctgagatgggcggatcacttgagctcaggagttcaagaccagcctgggcaacatagagagaacccctttttattaaaaattaaaaaaaaaatcaatcaggcgtggtggtgcacgtctgtggtcccagctacttgggaggctcaggtgggaggctcaggtgggaggctggcttgagcccaggagatcagggctgcagtgaaccatgattgcgccactgcactgcagctgtgtgacagagtgaggccctgcatcaaaataataatcataataaagataatctgagaagtgagggtaaaagttaaaggaagattaaaaacaaaaaaaaaatgcttataatcccagtactttgggaggccaaggcaggaggatcgcttgagcccaggagtttgagactagcctgggcaatatagtgagacctcgtctctgcaaaagaaaacaaaacaacaacaaaaaaagaaaaaacagctgagcatggtggcacatgcctgtagtcccagcctggccaacatggtgaaaccttgtctctaccaaaaatacaaaaattagccaggcatggtggcttttgcttgtagtcccagctactcgggaggctgaggtgggaggatcgcttgagcctgggaggtggaggttgcggtgagctgagatcgtgccactttgctccagcctggatgacagactgagaccctgtctcaaaaaaacaaaaacaaaaacaaatcagaatggagcttataataatcacaccgtagctaagacttgggcactgctgatgtcccaggtgctgtgctagatgcttcctgcattattaccttgtttactcctcacaccaagctgggaagtcggtgttatgtggttattcccattttgcagatgggcaaacacaggcttagagaggatcgaggtcatcctgccagcaggtgagatttaactccaggcagtgtggctcttcattgccgctgaccctgcttaaactggaagaatgattcagatgggagtcatcttcccagctggctcctagtaagctgatgtcattcctggcatttaagctgcacccagccccagtgttaggaagacgcgctagaggagacacattagatcctttttgtgctgaatgaacttgttggtgtttataagaagaagacagaaccctagtggcttcatgctactccaggaccaagtccagattctcgccagccacccagcgcctgtccagcccagcccagcccagctccagctccagctcccaggtcttctcccttggcctggccatggggtcttcgtttgctttctgtgggtcccatgatcttccttggctgaaagccctcacgtcccctgttctctctgatctgacaactctctgccctgttgacttaaatgttgcacctccagcagggtgggggcccctctttgcccattggcaccatcatgtccctgcattcctgtttcaggttgttggcacagttcctgtcttcctggggtgtggtgcattcccatttcactgggagataatgatgaccatttacagtgatctttgtgtatttgcccagcaagcaagaggcagtctagtgtagtggttagggtgactgctcttgaggccagactgcatgggcttgaactgatctttctgggccctggagctgtgaccctggggaaggtacttccccacgctgtgcctcagtttcttcttctgtaaagcctacttaactcatagggtcattagagaattgagtgagttattaaatgaaatgatgtacttaaaactggacctggggccgggcgtggtggctcacacctgtaatcccagcactttggaaggctgaggtgggcggatcacttgaagtcaggagttcaagaccagcttggccaacatggcaaaaccccatctctactaaaaaatacaaaaattagctgggcgtgatggtgtacgcctgtaatcccagctactcgggaggctgaggcaggagaatagcttgaacccaggaggtggacgttgcagtgagctgagatcacgccactgcactccagcctgggcgacagagtgagactccatctcaaaaaccaaaaaccaaaaaacaaaaaagctggacctggtcaagccatcgagtgggagaaaatgtttgcaaaacacatgtttgataaaagactggggtccaggagatggagagaacttccgcaactcaagaataaaaacacagtcaacgcagtaaaagaatagatagataaagggtttgaacagacacgtcaccaaagaagattgacagatagccaatatgcatctggaaaagtgctccccgtcaccagccacctgggaaatgcacatgagaagaacagggaatgccccgcagacccatgggaaaggctggaagatgtggtgagaataggacagctgctactcactcaggctggagggatgtgcagtggtgtggcccctcaggaaatcagcttggtagtttcttttaaaatcaagtaaccatccttcctatgacccagcaattccagtaaatcttagatagatttgctcaacagaagtaggaatctgtggctgagcacggtggctcattcctgtaatcccagcactctgggaggctgaggcggacagatcacctgagctcaggagttcaagaccagtctggccaacatgacgaaacctaaaaatataaaaattagctgggcgtggtggtgcatgcctgtaatcccagctacttgggaggctgaggcaggagaatcacttgaacccgggaggtggaggttgcagtggcagtcaatatcgtgccactgcactccagcctaagcaacagagtgatactctgtcaaaaagaaagaaaaaaaaaaagtaggaatctgtaagaagactcttgtacaggaatgttcatagcagcttcattcataagagctggtacttggaaacagcttggggaccatcagtaggtgaatggatacacggacagcagtaattgacaggacggaatgatcctgggcagtgtcaaggaacaaggtgccggtacaggaaatcacccgagactctcaaaaccactatgctgagcaaaccaagacagaccaaaagagtacacactgtgtgatttcatttcatttcatttttttcaaagatgagatctcactctgatgcccaggctgaagtgcagtggtgcagtcatagctcactgcagcctcgaactcctggcctccagtgatccttctgcctcagcctcccaaggagcgaggaccacaggtgtgtaccactacaccccgctaatttcacttttacaatgttctacagcagacagagctaatctgtggtggttgcctctggggctgtgggcaggagttgcttggggaggagcaggagggattttctgttgttatgaaaatattctttacagtgagagtggtttgagatacgcaggtgcagcatttgtcaaaactctgcatgtgtactttaaatttgtgcatttcatggcatgtaccttttaactccaaggaaataaaagaactataaataaatactgaactctaattagtgatgtgtgtgattagagggaaaagtactgatgtctgcaacttactttgaaatgtgttaaaaaaagatgatatggtagactgaatagtagtaccaaaaatgtctatattccaatacctggaaactgagaatatgttctcttatgtggtcaaagggaatttgcaggtgtgattaagttaagaaccttgagatggaattagcctgggttatttgggtgggcccagcgtgattaccagggtccttatgagaaggaggcaggagggtcagagtcagagagaagtgaccatggaggtggaagttgcaatgatgtggggccaggagccaaggaatgtgagcagcctctgaaagctgcaaaagccaggaaattgatttcctcctggagcttctagagggaatgcagccctgctgacaccttgattttagccagtgagacccattttggagtcctggcatccggaaccacaagatagaaatttgtgtcgtatggaggccgggcgcggtggctcacgcctgtaatcccagcactttgggaggccgaggtggacggatcatgaggtcaggagatcgagaccacggtgaaaccccgtctctactaaaaatacaaaaaattagccgggcgtggtggcaggcgcctgtagtcccagctactcgagaggctgaggcaggagaatggtgtgaacccggaaggcagagcttgcagtgagccgagatcacgccactgcactccagcctgggcgacagagcaagactctgtctcaaaaaataaaaaaaaaaagaaagaaatttgtgtcgtatgaagtcccacagtttgtgggaattatttccagctgcaattggaaatgaatgctgatggattgctggatagatagagggatggacggatgtggaataaaacaagtatagacaaaggtgggtggtggactgtaggctgtgggtatacaagtgttcacttcaaactttacttggctgggagtgggggcccatgcctgtaatctcagcactttgggaggccgaggcgggtggatcacttgaggtcaggagttcgagaccagtcttgccaacatggtgaaactccatctctacaaaaatacaaaaaattagctgagcacagtgacatatgcctgtggtctcagccacttgggaggctgaggcaggagaatcgcttgaacccgggaggtggaggttgcagtgaactgaaattgtgccactgcactccggccagggtgacagagcaagactccctctcaaaaaataaaataaaataaagttctttagatgtttctatgtgtttgaaacttttaataatgaaatactggggggaaatgactgggcctgatacataataaaagccctacaggccaggcacagtggttcacgcctgtaatctcagcactttaggaggctaaggcaggaggattgcttgagcccaggagtttgagaccagcctaggctacatagtgagaccccctctctaccaaaaaatagaaaaaaatagccaggcgtggtggcccatgcctgtggtcccagctaccccggaggctgagggggagaatggcttgagcatggaaggctgaggctgcagtgagtcgagattgcaccactacattccagcctgggtgacagagcgagaccctgcctcaaaaataaataaataaataaatacatacatacattcatacataccctacataggtgtcagcctttgttctcattggcatctcatctccattcttattgccaccacggccactcccccactttatccatcaggtggagaagaggcctgggaagagaagagaccaggggctgggttggtggtgagcagacgaaataataaacatacaatgaggccatatgacatattgggagaattgctttcacttaagaaaatctaggctgggcgcggtggctcatgcctgtaatcccagcacttttggaggccgaggcaggtggattgcctgaggtcaggagtttgagaccagcctggccaacaagtgaaaccctgtctctactaaaaatacaaaaattagccaggcctggtggtgggtgcctgtaatcccagctgctcaggaggctgaggtgggagaatcgcttgaacccgggtggcggaggttgcggtgagccgagattgtgccacttcactccagcctgggtgacagagcgagactccgaagtgaaggggctggggctttggaactgtagaggctcatctccccagtaagctgtcacttgtgatgtggttacagctgtaggcatttgcagagatgggacgagaagacacgccaccctgggaactggcccgtgtcttcacacgtcctgcactgctgctgctgagaacgtctgcactttgttaggggaagagagtgttttagttaaatttatctggaaaacatattattagtataatgagattttaatgatttgaaattttgttggagcagcgcagggagaatttcaatcttaactgtgtgtgcagctgggcattgtttctattttattttgtttctttgcttgggcctcattgcaaggacatgtttctacaattattatttagtttttctttcctagagccctgctttgttacagctcttaattttcttgtgtagaagatctgctggagaaaaaagaatatcctttttgtaaatacttagctggcttgatcagaaccagagaatgagcgttgttaccgaaggagacttgtgtttgtttaaggtttactggcgcactctgtggttgccgtggagtggacccaacccagatgtccgttaactgatgagtggataagcaaactatgctccatccatacgatagaatactattcagcaacgaaaaggaatgacatatggatccatgctacaacatgggtgaatctggaaaacaggctcagtgagggaagccatttgcaaaaggataaatactgtgtgattccatttatttgaatatctagaataggcaaattgatagagacagaaagtaagattagtggttcccaaagcctggggaaggtacagtgacccctcatgggtacagggattattttgggggtgacgaaaatgttcttacattgacaatggtgatggttacacagctctgtgaatttactaaaaatcattgaattgtacacttatttatttatttatttatttattttgagacggagtcttgctctgtcgcccatgctggagtgcagtggtgcgatctcagctcactgcaagctccgcctcccgggatcacgccattctcctccttggccacccgagtagctgggactacaggtgcccgccaccacgcctggctaattttttgtatttttcgtagagacagggtttcaccatgttggccaggatggtctcaatctcctgaccccgtgatccgtctgcctcagcctcccaaagtgctgggattacaggcgtaagccactgcgcccagccgaattgtacactttaaaacggcaaattgtatggaatgtgaattctgtctcaataaagctggtaaaaaaaatagcgtggtactgagaggcagcgctcagagcttgtgagatgtttttctccagttggtattcgttgcatgtttccaaggtgagatctttcaccttggggtgagggcgggtggatccgggacagacatggaattttcagtcttcctcctcctcctcatcttcctgttcattgcccctgcagtggtggcagctgtcccatatcaaggtctcacactggccaggggctgggcttggtgctgtacgcagattgtcttattaggactatgaggcttttgagataggtatgataatatgtcctcattgagcaagtgacaataggaaacccccagaaattgtgtgcactgttttgcctgatctcacacactttggacagagactttgatcacattcttaggggcccacaaatggtcaaaaacctctgaactgagacagcagcattttttgtggtttttttttttttttttgagatggagtctcgctctgttgtcaaggctggagtgcaatggcccgatctcggctcactgtaagctctgcctcctgggttcacgccattcttctgcctcagcctcccgagtagctgggactacaggcacccgccacagtgcctggctaattttttgtgtttttagtagagacagggtttcaccgtgttagccaggatggtctcgatctcctgacctcgtgatccgcccgcctaggcctcccaaagtgctgggattacaggcgtgagccaccacgcccggcctgttttgtatttttgagatggaatctcgctctgtcgcccaggctggagtgcagtggcatgatcttggctcactgcaacctctgcctcccgggttcaagtgattttcatgcctcagcctctagagtagcttggactacaggcatgcaccaccacacccagctgatttttgtatttttagtagagacggggttttaccatgttggccaggtgggtctcaaactcctgacctcaagtgatccacctgccttggcctcccaatgtgctgggattacaggcatgagccactgtgcttggcttgggagagcaacttttaaactctctttttattttggatccatggtaagaaatatatttccataaaaaccccagttcaagcatacatttacctatatccatgaataaaagtttcatgaaatgatatcttcctataagcacactgacgtttgctactctactgttctttcatttcattaaagaaacgtgctgtccaggcaatctcagtactttgggaggccgaggcaggaggattgcttgagcccggtggtttgagaccagcctggtcaacatagcaagaccccatctctacaaaaaataaaattagtctggcgttgtgttgtgtgcctgtggtcccagccacaggtgcccctgcaggggcagggggctttcaggtgggaggatcgcttgagcccaggagtttgaggctgcagtgagttatgattgcaccactgcactccagcctgggtgacaaagagagagtctctgtctaaataaataaataaatacatacatacataaaatatgctagtcacagtttcctaaatggattttatgactcattgagtcaaaatgatagttttaaaatgttgctaagagagatgtaaggaggaaaatgtgttggtgagtgttgaggagcccaacttcttttgagaaatcattgttggatctggtgtctcatgtgttaccctggggtttcaactcctgtttgctcattcagttattcattgatcaccctgtcttccaggcatgcagtcattcattcaaggtgattattgagctccccttgagagcaggtatggggctgggggttggagatccagtgagtggtcctgcttgagagactggccctgcccacatggcactagtgggctgggactctcccatcactcttgtctccatcttgttgtgcactgttgatgctccattgaatgatcttggcatctttgctgaaaatcagttgatcatcaatgtatggatttatttctgagctttcaattctattatgttgatcaacaggtctgtctttatgttagtactacactgtctctatcactgtagctttgcagtacgttttgaaattggcaaatatgacacttcccactttgttcttcaaccttgtgttggctatttgggatccctcgagattccgtatgagttttagggcgtgattttctatttctgcaacgagccaccattggaattttgggaggaattgtactgaatttgagaattgctttgggtagtatctttaacaacacgaagtctgccagtccatgaacataggatgtctttccacttccttaagtcttctttaatttcccttcgcaatgttttgtggttttcagggtacgagtctcttgcctctccaggcagatttatccctgggtggcttatgctttcggatgctgttgtcagtgggattgttgtccttgccagtggtcgctgagcccagctgcagccttgtcttgcactgcagggtgtctgtgtcacctacttgcctagttctggccacttttcttgcaggaagtcagaagtgtactgatctggagtaggacccttagcacaacagagctgctccttggtgctaggagatgcgtcctgaggctggccatccatgtcagaggacctggcgcctcaccctcatcatgggatatcactgaccaccagtgggggatgcatctctgctgggcttggcctgcaaggtaggagctgactgcaggagtgggaaagagcccatggcccctgagggggcctacagttggctctcctgtggttacttggcatgtttgatagacgcctgggtctggcacagagaacactgcccgctgacaatcattgagcctcggcaggctggccccgatgacatgttatctccccacacagtccctggacacacttgattaaaggtgcttattactttcatagtgttggctggagtgatgtgataactccacaaaaggttctggcagaatcccagaccttggggtgttcccaccagtgtctctgtgttcaaagttcagcacagtgtggggtggcaggagatgggaacttggagactgaggccagagtctgctgacttgagcctctgctgaggtccttatcagtgccgggagagcagcagcctaatctcaagatggtttagaggatttagcgggggcgtgcatgcagagttgagaactggctcctgggtcggtgtgcggggggtggggatggcccgggggccgtagctacagtttgtcttccttcccccaccggcagaggtgaagagaggtgttttgtcctggagccaccaggcctatccatggaggagcagagcttcacatggagcctgtgccccgtcttagtctatttcgtgttgctataaaggaacactaaggctggctaatgcataaagaaaagaggtttacttggctcctgtttctgcaggctgtacgtggcactggcatctggttctggggaggcctcaggggcttctcctcatagtggaaggtgaagagggagcaagaaagggagaggaaggaggtgccatgctcttttctaagaaaacagaaacacagctgcattattttaagcaaaacacatattggcttaggtcgctgtattcatctcccagggctgtggcaccaaggcaccagacactgggtggctctttgggaggccaaggcaggcagatcacttgaggtcaggagttggaggccaggctggtcaacatggcgaaaccccatctctactgaaaataccaaaattagccgggcatggtggcatgaacctgtaatcccagctatttgggaggctgaggcaggagaatcacttgaacccaggaggcggagtttgcagtgagctgaaattgtactattgcactccagcttgggcaactgagccagactccatctaaaaaaaataaaaaataaaaaacccagcagaagtggattctctcacagttatggaagccacaagcttctaggggttagaattccaacatatctttttttggggaaagaggggcataattccccatagaagagcctgtaatctcagggagccttgacccaggtatttgacgttggtgtaatctacttgtgtatgtgtattggtggacaaaggggatggcctcacatcccttcagcatcttgggggtgggcggtgcctcccctccggctcccctgagtcagccccggggaagaccaattgtggggctggatggtgtgggaacccccagctccgtcctgtctccagccatcagtgaggtgtgcttggccattccccacaggaccagtgggcgggatggggcagctttgcagttggagaggatgggggttcaggcaggcagaacagatgcgcggacacagaagagctgtgcagaatgtggagttgagcttcctggaaggcccataggagaggcgagactgaaatcttcttgatactttttcactggggcctgaaagcctggtgcagaatgaaactgaaagcacttgtctcgttgagcaaatcattcaactttgttatttctgtaattgaaataattcctggcattaattatgtggagagcactcatgaccatgtggacatatcttttgggggcacatgaactgagggtaataatttcgctcgaattttttttttgagatggagtcctgctgtgtcgcccaggctggagtgcagtggcgtgatctcggctcactgcaacctccacctcctgggttccagcaattttcctgctctagcttccccagtagctgggattacaggtgcccaccaccatgcccggataatttttatattttttaattttatttttatttatttattttttgagacggagtcttgctctgtcactcaggctggagtgcagtggcacaatctcagctcactgtaacctccgcctccaggcttcaagcgattctcctgcctcagcctcccaagtagctgggatgacaggagtccgccaccatgcctggctaatctttgtatttttagtagagacagggtttcaccatgttggtcaggctggtctcaaactcctgacctcatgatccgcctgcctcggcctctcaaagtgctgggattacaggcatgagccactgtgcctggcctaatttttgtactttaggtgggatttcatcatgttggccaggctagtctcgagctactgatctcaggtgatctgtccactttggcctcctaaaatgctgggattacaggtgtgaaccactgcgcctggcctatttcactccattttgccgaggagggaacagaagtgtggagtcctcccagccacatggcctcggatccgggctgcaggtccaggctttccggctccagggctggtgccctctgtcctgtgccacttcccctgcaaaatgagatgaaaatgagtctcattttacgatgaggaaactgaggccctgagagagggtgagaaaccaggtctctggctgaatgcacctctcactgaagacatctccgggtggaaatgttctgagagctgctgtgtgtgctggtgtcagaatgaacaatacccatagtgcttggcgtagacaatcagcaaagctagggacccgttttctcctcccagccccctttctcacttcaggccctagacaagaatcggaggtccgtttctcaagtttagctcctgtctgattaaatttgaggttcgtttctcaagtttagctcttgtctgattaaatttggatttgctccactctttttcacgggcataaaaatatctgcggagtgaaaatgtgtgcagaggatgcactgcgtgcaggctgcggctcgaggtcaatcagattcctccagcgataaaaggcctgctgaggaagcggccccactcccagcacagccccattgattggcttttattttcctctgttgctggagtgatccaatttgaagccctgtttctgagcatgttgcaaggaaccctaggggctgccatagccctggagatactggctggaaatcaaattcaaattggtgctttcttcctattaaagcaggagacctctgcccgggaacgggccatttgggggctcagccatctggcacatggagtgagtaggttttattgccaaagccgtcccggccttggcctcagcctctgtgtggctctggtggggagtgtgtctcgatgttgtactgtgaataagccccatgcctacttgagtttggggtttctgttttacctacacttccatattgtgggcatgtggctgcggaaatgtgcctgcacctggactcgctgtcactcactggcttctcgtggtacagcctagggagggttgccccagccgtatttagttcttcctgcctcagatgaacgggcctcctctcccagctcctaatcaggagggcagagtctcgttggcggctctcctgtcctgctgccactgcctttacacttcttcagatatgcggccgtcttaaggtgtaaatgccttcctctgtttcccagtggttatctaaagcaaggattggcaaacagaatccacaccatagatttgaggtatgtttgttgtcctctttccttcttaaactgttagtaaacaagacattcctacaggtgacccctttcggcctttttttttttttaagactgagtttcgctcttgttgcccaggctggagtgcaatggcgccatctcagctcactgcaacctccgcctcccgggttcaagtgattctcctgcctcagcttcccaagtagctgggattacaggtgcctgccaccatgctaattttgtatttttagtagagatggggtttctccatgttggtcaggctggtctcgaactcctgaccccaggtgatcctcccacctcagcctcctaaagtgctgggactacaggtgtgagccactgcgcctggccagtcctgcactcttcaagtttctatgtgttgcagactggtggggtagcaatatcagttagagagacaggactggggtcacttgtcccctgttagctcagtgaccttgagctcagcttagacacattgtctctgaacactgtgctgatggcaacacctctctcacctgtcttgcagtcttatttgaggaattaaatgcaataacctgggagaaagtgcaggtatgaagtcagggcacacagcccgtcaccaggagcttgaaggaggagaagagtgggtggggatgtgagcacagaagctgaggcgggggctgagccgggtgtgtatttctgcctgtgccacagggacacccctttcaggcactgggcgcctagctcctgttgtctcatctcctaagagagtctcgggaggcctgagactccctcactgctgcgggcttcaagagcagcatctgtgctgagtaacagccatgggggcagaagcagagatctcccgtgacagagtagttaggcagccgtaaaaatcctaccaccagctcgtggaaaaggtctcatttgacaggtgccatgccgtcaaagacttgtgctctgcagctgcaaattcccaactgaaaaatatcaacaattcttacgaagagagaaggggagccctgcaaagctgttgtgtcaccccgtctgtttgtaggcgctggggggattgatgatgaggtggggactgttcggctggccacactgccattgtagatagcctgtgactctgtggctggcgcctggctggcctcagtgaagcccttcagtcccagctctgaccatgtctctgtggagagacaagcaggtgatagtgttgggtgggcaaggctgtgctggtggcctgcttagcaacagcaggaaaaggaaggagataaccaccccaacctttcttgctggaaggagcccttcctgttgtcggcgctgtgtgtaaccaatgaggcgaatgccgggaagcgcttggtttgtgtcaatgaggggagaggattgtgcagaagtgcaggaagggaccatgggaggaaattgagtgaaggtctctgttaggggtttgtgttcccctaaaaggtatgtccaggtcctagtctccagcccttgggactgtcaccttatttggaaatagggtctttgcagatgtgcttaagacgaggcctgtctgaagtagggtgggcccctaattcaatgtgactggggcctttatggggagaggaggcaggacacagacagacacgggacacagaggctggacagagattggagagatgctgccacaagccaagatgcaccgaggactgatggccaccaccagaaactgggaagaggccaggacggatcctcgcctggagccctcagtgagagcacggctctgccgacaccttgatctcagacttctggcctccagaactgggagagaatcgacgtctgttgttttaagctgccagtttgaggtactttgttaaggtggccacaggatgcgaatacagtcaccatctggcctttgatcttctaattgcctcggcggttctcctgccagtaagggttgtgagtgaaacttgaaggtcacagttggaaatcaagttaaaagaattaagctggaagtgcaacatgagagtccgtcaccctgagaggcggtgtgaatgccaaacacaggcaggcagggctggacctgcataaattgtggttcgacagcaccgggagaaagaaggcccgggcctgctctcctcacctgattctgggaatgccgaacctacctgtgttcctgatatcaccccagtgctaacttcccaccccttgaaaatgtcaaaacattgtgttatgaatgttcttcattgagcaactgcgatctctttctgtaaagatccagagaatatttcagcctctgtgagccatcctgcctctgtaggaatgaatcaactctgccttggaagcatgaaagcccctatagacagttcataagcatagccgtggctgcgtccccctgaagctacaaaagtaggtggggggctgggtgtggtggctcatgcctgtaatcccagcactttgggaggctgaggcaggcggattgcttgagcccaggagttcaagaccagcctgagcaacatagcaagaccctgtctctacaacaaatacaaaaattagttgggtgtgttggtgctcacctgtagtctcagctacttgggaggctgaggtgggaagatcccttgagctcaggaggttgaggccacagtgaactgtgattgtgccactgcaccccagcctgggagacagagcaaagccctatctcaaaaaacaaaacaaaacaaaacaaaacacccaaaaagacaggtggtgggccagatttgctcactggctgcagtttgccaatctatggtttaaaccaacaatttaaataacacacacacatctttgtatgatgttacacatcttttttttttttttttttgagatggagtcttgctctgtctcccaggctggagtgcattagtgtgatctcggctcactgcaacctctgcctcctgggttcaagcaattccccttcctcagcctcccgagtagctgggattagaggcatacaccacctcgcccagctaatttttgtatttttagtagagacagggtttcaccatgttggccaggatggtctcgaactcctgccctcatgatccgccctccttggcttcccaaagtgctgggattacaggcatgagccaccgcgcccagcctgatgttacattttctagaagttctcagtgatgggcatttaaaggattcggctgctgctccctgtggctttcacagcgctgccctgaatgggtgttagggcaccgtacaggtagcggggatgcctgggaaagcccagactcacagcaacacaacaacagttaacagactccagtgaccaaatgtgtgggtttttcctgcaccaactggcggataccagctggatgtcccctagttcaattcaattcagttctgactccacctacctggagatggcatcagatcccacagggtgagggctcagtctcccaagactctgaacagtggctgtaagtcagggttcccacagccccatctttgggttcaattaatttgctagggtgactcacagaactcggggaaacatttacttatatttcctggtttattataaaggatattacaaaggatacagatgaggagatacatagggtgaggtgtagggaaaggggtgcagagcttccatgccctctctgggcgtgccactttgccaaaaccaagcatccagtctctggaagctccctgaatcctgccttcctgggccttttatggagcctcattggatatgcacgattgacagccatgtagaaataggattggacagcaagggtgtgatctaacactaacagatggactggggaggccctgcaagacctatctgtgcagccttccttcctccaaggtgtgggggcccctctctggagtgagggtctcattacttacaatctgatgagagtcctgccttgggcaggtgaaaggagggcagaaggttagagagattctgttttctgaggctaaagtgccccaacatcttttattattattattatttttgagacagggctggagtacagtgatgcaatcttggctcactgcaacctcacctctcgggctcaagtgatcctcccacctcagcctccctagtagcaggcactacagccgcgcactacaacgcttggctaacttttaaattcttttgtaaacacaaggtcttgctatgttgcccaggctggtctcgaactcctgggctcaagcaatcctcccgccttggcctcccaaagtgctcagattacagcatgagctcctcagctagaagagttaaactcatagagagaggaagtggaatggcagttgccaggggcaggggttgggggctgggcagggaggggacagggagttagtgtttctgccttgcaagaagaaaagagtttggcggataacagcgatggtggcacagcagtgaatgtccttagtgccactgaaccgtacacttaaaaatggttaaagtagccgggtgcggtggctcacacctgtaatcccagcactttgggaagtcgaggtgggcaggtcacctgaggtcaggagtcttgagaccagcctggccaacatggtgaaactccctctctactaaaactacaaaaattagccgggtgtggtggtgggcgcctgtaatcccagctgctcgggaggctgaggcaggagaatcacttgaacccaggaggcagaggttgccgtgagccgagattgcgccattgcactccagcctgggcgacaagagtgaaactccatctcaaaaaaaaaaaaaaaaaaaaaaggttaaagtgagaaattttatgtattttatgttaaatgtaccttactacaattgaaagaatgaaaaaaaaatactgggaaatacattacacatacaaaagagtgtacatatgtatagtttactgactaatattaaggaagtacccacgttcctgctatccagcttaagaaataacattacctgttccccgagccatatgccccgtacctcctgtgcgcctccctccccaccagaggtgaccagtgccgccttgaacgttgcatttagcatgttgtattagttagagttctctggagaaacagaaccaatgggagatatgtagctctctctgtctctttttttttttgagacagagtctcactctgtcgccaggctggaatggtgtgatctcggctcagtgcaacctctgactccctggttcaagcagttctcctgcctcagcctccccagtagctgagattacaggcactggccaccacacccggctaatttttgtatttttagtagacacggggtttcaccatgttggccaggatgatctcgatctcctgacctcgtgatccgcccgcctcggcctcccaaagtgctgggattacaggcgtgagccaccgcgcccagcctgtctctctgtctgtctctatccatctctctctctctctctctctctatatatatatatatttgaagagattgattataagttattggctcatgtggttacgagactgagaaatcccaggatcttcaagctggagacccaggagggccaatggcgtcagcccaagtgcgggaggagacccacgtcccagctgagtgaatccccttaccctgcctttcggtctattcaggtgtcaaatggattggccgaggcctatccgcactggggagggccatctgttgtacccagtctaccgattcgaatgctaacctcatctagaaacaccttcacaggcacgcccagaataatggttagccaagcaccaggccgctccccacccagtccaggcagctagtcagcaggccctgccccacttgcttgtctttccttgcgttttgcacacgcatgcatctctgtccctcactttctttagttttgcccgactttgaccccaatatgacgggagccccaccgtgcgtgctgtcctatgactcgagtttacgcagtagcctagctttggggcacagccccatttacttggggcaccgctgcctctgctgtgtggccgtgtgggatcccacaccaggagcaccgtccctttgtcacctgggaggggtgattctgtgcctgagttgcatgtggatttcctcctgctgagttttaattaagaggcagggagcaggtgggtgaagggcacacacacggatgcagcgttgcccgggttcgaattctgcctgcgccatttcctgcctgctgaaccagatcggacaaattactctacctctctgtgccacagattttttgttgttgttgttgttttgttttcattttgtctcgttttgtttttgtttttgagacaggttctccctctgtcacccaggctggtgtacagtggtgcaatcacggctcactatagcctcgaccctgtgggcttaagcaatcctcccacctcagcctcctgagtagctgggacgacaggcgtgcacagccacacctggctaattttttaattatttgttgagatggggtttcactatgttgcccagggtggcctcgaacccctgggctcaagtgatcctcctgcctcagcttcccaaagtgctgggattaagtgtgagccacctcatctggcctttgtgccccagttttctcaatcaggtaatgatgatagctctcaggtggtgagggtgactgtataaaatgtctggaaatggcacctgctctgtgcccaggggttagaggcttgggaccgagctgggggctgagctgggggtggagctgggggctgagctgggggtggagctgggggctgagctgggggtggagctgggggctgagctgggggtggagctgggggctgagctgggggcgtttttgttccaaggctttcttgctgataagtttctctttctctctctctcttttttttttgtcctgcgtgtctcaacctgacaaaaatgctcagtttagaagcgtgtcgttccatttgtgggaaaattaaacacatttaagagtaaattaaattaggggacttgtgatcattagctaagtaaattattttttaaaaatgtgatgtaccaagcatagcacatgtggcacgctcaataaatatttgttagaatgaatgataattttatgagccagtcgagtcatatataatgggattatttggttctagaactaatgaagtgactgtagagcaataaagcttctaaaaagaatctccgtgctcgcaaaaaatccaaaagtgggggaagaggctcatgctggatttcacccaagagcgaggcccgaggagagctgggacgctgtgtcctgagagctgtccaaggggggcccttgtgacttggcaggggtggttttggagcctgagtttatccgcactctgggtggactgggtctcgggggaggcctgccttaggtcagctcaggagaccagtggatatagcaggaggcccacttgcagttcacggtttgtcttgccagatgtgcagggggcccggtgtctcagcacttggcacctgtgggactgagagaggagtcagtctagcaccagacacccgcttggtgggggaggggagtggaagaggagggagaggagagagagggggctggagccccagtcccacagcttaggtcctgggaagccctgtgggttcatgcttgccttgaggggaggttggacggctcaagcagggaccaggagcctcccagtgtggcatgagctttgctggaagcctgggctctttgagaggggtggggctgagagccgctagacctggcttcatcctcctgcctgctttcctgtctggggtgtaccctgggaagggacataacttccctgaacctcggttgcctcccctgtccagtggaggaaaggaaggcacctgcctaactgggctcttgaaaataataaattgagataatacaaaatctgcattaatttcctaggcctgacataaaagagtaccccacactggctggcttacagagcagaagtttattctctcccagctctgaagaccagaagtccaagatcaaggtgtcagcagggccttgctccatctaaagtctccagggagggatccttcctgactctcttggcttctggggacggtgggcagtcctggcatatcttgatttgtggccatgtcactccagtcagcctccattgtcacaggtgtcccccttcatgcccctctgtgtcttcctatggtcttctctctgcatgtcagcatccaaatttctctctcccatgtggacaccagctgggcccaccgcagtccagtatgacctcatccgaacttgattacatctgcaaagaccctgtttccaaataaggcacattctccagttgtccaattccaggtggacgtggatttttttttttttttttttttttgagatggagtctcactctgtagcccaggctggagtgcaatggcacgatcttggctccctgcaacctcctcctcccgagttcaagcgactctcctgcctcagcctcctgagtagctgggattacaggcacctgccaccacacctggctaatttttgtatttttagtaaaaatggggtttcactctgttgcgcagggtggtcttgaacccctgagctcaggcaatccacctgcctcagcctcccaaagtgctgggattacaggcatgagcctctgcgcccatcggacgtggattttggatgagacaccattcaacccacagtacctggtgctcagttagtgactaaaacccactagttatggtcactcagtcacccttcttgttattactttcatagatgagggtgtgatgggggggggaaacagaagcagagttgattgtatcttcttagttctgcacaccctgtggcttttttttttttttttttttttctgagagggagtcttgctgtgttgcccaggctggagtgcagtggcacgatctcaggtcactacaacctctgcttctcacatttaagcgattcttctgcctcagcctcctgaatagcgggcattacagacatccgccaccacacccagctaatttttgtatgtttagtagagacggggtttcacaatgttggccaggctggtcacgaactcctggcatcaagtgatccacccacctcagcctcccaaagtgctgggattacagacatgagcctctgtgcccagccccgtggctagttattagactgttctaggtcttgatgggaaaggggaggaggacttgttcttctctttggattaataaaacaccgtgaggcttgtgtttgcacagtgcccacagcttgcacactgacaagcccttttaggttgacttctgctgagtcatttcatcctgttccatttgtcagccataaggtaaggagcagtttttctgatgtactccttttgcataaatgctactctccatcagcctcgagaagtagaaggcaccggtatggtatcccaagctcattcacaggggagaagagatgcctgttgccacaaaatgtgaatgttgggtgtacattcaggtgtcacgtacgtggtgttgattgtctcagcttaataaagaaagatgccgtacacattttcctttaaaaagtctcacttggcttgtttgacaggcacagaagatgtgttattaaacacttgcaaagcctgctgtcatttggttttaaacagcactcgtcgtctttggcggggcgtgtttgctcagcatcatggaagggggatgtgaggtacccaggtggcagtttctctaccacgatgctttctctgcttgctatcgggagaaatgttctttcctatgttgtgggaaggcggaaagggcactctgaaatgtaaggtggccttttgtattagaatttcatggctgagaccaggcgtgggggctcatgtctgtcatcctagcactttggaaggccaaggcaggtggatcacctgaggtcaggagtttgagaccagcctggccaacatggtaaaatgccatctctactaaaaatacaaaaaattagctgggtgtggtggcagccacctgtaatcccagctacttgggaggctgaggcaggagaatcacttgaacccaggaggtggaggttgcagtgagctgagattctgccactgcactccagcctgggcaacagagagagactctttctaaaaaaaagaaaagaaaagaatttcatggttgattgtcacaggaccatctttagtcccaagatctgaggcaagggaatcgttttcaataggaaacttttaaatgtttgagcagcagaaagggagattgagccagaagaacttgctggtggaaagatggtggaagctgggagctttgaggttctaaaaatcctggtgtgtcaggtcaggtagtggggcaaccggagcttagggtgagttatacctgatgggacttaactgggtaaatgtcatctagtaacccaactacattcggcattaatatctggacaaaaggtggaatacacccgggttctttgggcacaggcgaaggagaggtctcatagtttgatgttgctcaagaagggaaaacaagcaggatgggaagaggtctaatcagccggctggagtggggtgctgggtttagttcattccttcttaaactcagccagttctcattattcatggtggttttgatctataaagttgccacaaaccccaagttagccaatactgagccatcactcctagggcagtacagcgctcggttcctgcgagcctctggtcacaacattttcagcaacagatccatacataactttttcttatatatgtttctttttaaagatacgttatttaaaatgtattgttgattgattaacattgagctcacggccaacagcagtataagtgctgcctgaatgaagcttctctgacctgtgcgttctctgcaaggcatacctcagccttcttgcacttgggaacactaggagtacccctcgccacgcgtggggacccattttaaacagcaaagttggctgggcacggtgactcatgcctgtaatcccagcactttgggaggccgaggcaggcagatcacctgaggtcaggagttcgagaccagcctagctaacatggggaagcccagtctctactaaaagtacaaaaaaattagctgggcatggtggtgtgcttctgtaatcccacctattcaggaggctgaggctggagaattgcttgaacccaggaggcagaggttgcagtgagccgaagtcacgtcactgtactccagcctgggcatcagagcaagacttcatctcaaaaacaaaacaaaacaaaacaaaacaaaacaaaccaaaacagtgaagtcaccaacaaatagcagaaaaatgtgaaaaacatggcattaaatagaccatgaaatggacacttgtttatgatgtgagacctcagacaagaaggcagagcgccccgtgtttgacctcaggtggggacacatccggcaactcagattcttttttttttgagtggagtctcactgcgtcacccaggctggagtgcagtggtgcaatctcggctcactgcaacctctgcctcctgggttcaagcaattctccagcctcagcctcccgagtagctgagactataggtgcgcactaccacacccagctaatttttgtatctttagtagagacggggtttcaccatattggtcaggctggtctcgaactcctgacctcaggcgatccacccgctttggcctcccgaagtgctgggattacaggtgtgagccaccacacccagtcagattctttgcttctgtgtgcaggtctgtgaatgaatgtaggccaagagtattgattctgagcttacaaattttagccagtagacacatttacacatacagaatccatgaatcaaggcgattgactgtactttgacaattatttgtttagcactgtaggaggaacctgcaaactgttccttccctctgctcacatactgcccagggtaagacttctgacaccagaggtgcagggatgcttcctgccgcacctggcagttctccagcagacaccagctgggtgtcctgcagttcagttcaattctgacaccatcgacctggagagagcctcagaccccacaggtgagggctcagccccacgagactgcaccccaaatcagggtccccacgactgcttcctcggttttgattaatttgctgggactcagaacttggaaatgggccaggcacggtggctcaagcctgtaaccccagcactttgggaggccaaggcaggtggattgcttgaggtcaggagttcgagaccaaccgggccaacatagtgaaaccccatctctactaaaaatacaaaaattggttgggcatggtggtgggcactgtaatcccagctactcgggagactgaggcaggagaattgcttgaacctgggaggtggtgattgcagtgagctgagatcgcaccactgcactccagcctgagcaacaagagcaaaaccctgtctggaaaaaaaaaaaaaagaactcagggaaacactgcatttgtgctccctggtctattataaaggagatgataaagggtgcaggtgagcagaacaggaggaggcacacagggtgaggcctgggagggcccccagcacaggagcttctgttgccctggagttggggtgtgccaccctcctggcacctggatgtgtttacccacccggaagctctctgcaccctgtagttcagggatttttacggaggcttcatcatgtaggcatgtctggttattagttcaatctccagcccctctcccctttctggagggtggggttggggggtgtggagctgaaagctccaggcttctaattgtgtctgggtctttctggtgctcagcccccacccaggagccaccaagagtcacctcattagaataaaacatccttttatctccctggaaattccaagggattaggaactttgtgtcaggaaccagggtcaaagactaaatattagaacaaaagattgtcctggcacctggaaattacaaggttcttaggatctgtgtgccagggactggtggcagagaccaatatgaatatttcttttcttttctttttttttttttgagatggagtctcggtctgtcacccaggctggagtgcagtggtgtgatctcagcttactgcaacctccgcctcccgggttcaagtgattctcctgcctcagcctcctgagtagctgggactacaggtgtgcaccatcatgctgggctaatttttgtatttttattagagacggggtttcactatgttggccaggctggtctcaaactcctgacctcaggtgatccacctgtcttggcctcccaaagtactgggattacaggcgtgagccaccgcgcctggcccaatatgaatatttcttattattttacaagcacttgcggtgtgtcctgtggtctccgtcctcagcgtcgtggtttagagggtgcctgacaggcagggtgtggggttagtggggttggggagtgatttccggggcacagtgatccccagagtatgtgtggttgtccagttcactcactcctcgtggcctgctcggtgctgggggtccacactcacagagggcatggtctgtgccccttgggatcaggcagctgctcctggtacagatgagttgggagatgacttcctccagggcatgtgagaagctctcaatgaccaggccagctcggattcccagttctggccgagccgatgtgctctctgttgccacattccgtgtcacttcccaggcctccccggcttcccattctcggggccaggtgttccgtggatggggtgcggtgcggcctttgataccagaggcctgggatcgctttcctcctcggtttctgtgtggtcagtggcgccttcacctgtctcatgccctgccatgctgccatgcaagggcagagggctggtgttggggtggtgctggggcctggggagtggaatatcctgctctgttaagatgctggggatcgcatgtgtgatgctggccacgtcagccagtcttccttcctgccgagaccaccagccctcggtgcagccagccgtatcacctggttatagtcacgccgaaacccagctgtttggaagcgtggccgtggggccttggatcccttttcctttccacgtgttttgtggagacgaataacacaggcatgcgccgtgcccaggtggaggcaatgttaggaaagcaggaaggagctcagagcaggaaatgtgtgtggactcgcgtttgttgaagggcctggccgagttccccagaggctggggtcagtgttcaagttctgatgcttcacgtccttggaggccaaaggacgtgaccttgaagaaggggcagttctcacctgtgggcctaggagaggtcgttggccttaagacattactccaggtaattatatgtggttcctacctataatcccagcactttgggaggcagaggctggaggatcgcttgagcccaggatttggagaccaccctgggcaacaaagtgagactcctgtctctacaaacaaaaacaaaaacaaaaacaaacagttggctggatatgatggcatgcacctgtagtctcagctactcaggaggctgaggtgggaggatcacttgagcccgggaggtggaggccacagcaagctgtgatggcactaatgcacttcagcctgggtgacagagtgagaccctgtctaacagcaacaacagcagcagaacattaatccggatagttctaggatgagggttctcagagctagatgggcctttgcaagttctttccactgatccccaggtttggttgattgtatgaaaccaagaggaaatgtacagggtttttgtgaagaaaggaaagtgtcatttctttgggttttactttgaatggcattggatgaggtcctcagagcttatgtggggccagcccagcctgccccatgtgccccactgagaccctggaaacttggctttctcccactgctcccccagtgctcactgactagttttggggttttgtggggaccctttgtctatctgcttcgtcttccccagatgaatcaggggacgtggtggtaccatagtggtgctgagggcagcttctgggtgggggttctcagaaggagaagtctgtccaggaagattatattttattaccttctccctcatcttatttattttctgtttttttagaggctgggtctctatgttgcccaagctggtctcgaactcctgggctcaagcgatcctcctgcctcggcctcccaaagtgctgggatgcaggtgtgagccactacgcccagcctcccacctctttcttatttctttattgtttatttcaacaggtttttggggaacaggtgtgtttggtgacatgaataagctctttagtggtgatttgtgagattttggtgcacccatcacccgagcagtgtacactgcacccaatatgtagtctttttatccctcacctacctcccaccctttccccaagtccccaaagtccattgtatcattcttatgcctttacatcctcatagcttagctcctgcttctgagtgagaacatacgatgtttggttttctattcctgagttacttcacttagaataatggtctccagttccatttccatccaggttactgcgaatatcattattttgttcctttttatggctgattagtattccatggtgtgtgtgtgtgtgcatgtgtgtgtgtgtgtgtgtgtatacactgaaatttctttatccactcattgattgatgggcatttgattggttccatatatttgcaattgtgaattgtggtgctataaacgtgtgtgaagtatgttttttgtctgatgacttcttttcccttgggtagatacccagtagtctcctacttctttttaaaggaagccttgctctttcttaaaagctgctaaaaaggaatgagagtggcgctacagcaaacatctattgagcgcctactgtgtaccaggtgggtggctatggtggaatctaccacttcttaaaagtcaccatccaagttaccgtttttctgaaatactttgtctttcaactgagtgctttgtttttagtgatggccagtgaagggcccaattcaaacagaagcagagccgggggatactgaagggcctttctccctgtgagccccttagaactcaggcagaaatattttagcaaaaagtcgaatctgtacttctctggcttttaatgggttatattgaaaaggatatgacctgcctctaaggttgtaacttacgtttggctcagtcttaattatcttaacaaggggtgcctccccacccatcatccccataccttgtatttatgcatgtattgacttttctcccactttgatagcttgaaggcagggctgcagtgtttctcaccttggcaccccaggcttgagtgatgcctggcacacagtaggtgcacggcacacatctgagttgagatcctgatacgcaccctgtataagaccttcaacagcctgtcgaccactcactgcctccgtttcctcatctgttagatagggatgatcataagggttctttcttgcttgccttatggggccttgatgagaatcaaatgaaatgatgacatcagtcccttaattatttctcctcctcctcctcctcctcctcctcctcctcctcctcctcttcctcctccatctcctcctctcttcttcttccttttttttcttctttcttctttctttttcttcttcttaggcagggtctcactctgttgcccaggctagagtgcagtgggatggtcataggctcaagtgatcctcctgcctcagcctcctgaataactggaactacaggtatgtgccattgtatctggctaagtttttgtagagacagggtctcactatgttgcttaggctggtctccaactcctgggctcgagcggtcctcctgccttggcctcccaatgtgctgggagtacaggtgtgaaccactgtgccaggcccctttaatttattctgaaaatggcgtgtcaggagctgggtcttggctgccttgcttgcattgtgaaatccccttgcctggcaggtaggaggcagtcgatgcatacagggtgagtgaatgaaatgttagttagttgcattacattgaagtggtctaaacctgactctaagatgtgactactaggctgctgatccttttatgatttttcaagtgcgtagttattttccttttaaaagctaatcacatttcctttcctgactgatcctctgttatttctgcctcctcccccaaggggctgaccaccagccccaggcatctccttggccagctcagtggatacacacacgtcaggaagaccctcccttgccccagccttccttcgtgggtggcactggacactgggcagatggaaaggccctctccatggagcactgggctggcgagggccttcctgtctgtgccctcatgatgtcctcacttggctgtcgaggcatctcctgggccatgaagtgctgtttgctgtcctggccttggattcctgcatcaagtctcccagcaggaaaactgttaaaccaaaaccagtgttgggaactgcatcagagctggggaccacatcagtgctggggacctggatcagcattggggacctggattagccctggggacctgcattagtgctggggactcgcatcggcattgggtgtctttttgttgcttcctcaagtcctagttttgactctggatgaagcttggtttgtgccgtgggagtggagtgttgggggacaggggtgaccggcgggtgagccctcactgttgatcctggcctcgaatgggagaggggcactagtgcccctgggagtgggccaggcatgtcccagtccactgcctgccccagagccccgcctggagcacctgctgggtcgggacatgggcctcccgtgggcctcaccgcttcctgcttcagcagaactgggattgtcagttaatcgagcaacacctccaggaagccagcctcaggaaagagcttccacagggagttgggggactggtaattggaataaataaaagctaatcgtgcttcctggatgccaggaaccactgaaatttgtggattcccacagcagcacatgaggctggtcattgttaataacccctttttaccgacgaggaacccagaccagacagagagcccgcctgtgtcacctggtagggaggggctgggcctggtgttataaaccaggagagggttcaggccgaggaaagggggagcaagttgccggccaaggtaggtatcatgcgagtcctacttctcccctcattcaaggaccttcctttggggaagtgagtgctcccgagagcagcctgccgcctccgtgtcggggcagcctcagcttcttctttctgtgtccgatatttgatttctgttgtcgtggaaacggggtggcaagtgttccatgtgttagcatttggtcctcctgacgtagtcggcacacgggagatgcagctggggtggcacgtgcccacagtggtgccacctcttgccgggggtcaggcagaggagacccagctccgtgccagcttgcagacccccaatcacttctcctgtctcagggcccagagagcaaaggcagtgggaggccaatgtctgttgttcagtttagctctgagccacgtgcatcttcagtcagcccaggggcctgggcgcgcccttccttccttctttgtgcatgggggttttcctggggagcagttgccctggcccatgaggctgatgggagtcaagacagaaatagtggtctgtggtcagcaaggagctatcgctggaaacaccccggtccttccacagcctgaccctctgtgaccttcctcaaaggctccccaaagaggctttcccttgaagtgcaagtcatagtggcgcccctgccacgtccctatatgaacggggtgtgtgcccgcctgccctccgacgtccgccggctgtgctggtctgcagagctgccgccagctgcaccctcctcgccagtgagttctgttgctttcgtatcattttcagcaggagctaaacccaggccagcccttcttttcttttctgctttatggcagaattttgttttgcaagaatggaccctgggtggctgcttgacttttcccaggaaggtgatggggacgttggtgttaggacgatgggcaagggggtccaggttgtctcactgcggccccagagggatgagggtctgacttgtggagtgaaatttccagcactctgctgggggcgagtagatcattgggcccagaagaatgggatttggaacattctcaggcacatgctgcaattaagattttctttttcataggggtacctgatactgtgggtttctctctctctgtcttttttttttctctctgagatggagtcttgctcttgtcacccaggctggagtgcaatggcgcgatcttggctcactgcaacctctgcctcccaggttcaagtgatcctcctgcctcagcctcccaagtagctgggattacaggctcccgccaccgcgcctggctaatttttgtatttttagtagagacggggtttcatcatgttggccaggctggtcttgaactcctgacctcaggtgatccacccacctcggcctcccaaaatgctgggattacaggcatgagccaccgcgcccggccatgggtttctcgttagtggtcttcggttctgtgtttcccctctaagtagctgatcgtggccggtgcctggctttcccctggtcaccactagatattctgtcttgtctttgggaggcagagtcagtagaaggtgctttgcactgggcatgcctgggagtgagcccagccttgctgttattagcgcccatcgtgacggtcggccaggctgccctatgttcgatttttcctcctgtgaaatgggaacaacagtagagctgatgtgtcctgggctttctgcatcccagggactatcccagctccttaacgtgctttgctcagtgctatcctcctaaaaagttttcttttacagttgagtaagctgaagcccagagaggttaagtaacctgcccaaggtcacaccgcagatcggaatgggagtcaggagtgtacccaacagcctggctccctagtcagtgctctcaacctcagcttgaaggccgcctccctgggccctgctaggggacccagtaagatgacagttattcacattctcctttgtttctgataccaagcaaactcctggtaaatgctccttccccacttttgtggaataaagaatgcacatttttttctgagctctgcctgggtatccttaaggagagggacgctgtgcctgggacgcagatgaacaagataggagctgtttcctggaggagctcccaggctgatttttgcctttgatgttctgcatctttttcacaggctttttgtagatgtgtggggatatttctagaggagaaaccagaggtggaaggaggggcataatgaaattgaatgctgggcatctcttagctcacattatatgaggctcttcagggacaatagaccttgcaataaaaggcaaaaaggtgattgcgcacagagtgcttttcctgcacagtgctgggcgggatggggtggatggggcttggcggctggaggagggtagaccctgcccgcacctcctgggacctgtgcgggactttgctcaccttgctgtttctaaccaaggtaccagattctcttcactcaggtgtgtcagattttaacccttgaggctagaaccttgccaggcttattcgaagtcagtggttcctagtagtcacagggcccctgccctagaccccagaccaggaccccccggcccctgcccgcccgccttggcctggtggggtaggagtcactgtgaaaggggtcctggagcccagtatcactccagcgacatttcccagagagcatcctggggccagtgtggggtgtgggggaacagatactgagcgctctgtcccctccccttggagaatctcacagtacattagcagagtcaagactctgagaagtccggtaggaaaagacacctgcttagcttcccttaacttcacgactcctccacctccttgacctttgcttgattcatgtgtgacctgtgaacgtctaaactgcaggactcactttgggagatactgatggagaccaaataggtgtcctgctcatatatcctccacttcttcagttttgctcaggatccactgggcttcctaaaatgcaaacgaattgaaaagctgtgctgaatgtgtttttctctgtctgaaagtacagccacccacgaaaggaggaggtctgctaagttttcttttagaaaaggggtccccaggctctgaatgcttgaggacctcattgggatcaccccctccattgtgggctacccatcctccacccgctgtggcctattgataacctcccagccaccacctatgctcctagaggccctgactggaatccctgtcctcaccctgagtttgtcacctccttccaaacttcgtgtcctctgttgcagttgaggacctggaagtcatgattgggctgattagtgatgggtgtttattttgaattcttaactaaacaaggaggaatcacatcctagctccgtattttactagttatgggaccttgactttcccaagatctactttccttgtcagtaaaatggcaataatcggggtaacccataccctgattgctgagaacccctgtaggcgtccatgcctggcccaaagccaggacccaggaagggaggcgcagctgggcggcctcttctgcgtctctgccagttgctggcttggattctaacaccctccttccctccctccctcgctctctaccagtgggatctgagaccatgaaaacgtttgaaggtttctcaagcgtctgtgactgccccacgtctgtcgttgggtggaaaggactttgtaattgaacggagtcagttgtaatgtgaatgtcatgtggagctgcttttccttggcaagtccttgctgtgtgagccattgtttccagatctgtagaaccctccctaccctgtccccctttccgggctattgggaggctgagcgagctcatcatgaggcccctgaaagatagtttctgtgccctgtggagctgagtccccgagtctctgtccccacctcacaggccccctctcaccaccctattgggttggtaaatttcaagttgggcatcagataggacaagggaaggggactggagaaggaagagccgacagtttgccctcaggacttcagagtcactcttttttgtttggttggttttttgagatggagtcttgccctgttgcccaggctggagtgcagtggcgtgatctcatctcaccgcaacctccatctcccgggttcaagcgattctcctgccttagcctcccgagtagctgggattacaagtgcatgccatcatgcctagctaatttttgtatttttaatggagacgggggcttcaccatgttggccagacttgtctcgaactcctgacctcaagtcatccacccaccttggcctcccaaagttgctgggattacaggtgtgaaccatcgcgcctggcccagagtcaccctttctttttgtgccttattagacatcttcctgctacaggatagcccagaagaaaggaacaagtttccgtcatgaataagtcccctacctactagggatgtagggataaaggactggaactctctttcttcaccctgcagggcaaactccttcaagactcagctccaggaagcctctctggactactacactccctcctgagcccccagccttctcacatacctcccttatgtgtctcctgggtgctggagccctcagagcagggcctgtatctaagtccccctgtggcccacccagtgccccgtgccaggcctgaccatagtggatgtcactaagcagttgttcaatgagtgaatgaacaaatgcaaactaggcccaatcttatcaaattatactagaataattgtataaaaaaccagacttctttaagtggaggaaatttaaagtcagaagtgggctgggcacaatggctcacacctataatgctagcactttgggaggctgaggcgggcggatcaccggaggtcaggggttcgagaccagccagcctggccaacatagcgaaacccgtctctattaaaaataacaaaatttagctgggcgtggcggtgcatgcttgtaatcccagctactctggaagctgaggcaggagaatcacttgaacccaggaggcagaggttgcggtgagcggaggtcgcgccattacactctagcctgggcgacagagtgagagtcagtctcaaaaaaaagaagtgaatgaatacgaccatacctgcttttccagctcctgactcttaaacgtctcgaataccaatgccaaataaagggaaccgagagatgaaaggtgtcactgtcctgatcttcagatgcagaaatttctgtgtagctgaggaggtggggcccgcttgcccccctttgaattttgggttgtgcttgagcagaagcattcattgcttggagaaagcagaggagaccccagaagcacttccctctgaaagggagaagcaggtaggccaaggcagcggttctgggaccagctctggggccacctgcttttcccacactgggtctgtggtgggctcggcagctggcctgcacacaggagatcctcaaaacagatgagcgagcatgattgccatttttacactccctcatttaatccgcagcactggaggaggtgtgattatggtgtgtattttgtgcagccatttggtggacacctaccgaggacccgccgtggggcaggctgctggctgggctctgaggatgctgacgaggacccttctttgggatcctctgttcgggttgaagacagtttatgaaaacataagataacagaatggccgactctgaggcaggagccaggggtgtgtgagtgggggtcctggaaggggtctctggaaaccagaggaggagtggtcctctgaggctggccaaggctcccagcagagagacgggggcatgggcagaagcctgtcgtgccagtgagccctggcatttctgagcccctgatcggttctgttgcctgcacgacggcctgggtgagcaacactgacaggagacccctgccttagtaccatgtctcctgggctctggctagtggcgcctcctggcagcagctgcccaggccacacaggatgctggctacatgcttggctggtctggccatccctgcatggccccgctgtcactggtatctggagatcacacccagccagagcctagtgccaccctcggatgcttccttggggagggaggatgccctgtttccatggcaaccctaggtgggaggccagggcttcaggcaagctgctgagcttttcacagccctgggagtgaggagcagggcaggctgaccctggcctgtggggcagaattagtagaggaggagccccaccatccctgagaagaggaggggagtggggtggggaacattagacaatgttcactgcccctccctcagcttcccagctgcccacggcagtcccaggccaggccagtgtgggcgtggggggcagttagagcgtggccgtgtggtgtgccagcacgcagtgcaacagccaagacaatggagtcatcccctgcccctgggcccttccctccaccccacctcatgtctgcactaggtgaggaagcagaggacggaggagcccagtgggctctgggagctcctgggactcctgagtcggtggggacggggcttcccagcctcaacactgaggattcttggttgtggagctctcctgagcattgcggggtgttgagcggcatccctggcctctacacacgaggtgtcagttgtgacaacccaaagtgtctccagatgccactacgtaccctcccagtgtgggggtggaggaatcgtccccagttgagatccgctgagctgagaggctccccggaagcaggtggtgaaggaagggaaggccctgggccctggagacatggatgcctgcctgggacacacacaaacacgcacgcacatgcacgcatgcatacactcactcatatgcacacatgttcatgcatgcacccgcagtgaccctgaagggactagactatttttagagcacttttaagttcacagcagaattgagtggaaggtgcagagatttcccgtgactgcacggccccaccacgcacactatcaacatcctccccctctaacaacgtccagaccagagggtgcatctgtggtacctggtggacccacatggccatatcagggtcacccagagtccacagtttccatgaggggcccctcttggtgctggacattgtgtaaggacagggacccccatggtagcagtgacactgccctgagatccccgtgccccacctgctcatccctgtctccctctcactcctggcaacctctgctcctttcactgtctccgtagttttgcctgccccacagggtcgtgcagttgggatcacactgtctgcagccttttcagactggtttttcactcagtgagatgcatttaagtttcctccacgccttttcacagctgacggcgcgtttcttcttggttccaagtggctctttctgcattgtctggacggatccatttgttccctgtttgcctcccagaggatccgctgctcttgctgcagatgtatagcccaggtgctgtggagttgggatggagcagtcgagctgggatcagagcccaggcccctgccctgaggttggagctctctgactgcacctggcctaggcctgtgcattgtctaaactgatggccgtggggcaggggacctggagcgcaaagcaggagaggatgctgaagggggcaggtggggccgggacttgggagtgtctggaaggaggaccgcctgcctcaacccagggctggtctgtggaggccagagcgctcagcccctcaatgctaggcctgttgtgagtttctccatgaggtggccctctcagaaagagtggctccacagcagctgagttgggggccccatggcagctgagtcgtggactccatggccgctgatttgggggatgcctgtccttgtagagactgtcacctctaggaatggtgaaagggcggccacccgcagccctgtgtcctctttctagtcctctgtcttgtaagcccggtccccacagtggccccagtcctcccctgccagaaattcgttctcctcagaaatccgttctcctctctgatctttcaggcctagagacaggctcttccctccggagggtgcagcccaggggttctggtaagatacagagcccagcctcaacatagcaggaagtttttccacaaatacacagttcttcaagaccacatgcagctgtgcgtggggtgtgttttgaagggcaatggcaggagcagtgtatgcctcgtggtgcagggagcacgagttgtttataggcgtgcctgggtcctgggtctctgtgcaccctcctctagattcatggggcatctgcccaccgtgagatagataagccagggtgcctgcccctttctcaggtgagatgctgagggccagaaacatgctgctgtgtcccatggaggaggtggcctgccccaactcccctgcaccctagggagagtgcccacaggctgggggctggggctgggtcctgtgccccctccccagccctcggtatgtggctcgctgaggtgtgcgccggaatgttgggcacatcctgtctgataccagcttggctggaagtcgaattatgatcagaatatcacatgatgtgtggcctgggtccccctttggttgacactcttgagtatgggtcctgtgcctgcccggggccaagcagcaggtgcaaccgggcctgccctggggcagcatggggtgtgctagtgtcctggggccactgtaacaaagcaccacaacctgagtggcttaaacaacagaaacatagtctgtcacagttttggaggctggaagtccaagatcaaggtgtcagctgggctgtgctccctccagggctccgagaggatcccccttggcctcttccaggctgtggtggctctggtgttccctgccgtgggccacatcactccagcctctgtctccctcttcacgtgggcctccttctccgtctgtgtctctgtcctctcctcttcttgtaaggacgcctgtcattggattagggcccaccctaatgaccgaatctgcaacttgattacatctgcaaagaccctgcttccaaataaggccacagtcacaggtgttgggggccagactccagtgtgccttttaggggagatacagtgcaatacacagcacacagtgaggtcttccagatccccagacctatcttcttccagaccgccagacaacaccgataagggtgaagttggcttacgagtcctggccaggatgtgacggggagtcgccaggtgggtgccggggaggtgggaagctctgcaggggattggagaaccacacgtcattgcccacatgtgactttaaaccttagcaatgatattggagggggatagttactctttttttttcttctgagacagtgtctcattctgtcatccaggctggtgtgcaatggttctagcgattctcctgcctcagcctcccgagtagctggtattacaggcacctaccatgacactcggctaatttttgtgtttttagttgagacgggttttcaccatgttggccaggctggtttcgaactcctgacctcaagtgatccgcccacctcagcctcccgaagtgctgggattgtaggcaggggatattactctttacagctagggaaacagttgggcttggtgacatgatagagacaccaggtcccttgaggacagggggccatttgcagagccgtgtggtggaaggagcctgaatttggagccccaagctcacagcgtgggtccttgtcacatgtcctgtgagctctgtttgcatccttagctcaggcaagctactgtgttgaactggctggacacagtgtgtctgtctctccctcttccagagaagtcctcacttaaggttgtgtcactgtttttactgatgttggaattggcacttggagatgtgaactttcccaaggccacacacccagatgagtggttagacccggacctgcctaactccagcatatctttttcagggggacacaattaaatccacagcatggactgagttcccctcttctctgccaccatcctgaccttttcctggccagggttaccatgtcggggcaggcatgggggaagtggtaagggaggtatctggacctagtaaaaggctctggtcctcctgcttcctcttgtaaggaccctgtcaatcacatcgggccccctgaataaccaggctaatctcccaccccaaggtccttacctaatcacatctacaaagtccccctcttgccatgtgaagtcacaggttcctgggacttgatgtgaacatctttgcagggaccatgatccagccttccatagaggcagtgacagatggagtagaatataggtcctttgagtatttatttatttaagatggagtctcactctgtcgcccaggctggagtgcaatggcgagatctcagctcactgcagcctctgactcctgggttcaagcgattctcctgcctcagcctcccaagtaactaggattacaggcgcagaccaccaagtgcagctaatttttttgtatttttaatagagatgaggttttaccatgttggccaggctggtctcaaactcttgacctaaggtgatccacccgcctcggcctcccaaagtgctgggataacaggcgtgagccaccgcgcccggcccctgtgagtttttacaagagacactgcagtagagagaatggtagagtcctcaaaccctgattcagtcgttcatgaattcactgagcactcaacgtttcccgcaatgtgtgtcctcttctttgccagcctgctggtgtgctcctggtgcttggtccaccatagatgggtgtgcttggtccaggaggctgatggtgctgacatctgggctgatattcaccgtttttagtgacttgaatgacgtccatgcagaagagctagtgcaccatccttgtgtttgaaaatgcccgggctccagcctgagaacctggtaggccagtaattggagggacagtagcaggatcgagaagccatctgtgtcacgtgttcttggggacaaagaggagacacaggctcaaggaacagcaaggtttgtgggacacagctgtgtctgaaaacgtcaagcagttagctcatccctggctacttcctgtgaacccattaaatccccaggctgaggaggacagagggtgagggaatctgaccccttactcagccctttagccagcggctgctgtgctaagccattctgagaagccaccggtggagaactgacttcaggtcgtgctgactgtgaggccatccagttgtttttgcacattgaaaacaatacattacactttgggaggccgaggtgggtggatcacttgaggtcaggagttcgagaccagcctggccaacatggtgaaaccccgtctctactaaacatacaaaaattagccgggcatggtggtgggcgcctgtaatcccagctacttgggaggctgaggcaggaggatcgcttgaacccaggatgtggtggttgaagtgagccgagattgtgccactgcactccagcctgggggacagagcaagactccttctcaaaaaaaacattgttccggatttgctaataaggaggcaacctcctcagaccttggtgtcacaggagaatggcccgcggcagccttagggccagttgtgattttatccacagtgttggtcagatgcgtcctctgtgcttgtttaatattcattctgcttgcgtgaacaaagccatgtcagtttcagtaacgcttgtgccagggggcacccggtgtggagcagggctcagtaaaactgctgcaaagaatgttccaggctttttgaaattacgtggagttgctggggctctcttgaggctgttaatttacttagggctgctgtgacaaaataccacaaacccagtggtttaaaccaacacaaatctattattttacagttctggaggtcaggagtcccaacatcaaggtggcagcagggccggttccttccggaggctccaggggagaatcccattccttgccttttccaacttgcagaggcacctgcgttccttagtgcctggcctcttcctctgtcttcaaagccatctcccgatctttctctgtctccttcgccacacctcctctggctctggccctcctgcttcctcttgtaaggaccctgtcaatcacattgggccccctgcataatccaggctaatctcccaccccaaggtccttacctaatcacatctgcaaactccctcttgccatgcaaagtcacagtttcctgggacttgatgtggacatctttgcagggaccaagatccagccttccatagagacagtgacagatggagtagaaagtacatcctttgagtttttacaggagacactgcagtagagagaatggtagagtcccgaaaccctgattcattcattcatgaattcaccgagtgttcacggagcacctgcctcagtccaggcgtcatgttgggagcaggggagacagagcaggccatgcatctgtcctttcagagcactgtagacgcaaatcctgtagcacagatgtgccttagactaatagtgcctcgaaaggagaggaaggggaatggatgcggggagtggggaacctgacctgctttgtggggtcatggagtgactctccacctgccgtcatccctccatcccttgtttggggctgttcctccaaaggtgcagtctccagcaggggtgtggggacccctgtgggccgtgaaggcctttctccttttctgctgtgggcattgcatctgttcctgatgggtagagttgtctgtgcccggtggggcccaaggcagtgccatggtggttctttgagtatctcaggtgggaactgagctgccagcaccagaggccaatggcttccagcactccccaaatccacctgcttttggaaggggcctgtctccgaagcaggccgggtcctcctgttgggggaagctttcatggaggcatctgtgtcacttctgcaggggagacagccgctagagggcactgtccttctggcctttcccacatccccgtttccatggcaggtgcatagtaaagcctttctttttctaacgacttaatgatttaatcttcttattttctcagcagacaacgctttggacttccctggatacattgggacgttaccagtcacattaattaatacgagtttcacaacttgggaaccagcgaacgtgcttctccagacttagcttctgcacggccgtttctgctttcctttatgaagtgcgtttctctaagagcctggcagtctcatggggctcgtctgttgctggaagtgagcagcgggttccattgccccccgcctcggtggggctcattgtgcagcttgctggcaagtggctgggctcggaggggcggtgacggtgacacacgccaggggaaaggttggcatcctcttctgagaattgtttcttttgggtttcacaccctgcccccaccttctgctgcctcgaggctcttttcttcttattattagctaatgacagatttcatgaccagtgactgaaatcatttggaagtaccccctgaaagccagcgtgatgggttggagaaatgtgacagacgcagcctctgaaaatcacagaggcagaggcttgcgtcgaaggacttgctaaggaattaggatgagagtggtcaggaggcagtggctgctgggcactggagctgagggtgaggggccgagaaaacgggaggcaaatggggtagctcttttttggggcgggggaggctggctttggggatgtgtatcccactgtgcaccgcaaggtgggggcactgggcggtaggttcccgtgctccggaagggtggcaattgaagggaggaattaaagaagttggccaggtgcggtggttcgtgcctgtaatcccagcactttgggaggccgaggcaggtggatcacttgaaatcaggagttcgagatccacctggccaacatagtgaaacctcatctgtactaaaaatacaaaaattagctgggtgtggtggtgcacacttgtaatcccagctactcaggaggctgaggcaggagaatcgcttgaatctgggaggtggaggttgcagtgagccaagatcgagccactgcactccagcctgggcgacagagcaagagtccgtctcaaaaacaaaaacaaaaacaaaaaacaaaaaacaaaaactgactcatgtggctttcagtctgagaaaccaatcagatcatcattgtctctaaagaatgtgtcctcctttgtagacaagaagctcaccggcccctccatgccccggtttctcgcccaggtgggttagacggccaacctgacattttaccgtgcacctggaagtctttcttcctgttctccttcccacaaaggattcatttttctgtggttctaacattttcctgatcaccccagggacaaaggggaagaaaagaccgtgtttctgggccaagggaatcatctgtttaacatgggcttcggagctttttttacatttctatgtaagcaacttttcgtattcagaagacccagtttccctgagccagatggactccttccatctcggggtggtctgtatttcagattcctgcagcaggtggctggtcggaatgcacaccccaggaggtgaggctggggggatgttggctcctgggctgcttgtactagcaagtccctaattgcggagcggactccttcctcctgagcccatcagcctctacgtggccacatcagggtaattgggttccttgtgaaacacgactgccaggctaatgtaaaccttaatggaaaccctctttttccacccaattaagtggctggaggtgggatgctgtgtgagagccgtcagttcagttccctgactttctcttgtagaaattatctatgtagctccatttggcctacataagcttagcatttgtgttcattcattcattcattccacagatattcagagagcagttatccatgtgctgggttttatgcaggatgtgaggccatggtcatgaatgggacctggcccctgtgcactccttgcggggtcggggggtgcagggagatgagcacagtccacaatcacatgatcggggaatagggtttgtcattgtcatgtgcacggggagctgtggaaacccagaggaggggcccgaactgcacccagggatagaggatgtgcagagtgtgctttccagacggtgggaaatgggtggagctagctgacctgaagtgaagggcattgcaggttgtggggacagtcgagcagaggggcagagatatgacctacagaagtggcctggaatggcctcatcagacgatgagtgtggaagcatggtaactgcagctgtattgatgagaggaggggtctgctcattaacagtcatcgggtaccactatgaaggttttgcgttttaccctggagctggtgggagccatggggtgcactgcagcagggagtgaccaacgccagctttgtgtattggaaggatttctacatcagacaggactctcttggtttgcaaaggacagaaaacccaactcaaaatggcttaaaagcaaaacagaattcactggtacatttgacagaatggtctgtggggttggatggcctcaggtaaggcttgatccagcacatagaaggtgttgctagatcctagattctgttctccccttccccgagctctttcgatctggtgccttcatctccaggctctgtatagtggtaagatgatgggacggcttcaacctccatcctttctgggtcaaggccagtgggaaggagtgcctgtctcattctctattcctggtaaagtctcagtgcagttcattagctctaactgggccatgcccatccctgactgtgttcctgggaggccagtgtgccagctggctttgtcctgggatgcctgctccaccccagagctgaactacaaggcccgagcatggtggcaggaggggtggctctctctgagggaggctgagtcttgtttgcctgaaaggatcaatggatgctggagaagaaaagcaatggtgtccataacagtcacctccagaaggggagaggctgggctggggtgggaagagtttagggcagggcttgcaggggccaaggtggccatcctggtgagaaagccccactggccaatccaagaatagggcacgagatgtgagcctgccaagggtactcccaggtctggcatcttggttctttccgctgcgttcttggcacagacactcatgccagggcctttgctgtcacccatagtctcagagtcatgttattattctgcagtcatctgtggggatgggaccgtgcaggactttccctccccagcttcctccctccttcagggtagctcactgtgtcccccgaggcagccagtgctgccgggagaggcccgagactccttctgggtctcagagccatttctatggttgaacccagtgtgtgtccttccctgtagaattggctgccactttgtttcctttagggtccccactgcaccctgtacataaccctgccaggacatctgtttattttccattcttgtagctttatttttatttcaaaaggagtacaagaacacagtctggtggcagagcctccctctgtctcctccttaccttcagccactgggccttgcatcagtaatgctgctcttgtcattctggagcatgccctttcatttctttttctgtgaattttgatacgtacacatagaaatacatagtggtgagttttctagttgtattttttacataaatatcatgctgtatttattttaaagtgtctcaccatgttgcccaggctggacttgaacccctgggctcgagtgatcctcccaccccagctccaagtagctgggacaacagatgtacaccaccacacccagcctttgctgtattgttctgcaacatggttttctttttctttttctttttctttttaattttttgagacaagatctggctctgtcacccaggctggagtgcagtggcgtgatcttggctcactgcaacctccgcttctcggcttcaaactttcttcccagcctcctgggtagctgggactacagattcacaccaccattcctggctaatttttgtattttgtgtagagatggggttttgccttgttgccccgctggtctcgaactcctgagctcaagccatccacctacctcagcctcccaaagttctgggattataggtgtgagccactgcagctggcccaacctgcttttgcttttttaaaaaatctcaacaccatgctatgtattgcacttaattaattgtgcatcgaatccttcacgagccttctgtgccaggtgcgaggtcggctgctgggtggaagtgaccaggatacgtcttccctcggctacacgcagactctccacggtgcaagggcagggcctgcccagccccatgcccagccctttggcatccatccaccagtgttagttagatcagcaggctgtcatgcccaaggcttgctgccatctgaataggacagggtttcagcagtgagctcttgatgtggagtctgcgccacctgttgaccttctttggatttaccttattgaaatgttcacacatttcttttagcttctcaacttatttcatcttgagaaatgggctggaacctcatgccccagcacaacaagccccataaatcagatgttcaagctgagcgatccttccggtttgggccacagtcacggggctttcttactcctctagtcatgtcagcaccgttcagaaactcatccttggcttagagatgatagtgagttacatgtacataaatacaccgagctcattaccctgggccggcatcctgcatgacaagggcccacatccatttctcggcaaaaacaaactacatctgccacttgaaacgtcaagaagcgctttcttgtatgttgtgctccatggatcactggaagtcctttccctcttttcccatgtccgggccaggaggagcagctgctctctggcactgttagcctttgctgccttttatcctaggcaagacactttgttattcctccgatttgtaatcccaagaaccttggagattggacttggagttcgtaacctcctggggagggccaggcctcacatttcaaggcctttgcacgcgtgatgtgccagcaacagctcagccctttgaattatgatccgcgactccctccaatcaccttccttctggatgtcagaaaagactgcccaacagcatctcctcccagctgccgaggctgatgatgtttttattctgatttagatctcacttaggtcttattttaactccactgagctgcaagatcttcactgaagtacaactggacttatttttagaaaaactgctctgttaagaagaccttcgtgcctgatgaagttagttattctgataaattacagcttctacgaagaaaccacacccctctgagtacggatggaagttggaaaattcatagaaagctgtcatttcctggcagaggcctggaaaacctcatttaacagagatgtctttgggttcctgcttaagcccaagcgaaggatcccgatgccccctccccagctgggaagaggagctggtggcgtgagttggcacagagccgcacctttctttctcctcctgtatcctcccgcaagctctgaagaccactctgtttctttgagcaggatcagttgtaactagaagtgggtaggatttgaaaagggctggttaagtgtttaaaactggggcagctttcctgccattttccagttcttttagatgtgcagggatggagaatggctgtttttgttggggttttctctttgatcctggttcagacggggccctctgaaatttctcgccctgatcttttgttctctatgaaaaccaggaattgcacggatggtgtagaaagtccccgtaggtggcaaagcatctctgctgtgttgaaatgacacacttagaaaagtgtcagaaaatggagttgccattgctctggccccccaggacctgtggctcagcctccattgggcctttgtgtctgggccagaccctccaggcaagcccccagtgaggctcttgggcccgtgattgcaggggcgccttgccatcccccgtgtcctgccctggttctgctagtggagcaagaagctgatcagcctttgtgttttcagatttcttctctccgttaaggtaaccttgttctttaaaccagcttgctttcaaagttgttttcctaataatatcaaaagggggaaaaaaagctgcctgaaaatccttttttgggaaagagcctgggcataaataaataaatacaaccatacaaagaagaagattaaaaaaaaaaaaatcaaagatggaactttcgcatttggcctgaggtataaatggcaggcttctgatgacatgcttttagtttttgattctctttctttccttttatgttcttgtaattccaaatcaggaacgatggtgtttttttttttttttttcttttttcttttttttaaaccttgcccaatctttgggtggaggctttggaagccgcacatattccaccattatagttactcaaagctgacgcttcccgaggggtggctgcatgctggcgactgtgccgagggtgtgtgtccctgaatctttgtgatctctctgaggtgtgttaggccccactttacagatggaaactgagacacacagagccgtcaagcagcttgcccaaggtcacacaccttgtcagtggtcaagctgggatccaaaaccagcagcctggctctgggattctaagctctctgttgtgctgctccttgaatatattaaaaggcctactatgtgcaggaactgggttggcactggcaggaaggcaagttcgggaaggagatagttacatggctgtgtggcttcagctggggagaggggaacacccaggagggcttcttggaggaggcggccagtaagatgaggttgaagataggtaggatttagtagggcacagtgaggtgcaagatcaggtagaactggctttagtcctgactctggggcttcacatctaacagcacaggaccagccactccctcacagacttgtttatttattattattgttattatttttgagacagacggagtctcgctgtgttgcccaggctggagtgaagtggcacaaccttagctcactgcaacctccacctcccaggttcaagcaattctcatgcctcagccgcccaagtagctgggattgcaggcgcccactgccacgcctgactaatgtttgtatttttagtagagacagggtttcatcatgttggtcaggctggtctcgaagtcctgacctcaggtgatttgcccaccttggcctcccagagtgctggaattacaggtttgagccaccgtgcccggcctccctcagacttgttaggagacaaggtgaatggctggcatggaagatgccctgcacatagtaggtgctcaggaaacgttagtggtgctctccccctttccaatggacagtcagcaatatgggttggacaagtatgttctgtaatccgaggttgtgtgccctctggctggcccacaaaatttgaattaatggctcgtatttataaatggggagattccacaccaaaccccacatttccagcttttcttgaaaactcagatctggtgactgcagcctgcacttcccactctgccatcccgggctgagcgaggagtgcccgtctccagagacagtgtgccaaggggccctcctcctatcaaatgccctcctgtctctctcttcctacctggccccccgtgcaggccacagagcgtggtgctgcaggtgaactctgctgcggtgggaacgagttggcatcgactccctcgtggctggctgctgggtttcgtgtggacagagacattcatcttagaacaatgcagacacttaggaaaacaagcacaaggcggtctttttcccttaatcacccatctcatgaaatcaagccccagtcccttggaagctcacaccctccacaccctccagacactgagagaatgcatgccagcatgcctgtgccagcgcgcctgtgccagcacacccgggccagcacacccgggccagcagatctttctctgtgactgaagacagccggcacttcacatctttgaagggtttgtctttctggcaagtagaccggtactttaaaaaccaaaacattcctgggattcactgaaagccagtaaactggcaccgttcaggtggcgggggggtcgggggaggggggaagccaagggtgtgagaggagcccctccttccaaaaatcacaccgatcctctgaaggtgacgatcagatccaggctgcaagttcttctgcaaaggagctgtgtccataagggaacccaggctgcaaaatatagcaaggcccagaagggcatccctcaaaccttcatggggttcagctttggacatgctggctgtggtttgtctccactgcactctgcaaagagccccgaaggccctttccttagcctggccatatttcaaggccagttcaattgctgcctcctccaggaagccctccatgcttctctgtggaataggggacctcgcctgccttgtggtcactcttcctccagtctgtgtctctcttggagcctaatcacagagaccctgtacatccacagctgcctctcccacttgcagggagtagtttgtgggccatgtgtgggtgctcacggttccccttattcctcaggaaatgtgaggaagttcctgtgaggccggtattcccaccaccccatgttacagatggggaaactgaggcttagtgcggtgaggggacttccccgaagccacacaccaacaagtggcaatgcgagatttggactggggctctgtggccacaggcctgggctcctcctgccaaccgaggggtctgccagcctgtgcccccctcctcctggtccccgaagcctttgcttccctcaggccatcgtgcataaccagccccttcagaatgcgctgctgagcagtccctgggcggtgttcgtgagcacgtttctcatttattaaggtcacaaaatccctggccctgtttagtgtcatctttgatgttcaagggcggtgtggaaatctctgttttgatatgacccaatttctaggctttcaaaatgtggcttctctcctcctccctctctgtgtttttgaaatcaggtgagcagggctgcctcgaagcgttgaccacttgccccgaggtctccctccccacccctcaggcccaggcacatgggtgcagtgccagctctcgggccttgccaagaggactctcgggcgtagcccacctgtgtaatcctccacacatagggaaactgggtcttttgttcttcctctgccatcagcgtgagcactgcaggcagctgtgctggacgggacctccctgcccctgttgtgtcctcctatgatgccagccaggacatggaacttccaccccgaccccctgtgctccagggctatcatattcccaaggatttctgtgaaaaatcacttttccctgtttcctttctgccttttaagactctctgctggttacaactctctttgtaactcgtcatgtggtacaaatacttgctgaaatttggtccctgttttctcagctgatctgggtgacctgtgggggttcttctggattatttttagagaggtggggcagagggagtctcaaaactctatgtctgtatcatttccctgtgaaggtatttaacatttgtccactgctggtgtagcgttatgctaaggattttggaaattcaaggatgagtggtgcctggatcttcccttaggatgctggctgtgggtggaggacagtgtgtgcggcagccaggctggctcgcggctggaatgtgggttacctggagagggcctgctttttttttttttttttttttgctatttaaaaaaattgttgtaaaataggcataacgtaaactttaccatcttagccattttcaagagcagagttcactggtattaagtacgttctcattgtgcagccatcaccaccacccacccacagaactctttcatctttccaaaccgaaactctgccatcattcaacactacctctctatttgctacttcccccgcccctggcatccaccagactgctttctcctctatgcattcgcctactcgagggacctcctactggtggaattgtacagtgtttgactttctgtgtctggcttatttcactgagcagaacattctcaaggttcacccatgcggtagcctggtccgaatgtccttcctttttagggctagataatattccgttgtatacgtggactaccttttgcttactcattcatctggtgttctcaaatgccaagactcagtgactgcagcagtgcccgaaggttccctcgaatcaaagaacttcctaaccccaacctgtacctaggctctgatactcctgcatcaggcagtcctctaggataaggtgcctgtttaaaatgcaaatatattaccttcgggggagtgggtaactggcatcctggggccccgctgccattgtccttatgagggagggaggttgtgttgtcctggaagtcgggtccacggtcacgtcctgagagtcccatcacgtgccatgctctgggctggggacttgatgttcattgtttggttacatttagcccttccaaagaccctggcatttttgcagtgttacctataaattccatgtgcggaaacatgggttatttccactcttttttttgagatggagtctcgctctgtcaccaggctggagtgcactggtgtgatcttggctcactgcaacctccgcctcctgggttcaagcaattctcccacctcagcctcctgagtagctgggactacaggcgcacgccaccacgcccagctaatttttgtatttttagtagagacaaggttccaccatgttggccaggatggtctcgatctcttgacctcgtgatccacctgcctcagcctcccaaagtgctgggattacaggtgtgagccaccgcacccgacctgggttatttctacttttgggctattttgagtcctgcagctatgaaaatgggaataaaagagggtccgctttttaagaagctgaatatcggcctttgctgacatgagaggagctggcatccttgggccctgctgccattgtccttatgaaggatggaggttgtgtcgtcctgaaggctgggtccacagacgtgtcccaagagcccatcatgtgccatgctctggactggacgctcaacattcatggttacattcagcccttccaaaggccctggcatttttacagtgttacctataaatgccatatggagaaataggtgcagagaggtgagtgggatgtacctggggtctcacggccagcatgagtggggccctgttggcctgctgctccaaagccatcatgccacacccccttgctgttccatcatctgccgctgtggaggctggatgtccagagctagaggtgttcaaggttcaaggtgattctggtgttaaaagaggaaataccattttacttctgaacctgtttcatggagaaagaggtacagctccgggcacactggcctgggtacctttgcagcatgtgatcagggactgctccccagcggccctccaccagtgccatgaaagtggccagggccctacctgcacccggcaccatggatgcatcttggggctggaacctcgagtcttacatgcagcagaggctgaggctgtgactgtggagaaagcgtgacattacagaagcaagggttttggcacctggtgtctgtgtgggtgggtattcctccctggtggatgtggctgaaaggcctgcagggtctcactggtgcagggagatgaggggtcatttctggttctgggattgtccctaatcactgggcgttccagatcctgtaactgttcagcactcccttgagacaggaggtcatggtgtttctgacttggagcctctggctctctttattagattctgttgcatgttccagccatcctgacccgggtgttccatcagatttctgtgcctgtgaatgtggccatcaccagtgaccccactttaaactccagattcacctgtatgcatgaccggagggggttagcatcttgagtccgtggttcaggacgcagccccccggcagagggaaggcagccccactctctcatgccccatcgctgtggtccatgctttgtctgcctcagcagtcttggtcagatctggaagcatctggaggcatctggaagctttggtgtcttagttatgagtttcaaagggcagtgaaaacagactggcagagctcagcgagacctgggaaatatttggggtggggaggaactgcagaatgtattcttggttcagagcatttttccctctgactctttctgggcaacagaccttttaggaatgtttgttaaatgctgaaaaaaacaggaattgatttctctctgcgtccacagccaacatgtgaggccacggcactccgtgtatactaacctggtttttctttccttttgctcaacagtgagtgacctgcaggaagaaggcaagaatgccatcaactcaccgatgtcccccgccctggtggatgttcaccctgaagacacccagcttggtacgggggttcctccgctccctgccctgagacagttgagcttccgtggcactaagttggtcttggggaggccaatgaggagcccgatagatctggcctcttgatcagatgctgggggcatttgggagtctaagttcttagctcaaggtcatctttagaaaagtccattgggaaaagcaagtccttcattaagggtttctgccctagtcttaaaacgtaagttttatttttcaggtggtgaagcaaacagattgggagaagactgacttgaaaagatagtttgttaaactcatagttctgaaaggaggtgtagcaggccactcagggccatgccatgccacgccatgccacgccacgccacaccatgccaagccacgccacaccatagcacaccatgccacagaaggccacatggaaagcactagtgtgaggcagaggcagaaggagcagggctaatgcctttatttgatattttatgtatatattttttgagatagagtctcactctgttacccaagctggggtgcggtgatatgatcacagctcatggcagcctttaccgtccaggttcaagtgatcctcctgccttagcctcctgagtagctgggactacaggcatgtgccaccccgcccacctaactttttaatttatttgtagagatggggtcttgccatgttgctcagactggtctccaactcctgggctcaagcagttctcctgcctcggtttcccaaagtgcagggactacagatatgagccactgcgcctggccccaacacccttactgtggctttctctgaaggaatgggcaaggctgggtgaacaggcctaggcctggcttgttggaatcgtttcactgggctttgcggtgcaggagctgtcctgagtcttctcagtaagaagactcttcttcttccacaccacgtggcgtggcgtggtatggtgtggcgtggcgtggcatgtccccagggccaggggagattagggtgaggatattggctgggagtgtaggagccccgtgagagcccaaggaaagaggtggctggggactctgggctctgcggctcaggctctgagtggttttcatatgaaaggtgtgctcacagagggtggtttaccatctctaggaattagcttgccctggaggtgcaatctctccagagtcagcaaggccccgagatgccaagcaccagaaaatacagaaaacagggcgggcacggtggctcacacctgtaatcccagcactttggaaggccaaagtggacggatcacttgagttcaggagtttgagatcagcctggccaacatggcgaaaccgcgtctctcctaagaatacaaaaattagccgagtgtggctagcctgtaattccagctactctggaggctgaggcaggagaatcgcttgaacccgggattgggatgttgcagtgagccgagatcgcaccactgcactccaacctgggtgacagagcgagacatctcaaagtaaaaaaaaaaaaaagaaaaaaagaaaatgcaaaacacaattaatatgcttcttccctttgggccagccagagctgcccgcggcctgggcttgcagggtgggctctgccaagtggcccaggcccctgcgctcactgcctgatgtaatgggtaacagccaagacacattttccttaaagtgtgttttgggatctagctgatctggaaggcatttatggaacattctgcgtatttccaaaccctggttcgaagggaagtcccggttcatcccttttttgtggtttccgtgacgaggccaggccagcaagagcttatggagaagaaacgccgatgcaagttcagccgccaaccgacccgaagccagagctggtgatgctgcctgaggtcgcaccagggtccacggggctttctctccctccgcttagaagagagtggccccaccaggctcggtggctcaggcctgtaatctcggcactttgggaggctgtggcaggtggatcacctgacgtcaggagttcgaaaccagcctggccaacatggcaaaaccctgtctctactaaaaaatacaaaaattggctgagtgtggtggcaaacacctgaaatccccgctacctgggaggctaagtcaggagaatcgcttgaatccaggaggcggaggttgcagtgagccgaggttgcaccactgcgctccagcctgggcaacaagaatgaaactccatctcataaaataataaaataaaataattagccaggcatggtggcacacgcctatagtcccagctactcaggaggctgaggtgggaggattgcctgagtctgaagaagttgaggctacagtgagccaagatcacaccactgcactctagcctgggtaacagagtgagaccttgtctcaaaaaataataataattgaactcactcactgaatatttgcacagcacctgattctttctgaagtcctctttgtatatttcatatcctttgggctcataaatgtcatcattgtagcgaatattgggggtccactgtgaatgcttctactcctcagtcccttcagtgaccctgtgaggtgggttgtatcattatccccattgtacagatggggaagctgaggcacagatctaagatcacagagatcactagtaagtgccaaagtcttgaaccccgggcattttgcccccagagctaggctcctccccctgctctagaccctctcagtgaagatggtggccctcatcagaggtgagtaggacaggtccctgtccttgggcacgttttattgcagctggctatgacgcacaaggtggggagggcgggggctcggttcccacaaaacactggcacagagataccaccctggcctctgggcactgcttctcctctgactgaagtggagagaaacctgaaccaggcccacctagcctgtgtggacccagacctgctgaagattctgagcccatgtctgaccccccggcaccccctggatggagcagcgcttgctgtacccactgtggtgtcccgggactgtgggctcctcgaggggtcctgcctcagtcttggagccaccgagaggagcatggcacagtttagcgaccactaaagtcacacagctcagagatggcatggcggctggtgtctgctctcagcttccttttaggaaaaacaaggagcctctcacagcccttttcttctctcccagagtccctggagtcctgttcctcaatgcaggatgtcagaaagtcccagggcacttggcagtgagggttcctggccacccgaagacctaccaaatgggagtatgcgggcccaggcccctctgctttaaacatgcctgcagtgactccggggcccactgaggtttgggaattgctcccctctaggccgcgtgagcagcccgtagcagactgagggccatgatgtgcagtggcctgcgggggtttcatgtccagggtccccggtcaaggctagcaggtcatgaatgctgacaggcagcaagggctgactgtgagctctggagcccccagatacagaggtgtttctcatctggagcaagcgcctgctctgaatcaggcccctgccccgtgagacgcagctgctccctggtctgtgcagagcctctgattctggcctactgtcaccatcaccaggtgaccaggagatcccggcgggatctgcagacatggacacactgccacacatagctgcctgcctggggcctgctgtccaccctctcaggcccactgttcccctctaggcggggtcaggaatgaaagctaccccacggggacaggtaaagaccggagatgcctctgagaaagtgtttggtaacagtaagcctcgaaacggcatctctgtcctccacctttcacagtctctgggtcagacgccccattcctctcagtggtcccgccgactgaggcaggacccctcaagaagcacacagtcctgggacatccgagccaccatggcatgctgcccagtctggggtcagacgtgggctcagagccttcaggagggagcagcgagttccctgtgggggccacatgagctgggcgggcccgaatcttgcttctcctcagttcagcgagagcaaggtgtggggacatgctagatagggcaatgctgagatttttagtgtgggttgaaggggatgtttccagaaacgggctctctgaaggctgggattgggtagtgacctgctcactctccgtcctgcaccccctctcatacacgtgtggactcacggcctggccctgctccttgcccgcctgagatgggtggtccagagggggtctcagacatgggtcacacaggcacacaaagtcctctttggggctggagagcttggaagatttggcattcgggctcaaggatctcagctggggagctgaggtctgaagggtgaaggaaacatgggccagggagagagtgtcagacagcgggagcaggtgccaaggctcagggcaggtggcagcaaggcttcaaggagtgagggaaggccggatgggctggagcagattgcaccaggagggcaggaaatgaggcgggagaggggccttggaggccacatggaggacgccggccttgatcccagcaggagtgggaggctgcggaggcctttgcagagatatcatcaggactcccgagaactccctgcacattacctggagtgtccttttcaggcatcagatctgtatgacttcaaaattagtttctccatgttgtcagagtttacactctgctgccgggaagttgcatcacatccgtgtcagcagcaaagtttcactcaaagccattttctttctttcttttgtattttattttattttattattttatttatttttaaaaatagagacagggatttcactatgtagcccaggttggtctggaactcctgggctcaagcaatcctcccgcctcagcctcccaaagtgctgggattgtaggcaggagccacttacgctcagcttcaaagctgttttcattctgaccgacatggtcagtgtccccagccccatgggagcctgtctgggctctgggaccctggtctcaactgtgtcctggccatctccacttgtatgtcctgggggtaactggcttctgcctggagcccctcttgtgccttttttcctctttaagagagaggtgtggtatagagcctcccggtgagtggagcctgggccccacccgacccatgctctgtgcaggtcccggagctggacagtgtggcagcctgagacccccttgcccttccctgtgtgtgttcagaggtgctcggcgcccgctggcttctgtgtggtgctgggcatttctgctgtggagcacgcctagccttggtgggtgccccctccgcagtcccgcctccccactgtctccacggcactgtcctccatgacgggctcagctggctgcctggtgtctgtgggatccaggctgaaacgtggagggaaagcaaacaggtagagaaatagaaagagggtgaggctgaacacgttttgctgttacacatcatccccccccacctttttttttgctatttatttctcaatattttttctgcatgttattttacatacaacattgcatattgattcttttccatggaatgtaccaaacattttccatttcattataaccatccagactcttcaaatgtatttataaatagtggccacagggaactacctggtgcctgaagctttcccacataccagattccggccagcggaggcatctcatgccctgtgaatgctgctctctccttatttctcctgaaaaatggaaatggtttggaccagctgctggcggagtctgggaggagcgaggccgggcagaatgatgagtttgacttcatccctttccagaagaggggaaggcgggaggatgccccatccaccttccagaaggcggttccttgcagtcaccctcccctagtgctgggttctctgcttctccatttgtcagagatgagttggcctccccctggttccccgtgtccctgccacccccacaatcgctgaccgtgacttccttttgtccctggcagaggagaacgaggagcgcacgatgattgaccccacttccaaggaagaccccaagttcaaggaactggtcaaggtaaggagctccgtcttggttggaatcttcctcttagggcgaggacttggctttggggttcagggctctcatggacaaagggagctaaacccggggctcctgaaagggatgttggtgctgcatgagaaggtgggcagacatgttggcagaggaggacggcagagaggatccagcccgaagtgccaagcgcctcccatgtgccctgctcggctggggctttaacgaccagtcttgtgaactctttgctggacagagctcggcaggaggggattttaggattaggaatgagtgctggcgtgagctagtgtagtaccttacagatggagttggaactccgtctggagcctggtggggtctagattcagatttaaccctgaaaagcaggaggggtcaccctggccactcctggccaggagccatctgatgccgatgcctgcgctgagtggacagtcagtttccaccacgtctggaggcgtgaatcccagctgggcgaggaacctggctgccccgctcccagaagtcagggaacagtgagggaaggggcccatggtgctggccttcttgggcagcggctgtccttctccagcgtggctcctgctcaccgtgaggcagtgcttgtgtgggtccaaggacagattgcagttttggttgctctgatcgaaaccacggtagggcttgagagagaatcccctgaagaggagaggctgtgggctctgcctgaccttggtgaacccagggtgggctcttgggcacacggctgtggcagacacttggcttccatagcccacggcgagcttgggcaccccgggattcttgaaaatgccgatggtgacagtgtctgccagaaacagacatttttctattaaaagtgctttttaaaaagcttctccaccttcaccaccacagtggacccaatgctgggctgtacaactgtgttttcatgagggctcattcagaataagtaagacggcttgcaagttatgttcttttaaaatctacattgaggctgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgaggtggcgggcacctgtagtcccagctactcaaaaggctgaggcaggagaatggcatgaaccccggggggcggagcctgcagtgagccgagatcgcgccactgcactccaacctgggcgacagcgaggctccgtctcaaaaaaaaataaaaaataaaaaataaaatataaaataaaataaaataaaatctacattgagaccgggcgcagtggctcatgcctgtaatcccagtactttgggaggccaaggcaggtggatcacctgaggtgaggagttcgagaccagcctggtcaacatggtgaaaccctgtctctactaaaaatacaaaaaatttgccgggcatggtggtgggtgcctataatcctacctactcgggaggctgaggcagaattgcttgaacctgagaggcagatgttgcgttgagccgagatctcgccactgcactccagcctgggcaccaagagtaaaactccatctcacagaaaaaaaaaaaaaagaaattccaaatgtcagttttagggtccacccaaagatgttgattattaataacttaaattatttaatttgttttattttttccctctgaatacccactttgttatttcaaacagaagaacgttgatgaggaaagtcactgtcttttagccacgaaaatgttgttcttgggggatatttaagcaagggatgcatgagaattatcaggcttctacaaagaaacagacccaattgtgtcaatatctagagagaggtttattatgatattggctcacttgactacggaggctgagaagtcccccgacctgccatctgcaagctagaaagctggagggccagtggtagagatgccagcctgcgtctgcagccctgagtaccgggaacagggtgggagaagatccaggtgctggcactagcagtccccggcagagagaggtgaatcccaacttcctccacctttttgttctatgggatcagatgaggcccacccgctttggggagggctgtctgctttactctatccaccaattcaaatgctcatctcctctgaacaccattccagacacacccagaaacaatgtttcattggctatctgggcaccccagagcccaggcaagttgacacagaagatgaaccatcccatgcacctttctaaagatttttttctttgatttttgagcaatgcttgagagttcacaaactccattcacaggattatctccttgaaacaacaccctggggagctgtgtcattcttgcttccatgtggagactcagagagaggtgaaggggctgggcgccatggctcacacctgaaatcccagcgccctgggaggccaaggttggggggaatcacttgagcccaggagttcaagaccagcctgggcaacatggtgaaaccctgtctctaccaaaaaaaaaaaaattaactgggtgtggtgggaggcacctgtaatcctagctatgcaggaggctgaggtgggaggattgcttgagccccggaggtcaagggtgcaatgagctaagattatgcctgtgaatagccactgcactctagcctgggtgacagagcaagaccctgtctcaaaaaaaaagacaggtttaagtaactccccacccccaggtgctggggttagtgatgtgtctgggcttgaatggctctgtccatttggtgctgtgttcactgagccaagttgagtgcgtgtggggtcctgtgctgggccctgggattcggggatggataagtgacttccctgctatgcaggatttgatttatgttcctcctggatgtctgcagtgccacccacccctgcctttgctgctttgctgccaaagacccccaggctgttttggccttggtggggcgagggctggctgctgcatgtcttccaggtttcagattgagaagaaggccacattgaggggcatggggtggactgatgggaaagctaattagcatcctttggggcaaagtacaactatggggcaaaatacaactaagaacaggaaggagctgaggaataaatgcctctccccgacttccctgatgtgggcttctgagaccatggctcatggagatgggctgcatggctgatcatcagctgggttttcttctgaagccatagccagctcatgcacctgcctcacctcccttcccctccctgttgctcgtctagggtgccctcccctcacccccaaacccctgccaaagaaaaggcatcagcagtgagctttgtcctggctctgtttttcagggaacctgggccagaatcatggtccccaaagatgaccatgtgataatccctggagccattgactatcatcttacatggcaaagggacatggtgggtgtagttagtgaccttgcaatgaggaggtcatcctggatgatccaggcgggcccagtgtgttcgctagtgtctgtataagagggacatggggagctttgactgcccatgaacatggcagcttgaccctggaggcaaggtggtagcttctggctctgaagatggaagaaggggccatgcactaatggatgcaggcggcctctgcctctagaagtggaaaagacaaagaaatggattctccactagagaacccagaaggaaccctggagcctccagaaggaaccagccctgctgacacctggattttagcccagtggaacagattttggactttgacctctaggactgcaagagaatccactgagccgttggaagcccctgggtttgtgttaatttgttacagtagccacaagcaactaacaccatcctgttctccaggctgctgcctccagctgcagctggcgtgccctggccactggggccaggcagggtgggttttgatacctgcagcggcagcatccttggccatttcctggaagggccagttgccagacactgagatgcctgttactgcaactgtcccaccagcctggagcacgtgtttctggagacaggcaaattctggaaggctccacctgctctcagactgcaggttgcgtctcaaagcaggctggcagacattttccactcttgatcaatcattttccaaaataagcatagacacagcaacccggagagcagcttcggtttggctgtcggtggcgtgttagttactgtagtggtggcacagaggcgatatacgttaaatattagttctcactgactatagccttttaaacagagcagcgtgtgggtggcagcaggtgagttggctatactgagcttgggctgcccttggttgattcttgtttgtcaggcatgcagggggctctctgtgcgtccaggcatattccctgtctggatttgcttgtgttcatggattttcagcacctcctttcttctggtttgggaatgagtcaggtcctcactacacaaggccagagcagtatgcgtgtgtgggtaggggtgagcaggtgtcattccctgcctcccctcctccttcactgccccagccaccctgaccaccttgctgttctgaggacacactgagccagtgcccactgggcatcaggtgaaaggggacatcccacaagcccaccctcacttctgacaccaatggcaagttcaggatctccaacactgccctgaggtttggtcatttgctagagggactcccagaacccacttaaagctgtcaccctcacagttacagtttctgatggtgaagggatacacatgaaaatcagccgagggaagagttgcccagggcagagttgaacgcacccacacagcacctccattgtcctttcaccatggggtcataggcagcgttactctcccggtgatgtgggacaatgcgcatgcagtattgccagccggggaggtcatctgagcctccgtgtccagagtttctgctggagctcacttgcatgggtgtggctgactgtccacatggctcatctgtctccagcccctccagcagctggctgatagagtgcaacccaaagccccctccctgaatgacatagttactccctggctggcccgagggccccaggtaagcagaggtactttatctggcagggcatttcggagcttaggagatcacctcccaggggctgaggtcacaggcccaacctctctgtgggcaaggttaggttcattatcacgtacctggtctttggactttcaaaggcccatgcctggagctgtcttcaacacttctttcagttttctctcaatgcttcctccttggagacgtatttcctgcccctgtcactccatcactctcctcctaaccccagttactttttctttgctgggcttgctgctgcctggagtcatttcctatttactagtttgtttttggtctttctcctcccctagaatgtaatcttatgctgtgagggaccatgaccattctcttcccagctaaatccccagggctggagttgtgctgcacatgcagagctaattcatccttgatagatagtaagagaaccgatgggggtctgtgtcagcagcaccaacatgaggttcacaccagcgtctcccaagatggcatgcggcttagagacaagacagatgtggttgctttttgttgttgttgttttgtgttgttgttttgagatagggtcttactctatcactctatcacccaggctggagtgcagtggcatgatctcagcttactgcaacctctgcctcccaggctcaagtgagtctcctgcctcagcctcccaagtaaatgggattataggtatgcaccatgatgcccggctaattttttgtatttttagtagagagggggcttcaccatgttggccaggctggtctcaaactcctgacctcaagtgatctgcctgtcttggcctcccaaagagctgggcttacaggcgtgagccattgcatgcccagccagatgtgtttttttttttttttttttttttttttgctctaccccaaacctgtgagatggcagggaggaggctctgggaagagggggtgagggttggggtaaacctgtggattggatgctgatgtaggtggtcccaggtgctcccttgggaggagatggacagtccggatggtgcagacaaaacacctccatccacattacctgcgtaattctctttgctttccagaacatcctttgtgtactgtggactgtgatgatctaatgctagtggattacatctaagtaggccttagtagaagccacctcccagtggttcctcggaggcatttggtccagaagcagatgattttagtgcaaagcacagaccgtatgcaggcctgagcagatcaggggacagacagatctggctgacatcctgatccgctggctgtggtggtgtggccattgcttgtagccacattgcagtcttgaatgtcccccttggaaatgggggacatttccaaggatgcctgcctggtcctctagttttctctttctctgttctctgtcatctgcacttttttcctcttgtcttgattgcttgtcctgtctcccctagtagacaccccctctgacctctgctgcctcaggactgttgctgtataaaatattgtgagatgccctctgctcctgtttaaaaaaaaaaaaaatccttagctctgggtaagctaggcactgagaatgaggccagtcattcaaaacttgtctctgagcattgattatactcatgtattatactgttaaggggtgaaggtcggctctagggtcagcttcctggatttaaatcccaactcagattaaagtgggagaataatagcaccaacgtgacaacctcaaagtgtcatttgtaaggataatgttagatcatacacttgatcacccgttagcagtgtaagggcagtgtgggaacatgagcatgaacagggcagcccagaagggagttgaatggacagatgggcaatgccagtttggaagtgggtgcatgcatccggtgggttcaggagcctggaagacttatccaaaagtcatctttgctggtgtttcttcctgtgtattttctctaaccttctccagcagtgacctgaattacttatgggtgaacactgaatgctgcccaggcaactagaggtttatagatgagatactttaaatttttaatgattcttaaaagagggagtggctattcttatgctttccagaatgaatagccaagggaaacctgtacagttgccatataaggagaaacctagacctggccttagcctctaggtcctggtgcagattcttagcacgtagcgcctaaaacctttgcgatttcctgagtgataggagcgtcttttgttattcataatgagatctgggtttatgctaacgaggtgactcagggtgggggctggccccagagtaaccaacacaggattagagggttgggtctatcagtcctacccacccccagcctctgggtggggtggagaggggctggagagtgaatcaaatcaccaatagccaatgatgtaatcagtcacacttacataatgaatcctccgcaaaacccatcaacagtggggttcagagagctttggcgctgggaaacacacatggaggtgctggagggggacacgcagggagagggcatggaagccccgcctccctccccgaaaactctgtcctgtgcagtgtttcttattaattacactgtccctgagttctttttttttttttgagacggagtctcacactgtcggccaggctacagtgcagtggtgcaatctcagctcactgcaacctctgcctcccgggttcaagcgattctcctgcctcagcctcccaagtagctgggattacaggcgcccgccactacgcccagctaattttttgtattttagtagagatggggtttgaccatattgccctggctggttgcgaactcctgagctcaggcaatctgcctgcctcagcctcccaaagtactgggattacaggcatgagccaccaccacgcctggcctgctgtgcctgagttctaacctttatagtaagttggtaatcctcagtaaaatgcttttctgagctctgtgtgttctgccaaatcactgaacctgaggtgagggccctgatttgtaatcagtgggaagaggctcaagtagcctgggagccccatctgcagctggtgtctggaatgaagtcaatttggtgggactgagccctcagcctgtggggtcaactgtagctagtgttagaatcagactgaactctaggacaccccattggtatcagataatcagagaattgctgttggaattttcatgtgcgtccgtgtgaagagaccaccaaacaggctttgtgtgagcaacatggctgtttatttcacctgggtgcaggcgggctgagtccgaaaagacagtcagcgaagggagataggggtggggccgttttataggatttgggaaggtaatggaaaattacagtcaaagggggttgttctctggtgggcaggggtggatctcacaaagtacattctcaagggtggggagaattacaaagaaccttcttaagggtgggggagattacaaagtatattgatcagttagggtggggcaggaacaaatcacaatgctggaatgtcatcagttaaggctgtttttacttcttttgtggatcttcagttaatttaggccatctggatgtatacgtgcaagtcacaggggatgcgatggcctggcctgggctcagaggcctgacaggaatgacacgttgggtgtcagaaaaaaaacacagaaaactccctaagcagattggttgaaagcaggctgactgcatgtcatctgggggtgcgtctccccccaagagcaggtttcacatctcattccccggttgattggacaagacccttcctgtctttaagttctgttttcttcctccctttgtctctccgaagaaaatcagctgcatgaaaacgatcctctgggcagaaattggtgctgttggagccgcacagaggtgccctcccgtgccccctggcccccaccgggccgtgtctcctcctgcctgttgcaatcagccctcgtccgactctttttggaagtgattaaaacataactgtcatagctctgggggagacaggctgcagatcctgattataattcagaaggatctaaagaaaaagtaattttttaaaaaaattctggttaaagccaaagctcataagacgtgtgtgatggagtggtatgcaagagcacaattaatgtatgtcctagacatctgcccacaggattcagggctggcaaatgagtgcgtccctaaaaataatgactagtgctatctttaaaaagtcttttgtggcatagcagattaagatggatggcctgggaagtacagtggcagcgtgtgctgtggtatccaggaataagttgtacctcctcggggtggcagtggaactgggccgtgaacagcttttgcttcccagagaggactgccatggcctgctgcatggaatttgattttaatctgtttgttatttttgggtttggtcttggactgggtttgaaatccagatgtgacttttttttttcttttttcagttttctttatagcagcaatgttgtatcttgtgtgtttcctaacaagactgagctctgagcaaggcagcctctggaaccaaatgtctgcaggcccaggagacctttctagaaagttcataggtgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaagaaagttcataggcggttctgcagtttgagccccttctgtgggtctgtgcctgctttagccgcttgagatatggcattgaacaaaacacaggccccgcctgggagaagctgccaggccagctggggagacagacctgataagtgaaaatgagatcgcgtggcctgcatgctccgaagaagactaaggcaggaaacaggactattttctcccgactgaattgtcctggtatccttgttaatatcagttgactgtgacttgagacttatcttggacacccctttctgttccgtgggtctgtgtctgccttgatgtcagtcccacagtttcgacgactggagctttgtagtcaggtgtgaaacagtggagtgtgggtcctccagttttgttcatctttttcagattgttttggcaatccaggagtcctttgaatttacatatgcattttattttattttaattattaatattattattattttttagatggagtcttgctctgttgctggagtgcactggtgcaatctcggctcactgcaacctctgcctcccaggttccagagattctcctgcctcagcctctcgagtagctggaattacaggcatgcaccaccatgcccagctaatttttgtattttcagtagagacagggtttcaccatgttggccaggctggtctcaatctcctgaccttaagtgatccaccagcctcggcctcccagagtgctgggattacaggcgtgagccattgcgcccggcctatatatgcatttaagacctgcttgtcaagttctttagaagccatctggatagtgattaatttgtaaaaatgatacttattatctttttgaactgccaaagtaatatatgctgctgaaaacctggaagacagaaaaatccaatagaaggcagggctaattttttttttttttccatgtatgtcccttcaggcttctctgtgtttttcatttttcctacacaaatttggaatcattccagagctagtaagcatctagggccacatttggactagtaccttgggataaattagagctggaattgccgggtcatatagtgtgcacagggctagggactgacttattttcctttctgaatgaagactctgaggtctagagaggttaaatgagtgactcaaggtcacacagctaaaactctggtggagctgggtcttaatgcagaccctacatattcatgccatgctgtatttatacaggcatgtacaccagcgggtcgggattttagggggtgttttaaaattctgcctgcaaaacctttttttttttttttttttttttttttttttttttgagacagggtcttgctctgttgcccaggctggagtgcagtgtcaccatcacagctcactgcagcttcctcccaggctcaagcaatcctcctgcctcagacccctgagtagctgggactacaggtgtgcactgccccacctggctaatttttaattttttttgtagagatggggtctcattttgttgcccagggtagtctcaaactcctgggctcaaacactcatcctgcatcagcctcccaaagtgctaggattgcaggtgtgagccgctgccccaggcaaacccattttaaagccatgagccaaaaattataaaagacatgcaaaatattatgagtagtcacttatctagtatttgcggcatctctcaggcttggggctttgctgggagctctgagggggtggaagaggctctgtcactggccttacctggctgtcaagggctgagtgtttggtggagggaagacgtctgcagcctgggaggctgcgggtcagaaggaggtcagccggggagctgggaggatcgtggggaacccgtggtggaaatcagcatggcgagagagtggaagcaggcagaggagggctttgaagaccaaaaagggtagttaggattgctgctctgtgtgtctgtaaacttggtgttgtctctcgaatttaaatgacatgctttgaaaacaaaaaaacaaacaaaaaccaaacccataaaatctcactaagtggccagagcaagttcccggggggtggcgcatagatgcagcggtctgggttctgtggctgggggagttggcttggggtccgtggctgggtcagtcttcaagagccaccctgggtggcactccaggtctcttggtctggggggaataccctgaccccagcggtttcacggcctcctccccactcagcctgggggagagtccagggtcggccctgtccccctccccccactcctgtcactatcagtcccctgtgctcagcttactggcagggttcctcctggctgtcccctctgcctccagcgctctttcctcaggtgtccacgcagctcgtcctcacccttttctgtctctgctcagatgccgcctgaggctcccaaaacagggtctcactctgtcacccagggtggagtgcagtggtgcaatcacagctcactgcatccttgacctcccaggctcaagcgatcctcctgccagcgagcttgttacaattcctgcaccaacacggatacattgttactaactaaggccctacaccagcaaagatacattgttactaagtaaggccctgcaccaacacagatacattgttactaagtaaggccctgcaccaacacagatacattgttactaactaaggccctgcaccaacacagatacgttgttactaagtaaggccctgcaccaacacagatacgttgttactaaataaggccctgtaccaacacagatacattgttactaactaaggccctgcaccaacacagatacgttgttactaagtaaggccctgcaccaacacagatacattgttactaactaaggccctgcaccagcacagatacattgttactaaggccctacaccagcacagatacattgttactaaggccctgcaccaacacagatacgttgttactaagtaaggccctgcaccaacacagatacattgttactaagtaaggccctgcaccagcacagatacattgttactaaggccctacaccagcacagatacattgttactaactaaggccctgcaccaacacagatacgttgttactaagtaaggccctgcaccaacacagatacattgttactaactaaggccctgcaccaacacagatacattgttactaaggccctgcaccaacacagatacattgttactaactaaggccctgcaccaacacagatacgttgttactaagtaaggccctgcaccaacacagatacattgttactaaataaggccctgtaccaacacagatacattgttactaactaaggccctgcaccaacacagatacgttgttactaagtaaggccctgtaccaacacagatacattgttactaactaaggccctgcaccaacacagatacgttgttactaagtaaggccctgcaccaacacagatacattgttactaactaaggccctgcaccaacacagatacattgttactaaggccctgcaccaacacagatacattgttactaagtaaggccctgcaccaacacagatacattgttactaactaaggccctgcaccaacacaaatacgttcttactaagtaaggccctgcaccaacacagatacattgttactaactaaggccctgtaccaacacagatacgttgttactaagtaaggccctgcaccaacacagatacattgttactaaggccctgcaccaacacagatacattgttactaagtaaggccctgcaccaacacagatacattgttactaactaaggccctgcaccagcacagatatattgttactaaggccctgcaccaacacagatacattgttactaactaaggccctgcaccaacacagatatgttgttactaaggccctgcaccaacacagatacattgttactaagtaaggccctgcaccaacacagatacattgttactaactaaggccctgcaccaacacagatacgttgttactaagtatggccctgcaccaacacagatacattgttactaaggccctgcaccaacacagatacattgttactaagtaaggccctgcaccaacacagatacattgttactaactaaggccctgcaccaacacagatacattgttactaaggccctacaccagaatggatacattgtacattgttactaaagccttgcaccaacatggacacatcattactaactaaggccctgcaccaacacagatacattgttactaaggccctgcaccaacacagatacattgttactaagtaaggccctgcaccaacacagatacattgttactaactaaggccctgcaccagcacagatatattgttactaaggccctgtaccaacacagatacattgttactaactaaggccctgcaccaacacagatatgttgttactaaggccctgcaccaacacagatacattgttactaaggccctgcaccaacacagatacattgttactaagtaaggccctgcaccaacacagatacgttgttactaactaaggccctgcaccaacacagatacgttgttactaagtaaggccctgcaccaacacagatacattgttactaaggccctgcaccaacacagatacattgttactaagtaaggccctgcaccaacacagatgcattgttactaactaaggccctgtaccaacacagatacattgttactagctaaggccctgcaccaacacagatacattgttactaagtaaggccctgtaccaacacagatatattgttactaactaaggccctgcaccaacacagatacgttgttactaagtaaggccctgcaccaacacagatacattgttactaaggccctgcaccaacacagatacattgttactaagtaaggccctgcaccaacacagatacattgttactaactaaggccctgcaccagaacggatacattgttactaagtaaggccctgcaccaacacagatacactgttactaactaaggccctgtaccaacacagatactttgttactaagtaaggccctgcaccaacacagatacattgttactaactaaggccctacaccaacacagatacattgttactaagtaaggccctgcaccaacacagatacattgttactaactaaggccctgcaccagaacggatacattgttactaagtaaggccctgcaccaacacagatacattgttactaactaaggccctacagcaacacagatacattgttattaactaaggccctgcaccaacacagatacattgttactaagtaaggccctgcaccaacacagatacattgttactaactaaggccctgcaccagaacggatacattgttactaagtaaggccctgcaccaacacagatacattgttactaactaaggccctacagcaacacagatacattgttattaactaaggccctgcaccaacacagatacattgttactaactaaggccctgcaccagaacggatacattgttactaagtaaggccctgcaccaacacagatacattgttactaactaaggccctacagcaacacagatacattgttattaactaaggccctgcaccaacacagatacattgttagtaactaaggccctgcaccaacacagatacattgttactaaggccctacaccagaatggatacattgtacattgttactaaagccttgcaccaacatggacacatcattactaactaaggccctgcaccaacacagatacattgttactaagtaaggccctgcaccaacacagatacattgttactaagtaaggccctgcaccaacacggatacatcccattactaactatggaggtgctttattcagatatcctcagtgtcacctgttctcctttggccgtctcagggttcctcccaggacaccacattgcattcagtcctgaggcttctctgggctctgacagtttctcagactttccttgtttctgttgaccttgacagttttgaggattactgctcagagagtttgtagactgtccctctgttggggtttgtctgatgctttcttcatgattcgatcaggttgtcactttggggaggaagtctgtgaggtcaagtgccattttcatcgcatatcggggcacacccatctgcacaccttcgctattggcgtcggtcgtcatcacctgtgcaggcgtgctcacccggtttctccactggatccagctttattttcctttctatcaaccatcacaacctgaaactgtgggcgtccgtgtgtctcttggagtctagtagaatgtaaggccctcaaggcagaggcctcgtctgtcctgtttgtcaccagagcctggtccgcagtggtgcctagtaagttagtccacccattcaccacatccttacagagctctggcgccaggcagcaagtgctggtgctgcggacagagccacagacaagccggtcatagcttctggcctcatagaccttggagtctaacaggggagagcctttcaaagatttgctcccattgctaatgggacaggatgagacagggtgctgggggactgagagctgtgatgggggatgctgcctggagggctggggtggtctgagctctggaggaggaagtgctgctcaggtagtgagggagggggtggtatctgggttaggggaagtggcgtgtgcagaggccccgtggcgcagatgagcttgggctatttgaagaaccccagcgaggaggcagggtgttcaggtggctgtggctgtggcccaggggcaagagggagatggggaggagtggaactggttaagaagtggacagaagtagggtgagaaggcaaagtccaggatctgagacaggaggatggtggccttcctgcctcccttccttcctgccttccctggaaaggagcacgcctggggtgtggtgagtcctgttagagatgctcacggaaccccctctccccaccccgccccgtggcaggggcatggagaggcgggccctgtgcttagggggtcctgggttagggacggcgctggaagttgcaggagggcagaaaccggcctctgaagagagtggggagggagaaggggagctgtccagggccctcaggcatgcatcatgtaagggtcaggggagtcagggaggatcccccaaaggaggctgtagagggtgaaggaggagggcaggaagccagtgagtgtgggggtctgtgggccatggggggtgggggaggcagctctttgggaactgagggggttcgggtgcagccctgggactcccaggccagtgctctccctccccctgccagccacctcgcagagagagcccggggtggaagcagggtagttggtgctgtgccctgaccttcagaggtggcattgacaagaccagaatgccacagggccatgcacctctccctgcaaactgccctttaatttatttttacctctgttccttgtgggcttgtgtgtcaggttcgatatttttatgttactgggaaaatagaatgtgcttcacagaaatttgccttgtggccaatattgcaggttgcagctgtttcagagtgacaggggacggtatattctggacttgtgcccttttgttcatctctgagaggggccataaactcccatttccgagaggttactgggaccaatgagatcatttattagttttccttgcacaggaaaatcacacactctgtgccattgattgagtccattttattttgtggaatagacatgtcagaagcaggattggccaggtggaattgtgtttggcgggagtcctgtctttccataggtactttcataatggaagcaatctccttctgaagtgtatcacccggtgaactgaatggaaaatctcttgtgaaaaggcttaagaggaaggctggcctggaaaaatgaaactcacatccacagagagacttgtacctgaatgttcatgtcagcaccactcacaatacctaaaaaggggtgataaccgaaataaccatcaaccaagggatggagaaacaaaatgtggtcccccatgagatggaatatgattcagcgtaggcacgaaagaaggacggaaacatgctataacatggatgaaccttgaaaacatgctcagtgaaagaagccacacatgaaagggcagacatcatcggctcctattaatatgaaatgtccagaaagccaaatccgtggagaggggaagtagatcgaatcacacacttttaaaggatgaattgtgtggagtgagaattctatctcaataagggtgcatacaaaatgcagctgacggtggtcacaccaagcctgtcagtaatgatgcataacttccctttgctgtcctgggttagggtgggttgagacttagggtgaccagggaggaatggatatcttgtgggtcaccttgactgtcttggggtgatgagagggcagtattaccaatgcttaatcatttgcccccataccaaggtgaacacgagatgctctggtcctagtggctgcagagttgtgcagcctctgtccctgtgctagctctggacctggtggtggccgcagagctgtgtagcctctgtctctgtgcttgctctggtcctggtggccacagagctgtacagcctctgtccctccgcttgctctggttctggcggctgcagtgctgtgcagcccctgtctctgtgcttgccctgtccttgtggtggctgcagagctgtgcagcctggccccagagctgtgcagcctctgtccctgtacttgctgtggtcccggtggtggctgcagagctgtgcagtctctgtttctgcactttccctggtcactgcctcattgccgtggcgctggtggactgaggccataatgcctgcgtctcctgcaggtcctcctcgactggattaatgacgtgctggtggaggagaggatcattgtgaagcagctggaggaagacctgtatgacggccaggtgctgcagaagctcttgggtgagttcacagcagggacagctctgtcccacccccatctccctgcagcggccctgggctgggccaggattctctgcatagtgacatcggccacaggtcctaggaagacactcaaagctgcagtgtgcatctcccaggtggtgcccaggccctgggctgtggcttcagggtcctctctccccttgccgtttctacagagcacccagccatggggcagcagcaggttggggacagcttccaaaactgcctgcggctcccatcctgttgggtctcaggcccactttgtgtccctgccaccctcttttgacttgaactccttcggttcaggatgggaggcagcaggagggaagcgggtctgcagcaatattctgtgagtgaatgtgtcaccaaatacatgatagctcatgttccctcaccaggggcgggctctagtgtctgcatttgctgggtgaaggcagtttagtgatcttcccgggactgactgatgcatggtttgatgtgcagacaaaccggttgtttattcatcagatgttggatgagtcccgagggctgggtaccagggatacggtgatctttgaaacagacgtggtccctgtcctcagaacttacagtctgtctgaaaagacaaatatttttgaatggttacagttactgttcagattgcttgtgatgagggccttcggagatgccgcaggttctgagtagaggacgccggcctggcctgggggtggggcggccttgcagctcatatggaagaacgagcgaagagttgccaggcaaagaacggaagagcagagttcgcagatgatgcatgagaggaattcttggacttgtagtgggttctcacgatgcctggcactgtcatgtctcattgtcacaatggtcctagggggcagtactgccatcgccttcgacaggtggggacgttggggcccacagtctcctggtgaacagccgggcagcctggccccaagcatagctcttgagcccggccgcggggcctttctctgacctgtctacggagcagccccaggtacagggcctgggtcaggcgctcctgcatgatcacagctggttctcacaacagccctgggggtctggctgaatgagcagatgtccctggttgtccccacgatgccttttgtttggatccaggagtgaatcacacatgaacgtttgtctcttcttttaggcttctttcatctggaaccgccttccctttccctctctccgttctgttctgtctttctgtcttttatgacgttttggaagggtctgggcctcttgtcttgtagaatatcctcccatcgggatctgtctgtctcctcacgatgagatctgggtcacatgtttctgctgagagtgtgactgcgctgcctgcttgtcctcctgggggcatcgtatcaggaggagcacacaatgtcaggctgcctgtcattggtggtgctgacagtttgatcactgggttaaggcagtggcctatgggtttctccattgtaaaggtgcttctttcctgttaaaaaaaccacttttttatttgttctattttggtagagtcaggatctcactcagttgcccaggctggagtgtagtggggtgaacatagctcactgcaccctcaaactcctgggctccagtgatcctcacaccttggcctctagagtagctaggactacagatgtgtaccaccacacttggctgttttttttttttctttttttgaaatggagtcttgctctgtcacccaggctggagtgcagtggtgcgatctcagctcactgcaacctccgactccctagttcaagtgattctcctgccttagcctcctgagtagctggggttacaggcacataccaccatgcccaggtaatttttgttttttagtagagatggagtttcaccatgttggccaggatggtcttgatctcctgacctcatgatccacccacctcagcctcccaaagtgctgggattacaggtgtgagccactgtgcctgactggctaattgttttgtattaaatttttaaatttcatttttttgtgttagagacagggtccttgctttgttgcccaggcctgttttgtactggcctgaagcaattctctcatgttggcctcccaaagtgttgggactacaggtgtgagctaccatgctcagcccttctttcctttttaatacatggtctctagaggggcagactctgggactttgtgaacgtcctgttcacccatgatgcgctccccatgattttatcatccgctgattatcattctctaaattatgctaaatatcatctctaaatattatgctggaggttgcaaaatagtgatttctgtatctttatcatggcttccccacttattagctggcattttcttctgtaaataagtgcttttcttctcctgtgtccttttttaaaaaaaaaaaatcccctaaaatagaataacacattcccctggactgatgaattattttatgttcaaaagagaatggtaattagatagcaaaatctgggccttatgggtgcttgtggctcctggggtgtcattgcttctagtctctttaagccaaaagaggtagcaaatatatagttttttaaaaattgtgagttcacactgctacttctaattccagttcaatgctacaagtttatcccttaactgtcagcattcagtattccagtctccagggagaaccttggttccagaaatatatttgctatttactctgattgcatacaaaaatagtgtcagaattacaataccaatacctctatcaactacaaacatgctaggtacaagatttctttgccattattttttaagtacaatatatccactaagagtatatagtcagaattctgtgttcagaacttaactgaattattttctttttgagtggtcatgtcatccatttaatgtataaataaattaatttgtttctctctgtatttagtttttgtgtatatgtttacatttaattttatttaatattacttttaaaaatgtaaagcatttacatgcttcaaaagtcaaaactatggaaatgacataccttgaaaggtcttagccaggtgtggtggctcagcctatcatcccagcaccttgaggggctgagccaggaggatcacttgagccgaagagtttgagaccagcctgggcaacatagtgggacctcgtctctacaaattaccagtcgtggtgatgtgcaccgtgcacctgtattcccagctgctcaggaggctgaggcaggaggatcacttgagcctaggaagttgaggctgcagtgagccatgattgtaccactacattccagcctaggcaacagagtgagaccctgtcgatcaagagagagagagagagagagagagagagagacagagagacagagagagagagagagagagagagacacagagacagagagagagagagagagagagagagagagagagagagagagagagaggtctcactgctttctctcccacgtatacactcccaggtaacaattttcaatggattctgattttatccttcttatgtttctttacaaaaatgtccatatacacacctactcatttcccttttattccttgcataaaaggtgatgtattttgtacattcttttacacaccctgcttgtttcgcttaatatgttctaggaatccttgcatgtggagatcacctttctttttctttatggctgcattgtactccactgtgtggatgttccttcgtttattcacccagtctcctatgtggggcatttttgtcatttctaatatttttctatcaccagtaatattgtgggaatatcctcgtgcagatgttacagaaactagaattgttgacctcaagtgtaatgggttgcttccttgagctgaccactgtagaggaaggaattctcaaattctgagaggcttcacctctctcacctctggccttcccaggtctgttgtgccttggttgatctttcctgtagccactttctgtcttccctggactgttcagtgtgcagacatgatgtaatatttccattaaaaaatggctcccttgctcctgcaacactccaatttctctgcatcactcaaatgtattgaccattagatttggcaccggatgggtcattggtggcccagatgagagcagttttggcgcagtggtgggggtaacacgctgatcggggagggtccaggggcagagaactgtgcctttgaggtacataattttgagagggagagagaggaagggagtgaacctgtggttgctgcagctgcttttcttttcaagacagggtctcactccattggctggcctggagtgtgggggtacaatcatggctcactgcagcttccacttcctgggctcaggtgattctcccaccttagccgcccgagtagctgagagtacaggtgcatgccaccatgcatgacttattttttgtattttttatagatacgaggctttgccatgttgcccaggctgatcttgaactcctgggctcaagcaatccacccacctcagcctcccaaagtgtggggtttacaggcatgagccactgcgcctggccaatacgaggctttgccatgttgcccaggctggtcttgaactcctgggctcaaacaatccacccacctcgggctcccaaagtgtggggtttataggcatgagccactgcgcctggccatagtagctccttttcatgtctgtccactgggaaccatgcaagctgcctgctgaaattacgtggatggagcccctggcacagtgcctggcacaggtctgtcgtcaataagcaggagttgttattgctgttgttttttaaacagacaaataaatgccaagagcagaactaaggagtatctggctcgctgctgggtaccccatccaccccaagtcccctgggtgactggcacatgacaaatatttgttgattaagtcaatgaaagaattcctgcagtttcattacctatgaagattgtggggtcctcttgtgggacatgaaagggggacagatagatgagtattgtttggatttttggtcctcagtgccatccacagactccagaagggatcagctatttgctgaacaatctttcagttctcatagagccctgatatgttttcagggtccacaaatgcctgtgacggtggcctcaagaacccagtgtccccttgtaggtgggatagcatacctcttaaaggtcagcatgagattccacccatgtcatccccagcattggtggggtcagcagatcctctctctggggtttcttttctgctcaacctccctgctttgatggactgcacagacaagccccatcttggtggaagggtctccccatgggctgtcctggagggtcactcccacagatatgccccatcctggtggaagggtctccctgggggctgtcctggagggtcagtcccacagacaagccccatcctgtgggagggtctccccgtgggccatcctggagggtcagtcccacagacaagccccatcctggtggaagggtctccccgtgggccgtcctggagggtcactcccacagacaagccccatcctggtggaagggtctccccatgggccatcctggagggtcactccctcagggcagggctggtgactggggtgggatcatgtttttctccgctgttgtgacagaggagtatctgctgcaggggatacgtggactgcggggggactgccacaaggatgtgaatgggtagggggtggggtgctgtttaggagagagagagactaggggagcccctgccagagaaacttggccctgaaaacacaggggtgcagcatctgtagctgcctctggacagagtttgcacactctgcacaaatggctcttacagaccagctcttggagggaaacctcctaggcttgtgacaggtggtggtgagggtggggggatgaggtgctggggaggccatgtcccataactcactctgaaggacacagtgatgcttggaccacattgtttgtccttattcatctggccctcagaaagtatatttggagggaaacatgtctgtgtttgttttggtcacacattcattcattcatctgatgaatgaatgttcattggcttacatgtgtcgggtggctcttggctgtagagacacagtgggaaacaagagagatgagccccgcaccctgcgcctgcccactcccccagcacacattctagcagagtgaagaaagagaagtattatggggtggagtggttcaacctgaaacctagatgatgttttaaaggaatgacaagtgctaggaggaaagtaatagaaggttatggggtacagtggtgggtgggggttggggaaggcaatccagggaagctcctctggggaggcgacatctgagcacatgtctgcacagtgagcttgggaagggcgttctgggctgaggctctaaagcgagaaagagcctgttgtgttggaggagcagtgaaaagaagcggaggcggggcccaggtggcagagagggagggagagagccaagagatgaggctggggccagatctcattcagccctgctagacaacagtctattccaagtgacaggaagccattggaggttttgggtagggctgtgacgtggattgggttagagtttaaaaggtcacttaggcttctgggtgcaggatggatggggaggagagtcaggagttggaactgagagatcagtcaggacaccattgccatggcccaggcatctgatgaagtagctcagcccccagagtggaagggcagacatggggaggtactgtacagttaaactgccataggaaccaagactgatggccaggtttgtggcttgagcaactggtaaatgggaagccgttgggagtagggtgggaggttgggaaggcgggggtctgtgttgtacatgctggggctgagatacctgcccttttggaggtgatgctgagcaggtgagcctggagtccaggctgcagtgtacgtgtgaacccagcagcactgagctgatgtttagcaccgtgggactgcacggcttcacccaaagagggtgttccaaattttatttggctgaatgccgaatgcccaagaattaacatctatatttggctaaggtgagaatccccatcttagaatgagatcccatggtacaagaataagtctgaaatgttcatcaagattgtgtcataattatcacaattttattattaaaaacgttagtggccaaagttttgatgttttgcattgcagtatcagtacagtcacacccagcactgttgggtaccacttgctcttgaggtcttcaaaccagacatttgtgatgctagatgctcactttcaactcagaaggctggaggagcacgtggacctttggctgatgctgtctgaagggatactcctcatgtgaagctgcccctgggctgtcagtttttctctctctgagtggctggttatggtagagacttacctcctctttgatcttggatgtgaagattgggctgttgctggtgatggccctctgttgaagcagtccccccaattggtactttgctccctacctgaagcagatattttctaatattttcagaagcaaacttgagtgttttgttcactttcattttttatttctgattcttttgcctgcacctgtggcttctcccacccaatgacttgaaacagtatgtcagcaagccttgtatctggcagcctggctgtggaactggccctcagaatctcaggacaggctctgaatttgcatctgcatctcagccgtggttgcctgtaaaccatgccagtgccttctatagagcagaattacaggggcatctttaaagctgcatcttcccctctcaaggcacatccttttggttccctcttcagttagtgctagcaaatgcagcacttactccggagttgctgtgattgtccatgagtcctgctatatcagttgtgttatccataaagtataacatgaggcttcctttggctcaagcagcctttttcttgtggagtagctgctgttccatcttgtttgaataatcacataagcacttgagaaggcaattctaaaatctcttgagtgtcaagtggtttgacatattaaaaccactttttttttttgtactgaaaaaaagaacagtggactagaatattcagatagtaacacagcatcagaatgtcttgcctcattttgtgaatgttgttacactgaaatgacataatatactgttgatgtgagatcctcttgatgtgatactactgatgtgatcacctgatccttgagctccaggatgccaggaatgacactgatgtaggcattcagctctttggctttccaaaggcagaagcccaaaccaaataggagattttagctgaataccaaggtcaaagccaacttctgtgcatccgtagtagagaagaggtctgaggactgggtctgggctgtcagccattagtggtcaggaagaggaagttctggcaaaggtcagtcacaagggagggggagccagaggagtgttgcattcaggaagggtaaaggaggtgtttctaggaggtgagaggaggaaagagaacagacttctggtttggccatgtggaaattgcccagagtgaaccagcaggacccctgaggagtccctcttctttttttttttttctcttgagatagtgtctcactctgttgcccaggctggagtgcagtggcgtgatcacagctcactgcagccttgacccctaggcttggatgatcttcccacctcagcttccccgggaagctgggatcacagatgcataccaccatgcccagataatttttgtattttctgtagtgctgaggttttgccatgttgcccaggctagtcttgaactgggctcaaacgatcctcccaccttggcctcccaaagtgcagggatcacagggatgagccactacacccagccgaatccctcttcttgagagaagattctggaagcagctgccgggttctctgccacatgccaggtttctgggggtgtagctcccctgtgtttgcagtgcagccctcaaggtagactgcatatggccagagtgaggtgcccgtgctgtgggagctcctggctgtcgtcctgctggtcactcacgggcacaccctctccttgtgaaggtgaagttcttcatcacatgtgtactcaacccccatgtggccatcactcagggtcacctgctacatgggagaatcctccccagttttctctctttctgtgctaggaagataggggtcctggccacaacagagccctgagctgctcctgcggcccccgccagtgggcacagtgatgtctgatgatgcaagtgatcatgtgccgtattctctgttgcacaggagtcacccaagacccagcctaaggcagcacacaggcatggccagtctctttggtctctgttgcctgctgtttccaccaccaaattcatattttcaagtcctacatgcagggcccacccatgtgacctcattttaccttaactgcctctttaaatacaggcacattgcaaggtatgagagcctcgcccactaggagagatgggtagcctggcagcctcccactgtccctgctaccagccagccctgcaggttgaacctcggaatgtgactgtatttatagagataataataggctgggtgtgatggctcacacctgtaatcccagcacttccggaggctgaggtgggcagatcacttgaggtcaggaattcgagaccagcctgatcaacatggtgaaaccctgcctctactaaaaatacaaaaattacctgggcgtggtggcacatgcctgtaatcccagctactcgggaggctgaggcaggaggatcgcttgaacctgggaggcagaggttgcagtgagctgagatggtgccattgcactccagcctgggtgacgagagtgaaactccatctcaaaaaaataaaaaaattaaaagaggtaatgaaagtaaaatgaggccatacgagtgggtgggccctaattcaatatgtctagggttcctataaaaagaggagattaggacacagacatgcacagagggagaccaagtaaggacacaggaaggagagggcagccatctacaagccaggagaggggcctcagaagggtctaccctgccggtgccttgatcttggacttctggcctccagagctgtgacataaatctccgttgtttaagccgcacggtgtgtggcatgcttcgttgcagcagcccagacaaacgaatccagtgtcctccgctcctctgccgactcctcttcctccaccctgggtgacgtggccatgttcagtctgcggggccggatggtggcaggtgcaacgggggcgcgtcaggcttcccatctccctggtgggcgaggctctcagaccacccagttctgtatgatcctatctctctccttccttctccaagctgccctgctctgccctttccatggttgttgaacacctgtgggacctacttgctctctacttccagggcgcaaattcagacagacagctgtggatgactcagcgaggagctgttagatccagatggagggaaatcagatgaataagcgggaatcgtttccactcccctgcaggatgtgttttgttgggctgctttgttttttctcttgcagtcattgccacccaatcagatgttttttacgggtgtttatctccccactagggacctctgttatctgtgccatatccagcacctaggacagtgcctgtcccatagtaggtgttcagtccctatctgtgagccaacaaacgcatgatcgaaggggtattccgagcccagcaggccttgctctagaattttattatcttgaaagggatgccaaagctgtttgttttctaattgagggaggggaggctgctggggagataacactgaagacatgggggcctccagctaaaatgttttaaacagaactttgtgctgggaaccacttgcaaaacagaaaccccatttgtgactggcctggacttgattgctttcatgatggcatgtcaatgccgcgtcactgacagcagctgtgtattgaaggctctgtgctgagtgcttgcagtcaccctcccagtgaaccatctcacgatgctctgtgacgtcgcttttgttgttttgcagagtggatctatcagtaaacactggagtcttagaatcgaagactagcagggaaactgggggtccttcctgctgtgtggccctgcagcgggcgtggggtggggcgctggtggccggcacctgccagtacctactgctaacaaaagggaaattgaaggaggtgcaggctgggctggagctcagtctcagtaattgaatcttgatgaaatgtgacagttcttgtctgtgctcctccggattgtttcctgttcattcttggtaataaaatcatcgccagttctgtgaatatctaatctaacttcctattgtggcattagaatgtttaagaaacaagaatgggagcctcaggtgtgtggggaggcagaggcagcttttaagaccttttttaaaattatctttatcagtcctctcccttttgggacccacagggacagtcttctcacctcctgactcccactttcattcttcccaggtaacctccttgcctctcaactacatcttattatgttttttccattttgtatgcatagaatgttcccgagtataacacccacagttttatccttaactattcttcccttttcaatctggcgtcattctctaaggaagattagtgacctggaagctcagcgttcatggttcaacatctcaagacgcccccatggccacatggtaacctgccccgcttcggggacctccttgaggctggggtcttggtggttttgagttcctccagtatatctctctccccttcctccctccctccctccctccctccctccctctctctctctctttttttctttcttctctctctctctccttccttccttccttcctttttctttctttctctctctctctctctctctttctgaggcagggtctcactcaggttgcccaggcttgggtgcaatggcatgatcttggcttactgcaacctccacctcccgggttcaagcacttctcctgcctcagcctcccgagtagctgggattacatgtgtgcgccaccacgcctggctaatttttatatttttagtagagacgggatttcaccatatttgccaggctggtctcgaactcctggcctgaagtgattcacccacctcggcctctcaaactgctgggattacaggcatgagccactgcgcctggcccttccagctttttctgaccctcttctcttgtgcttctcattgcagaaaaactggcagggtgcaagctgaatgtggctgaggtgacacagtccgaaatagggcagaaacagaagctgcagacggtgctggaagcagtacatgacctgctgcggccccgaggctgggcgctccggtggagcgtggactgtgagttccacgccacagggggagggactgtctggagggagcccgtcctctcgacattcgtcatccacatttgtcatccacattcatcatcatcccatctggccttgcatcttaaaattgggttcatctccctgctctgtaagaggtagaacattgcaggggagaagaacaggagaagggttagggagatcctagaaaagggacctggtcaggccacaattctccatcctccccatgctgcagaggagagaggcaatgtttatggatgggtggatcagagggactttgagagagagaagcagccttggggggttcttgttgggactcaaccccaaatactggtggcagcaacacctagtgggctgtttgtctatgaccctggcattatgagatgtgacatcacggtattttcagccaagacatgaacccggcaggtgaaagactaaaccaggagaagctggaaagttctcctcggtcctgcccactccttccccacctccctcccctggaagcagggccatgagggtgtggcttcagggctctctgtgctgggccagaggtctccgtgctttggtgagctgggctctcagtggtaggcaggagaccctggagcctggccttgcacccggtttcttggtatcgagaccttgggcagacccaggctgtctcgtgggtggctgggtccgtgggtggggaatcgggtgccttgtaaactgtaaaaccctgcaggagaagtggtgatgttgaccaaacctgagtccgcatgctgaggaagagagaggacagactcaggcaaggcaggggctaatgtctaatgtccccagagtggcctctgctcttggcagcctacccttgttgggatggttcattgcggagagggagcccttttttagtgccagagataataacgcacatccttgtgatgggtaagtggccgtgacctgctttccatgctcttttcccttctgtgctaattttactatcctgttcctttccctcatcactgcccaatttattgcttttaaaaacattgtgcttctaaaagtggttgcacaagtcaccttaggccaacaggaaaggagacagtgaagctagaagtaaattcaccaggttgctcatcagctctcttgatttgtccacacttcgctccatccttgtctcgctggggtctcatttagatgctgtgtctctgttgccttctgcacgtgggctcaggttcctgtgtaacctgatctaaagcgtctcccttcctccttcctcctgcagcaattcacgggaagaacctggtggccatcctccacctgctggtctctctggccatgcacttcagggcccccatccgccttcctgagcatgtaacggtgcaggtggtggtcgtgcgggtgagtataaccgagtggtcggcctgcctgtaactccgccagagaggcaacatcttcctcctgcagttttcctgccctccccctccttttttccccccaggaggctaccttctatttttcccttttgacaaaatgtgtgtctcaccctggctccgagataaatgattggaacgggaacaatggcattgatttgatgagaggcagaagcagaggcatgagggtgttgaggtttaattttccacatttttgaaaagaacattcatttctctccaaagccaactggttggaattcaatccccttgaatgtgcttattactcattggaggaggttggccccgcgggatgaaacagacacccaaattaaagccgctttgcattcgttggggattattcatcatgccccatcatctctttttttgggttcatttctcttgattcacttggagaaatggaaccagaacccaggtccttctaacagagggtgaagtagagttacctttctcttgctatttcccttacatttattttttattttattttatgttttgtgaaagggtttcactctgttgcccaggctggagtaccatggtgcagtcatggctcactgcagcctcaacctcttgggctcaagcggtcctcccgcctcagcctcccaggtagctaggactacaggcacatgccaccgtgcctggctaatttcaaatttttgtagagacaaggtctcgctatgttgcccaagctggtctcgaagtcctgggctcaagcgatcctcccatctcagcctcccaaaatgctgtgattataggtgggagctgccatgcctggccttatttcccttacatttaagtggacagtcgctgcctagggttcgtgtgtgcagtttccctcagtaaatgtgcaatgagcgcctactattctctaagcactcagcataggctgccgagccactaaaggaggaacacatgcctggcgtctgtgggggtgaccactgcggccagagttgaggtcacgctcggaaccttggatgcctctgtgtttattttactcgagacatccggctccactttcctctggtttttaaacttctcagtcccgtggtctctgtggtcggggaggacctggctgtcactgtgttttccgaacccattctggcccctctgttaccctgggagctcagtcttgaccggacgggaatgctcctctctggcatccggcaagggccacctgccatgtgtccatgtttccttcctaaggaggatgtttgtggctggtggtggtgactcgggacctggggggccattcctatggccccgtgtcttggccactggttcacaggcagccggcctgaaaaggcttccctaggacacattgggatgtggttcccaagcctacctacgtcagctcggggccccaggagccctgtgcaggctcagaaactggagtatttcctttcaggcttgcacttgggtccaagataatctttgcggtttgcagaaagtttgaaccaggcaagcacttgctggtgcttcctgccataacgggttagaggagtgttgtttggccacgaccaaagcagaatgaaacgggagcagggggtcctgtgaaccgggcgcagttactccccagaccttagagccgccttctgtcttctctgcagccccctggcctctgagcttgctcaggggaccccttatctaaccccagatggaatggttggtgtaagggatgtggcatttccagggtggaaggaaggaaggaaagggccttatttactgcctggccacgtggctttgggctgatcacttgcttttgctgagctgcaatgcttttccccataaaaccaagattttactacaaacctgtaaaacatccagcttcatgtctacaatcctagacctgggcccagcacctggtgggtgcctcaggcatgtttgatccttgactaggtgaacacaatgtctggaccttccttggcaggcactcctgagaatcaggataaatgtcacccacactgttgttcaataacaagcaccaaccctgagtattccatggaggtcaaactcaggaaagggatggaagcccagatcttggtggtgtccactgtgggctggcccagcgggaaatgagttcccagtcccttgaggggttcagtggtggttggattagccacccaggctccatctggagctcctgtgacaggcgggctgccacccctaccatcaccactgccatgcccccctcactaccatcattacttttttttttttgagatggagtctcactgtgtcacccaggctggagtgcagtggcacaatctcagctcactgcaacctctgcctcctgggttcaactgattctcctgcctcagcctcccaagtagctgagattacaggcacatgccaccacgcccagctaatttttgtatttttagcagagaccgggtttcaccatgttggccagaatggtctcaatctcttgatctcatgatctgcctgccttggcctcccaaagtgctgggattacagctgtgagccactgtgcccggccatcattgcttttctatacctgccacgctctgggagaagtgtgacatatactgtgtcagtttcctagggcagccataacaaagtaccacaaaccaggtggcttaaaacagcagacatttattctctcgcaattatggaggccagaagtctgaaatcaagatgttgtcagggtaggatgtcctccctcatgtctcctcctctaggggaggggtcttcctgcctcctccagcttctggtggtggctgtcagtccttggtgttcttggcttgtggccacatctctccagtctctgcctctgtcatcacatggcctcctccctctgtctgtttctgtgtctgtttcctcttctaataaggaggtgagccatattggattaaggaggggctcaccataatccatgatgacctcatctgagctagtatctgcaaagacccttatttccaaatgagatcatgttctgaagtttgtggtagatatgaactttgggggaccctcttcagtcccgtgcacacacatgattgcaggggatgttccctgttatttatgttccttccaattgcatgcctcacctctcctggctgcaaagcatagaggatccctttggggaatcctgacctggggtgtttctcctgagacccacacaaatgccaactctcaaggccacgtggagaccagagggtggggaggaggatagggacaggttgtggtcgctgaaaggcaccctgcccagggtcccctgctgtgtactcacccaggcctggcatgcgtgttcaacaccacccctccttctcctgttgctcttttctaagatgatctccggccccgcagcttcgtctgccctgtcagtgcatctttcctcaactctccactgcctgattttgtatgtttattttggggttttcagaaacgggaaggcctgctgcattccagccacatctcggaggagctgaccacaactacagagtaagtggacccctgtcttgcccttccaggccctgctgccccgagtgagtgggaccccaggctgccacttcagccagggacaccagcgcccatggggctgctcccgctccacaccccttctctgtagcatgtgattctcatgctggttcccaccccagctctcctccctctgcacactttcttcagagtttttaacattagaactgagttaccttccacagactttgaattttttcattcctatcttaaaaggtgagctgtaagaacattgcaaagtggggcaggcagagagagttcaggatggttagagagaaccattgtctcagttcatttatccatctacattagccccatcagaggtgggagctacatctttaaaccagaactttcctttgacagacactactaagccatctgttatctcctagagaaagccagagggcaggtgttcagaagtctaaaaggcttcaaatctattgaaaatagcaaatcaaacagtatctgtggtatgtggttttaaggactccttgtgataacctgctaagaatctttagaattcactgcatttgtgcctcttgactaaacctgtttcagatgaaacagaacatttaaaaattgattgtctcagctaatccatcagctaagttcacagagtgattaattactgtgttgtgaattcatggatggtatttcaaaaattggagctgacacaggaaaccactcgtggcttgcaagctctcagggaagatgatgggacagtggagtgcaggctgatgcatgtgcagaggcccatgaagaggcctcccagtctgccccaggcccacgaagggaacagggagagctggaaaaggggaggatgagaatgtggttctttgcccagcacagtgggcctttggcagcagctctgcctattcagcagtaggagaagggctgctcgtggggaactgggattgggctggtgtcttagttgtttattgttgtgtaacaaatcacccccaaagtcaagtggcttaaaacaacatctgtttcatttgctgctcacaattctgtgggtcagcaatttaggctgggctcagctgggcggttgttcagccagtctcgcctggggttgctcatatgatgcagacatctgaaggctggatggaggctggggaggctgagatgggctccccctacctctggtggttggtgttggcctcccctgggtctctttcctcctcacagtgctgggcatcttcccagggtgctctcagggtcctgagagagtgagaatgcagctgcagtccccttgaggccttgtcttggacatccatacctatgtcctcaattctgtgagtcaaagtgagtcacaggtcatcctggatcaaggtgcaggaaacagactctgcctccttgtgcaggaatggcctgtgcacattgttgggtggtgggcatgctgtgataggagttcccctctaggtgagggggtcccatatgaggacagcaaggaggagctgggccccctgccataaaactagaatggtccagagacagagaatgagcaagtgggtgggagaattgtctcagctattcatcagcagtaagtggccccaaggacctgctgcatgccagcctccttgctggatcaacagagacactgagaggtgggctgagtgcagttcttttcctccagggcgacccatcctgctgatgagaaaggatgcatccacagacatgtacagtctaacacaggggcttgtgggaagtgcctcggggccctaagggaatttccaggaggaggggagcaccccaaagtcagggaaggggagatttcagtgaaagccacctcaatcagatatcagatggccctgagcagtgaggaagggagttgggattttctagcctgagtcagtgtccctctgccagccagggtcagggtaaaggagaggctgggtcacctctccaggatgatgccccaggtaggttctcctcagggctggtcatcccatccttgtctcctgttccttcccctccccgtggctgcggaggctctgacggaacatttgaatcattggatgtctgctgaaaaccagcggcccaaagatccacattcagtttcctaaggcagcattgccacctcctatccagtctcagtgttcccctttctctttcaagaggtggctatgaggtcaccccttccaggaagccctcctgtctgccaagcaggagtgcttggcttcctgttagttcccttagcctctggacacatgtggccaacattgaaatattggcttatgaggtctgtcactcccaggcatcctgagggcagggccacatagtgtttatctccaggggatgttaatttctgtatctgcacagcctgcacatagtaggtactcaagtaagtgcttgttaaataagatggagccaaaggacttgagcctagagggatttggggacaaagtaaagacttccttgcctctcaggaaggcagtgcatggaaaggatctgtgcactcactcactgggaatctttgaggagaagctgctcaccactcccgtctcccccattgcttccgctgccgcctgcctgagatcagggcctggcctcgtggttctccaggatcctttagttccacaagtcctgcaagtacattgtgtttactcctggaaacatgagtaacctgcaaccttgtgtgtgtgtttgtttgtttatttatttatttgagacagggtcttgctctgttgcccaggctggagtacagtggtgcgatcccagctcagtgcagtcttgacctcccaggctctagcgatcctcccacctcagcacctgagtagctgggactagagcgcacgccatgacacccagctaattttgtatttttcttagaggaggttttgccactttggccaggctcgtctccagccttgcatttttttattgttttgtttgtttgtttgtttgttttttgagacagagtttcactcttgttgcccaggctggagtgcaatggtgcaatctctgctcactgcaacctccacctcctgggttcaagtgattctcctgactcagcctcccaagtagctgggattacaggtgcctgccaccatgcccggctaatttttgcatttttagcagagatggggtttcgccattttggccaggctggtctcgaactcctgacctcaagtgattgacccgattctgcccctcaaagtgctgggattacaggcatgagcccctgtgcccggcccagcctgtgttttgagcgttccacggctgctggaagacctgttgtctgctgaaatcttcatattaaccactcttctgatttaagtacctcccctccaaacaacattaccagggtggttaatgtgcaaatagagatggtgatttgctgctgaccttgtgcaaacattaataattcacacaagcacctctcgtttataattagagcaggctggaacacagcaccatgtgacttgcgttcttatcagtaggcctttacctgggcagcgagggcccagctttctggctggctctgtccctcatcctccattgtgctgcttgtgaaactgtgttctgagtgacccatctcatggctctctctgtgttcttgtttgcaggatgatgatgggccggttcggtaagtaaccccagggaaagtggggagatggaggcatgttagggctcccccaggaagctcccagagagtgtacatggttatctggagggagtgggaaactagatgggtctcactgcccccatagttctggaatcctagagaaagtgcacagcccacccccacctttctgtataatgggcttgtttctcagagctgagagtggctgggttgtgctaggaggagtggggtggaaggctgggtgaccagctaggggagcaggaggggcctgggatgtaacactggctggaactgtcaggggctggagcaagagtggttgagggtaaaagggagggaggagaggcagccagcacatggagcgtcgttagctggctggaagagagtggctcagctctgtggatgtccttccatgtgtattatttcctcctggaaaccactggtttagcagacttccttagagtcaggcagccagggctcattcctggctggtggcttgtggcctgccccttcctctctctgctcctcatccgtgaaatgggagtgtaaaaggctctccccaggcaggggctgctgtgagtattgggtgagatcacaggtgagtgccctgcttggccgggggacagccctctatgtgggctggttttattagtgttggttttcagtggctcttcccaaagagagagaggtaatcactctctcttccctcatgaaagcctgagacctcatcttcatctcggtgagggatggtaacgtttcaaccctcagtaccaggataccccggccctcggcctggccagcctcagtgctttgggaagcatttcaaaagagaaacctcttgacccccagataccctgttctccagtgagcagggaggggagaacagctcttaaaaggaaaaatggaaaccagatagaagtctcccacctgcctctctagcggagctgatatctgtcttttgggggccctctgggtgggggtgccaccccctgagtcctatacaatgagggctgggccagcttggccatggggctctgtaacctcaagttattatggggaccagctaggatgccattgctgcttatctattgtattagggttctctagagggacagaagtaatacgatagatagatatatataaaggggagtttactaagggtattaactcacacgatcacaaggtcccacaatagtccttctgcaagctgaggagcagggaagccagtttgagtcccaaagctgtagaacctggagtttgatgttcgaaggcaggaagcatccagtatgggagaaagatggaggctgggagactaagccagtctagtcttttcatgttcttctgcctgctttttattttggctgtgctggcagctgattaggtggtgcccacctggattaagggtggtctgccttttccagtccacagattcagatgttaatctcctttggcaacaccctcacagacacacccaggaaccacgccttgcacccttcaatccaatcaagctgacagtattaaccatcacgcctgtggagaggggaagtggctcagatcctgcggggcttgaattgagaagatgcagccagcgtgtcccccctaggctttctttactagaccttaagctgtgctgggaacattcacaggccttctctgttttttgtttgtttgtttgtttgtttttaaggagaattccagctcttttaaattgtctctattattaaaaaacaaatgcaggaagagaaagagaaacatcctgtatatagttgctgagggaggcgaaaccgcagtggggtcacagctcatgggaccggggtgaggcgtctccccaccctgcgtctaggtagaggcgcgttttgggggcccagtgcccccctctgtcacctcttctccatcttttcttcctggaggaggctcagaacccctttggaattgtagaggcctaaagatgaggagagggccgggcgcggtggctcatgcctttaatctcagcactttgagaggccgaggtggatggatcatgaggtcatgagatcgagaccagcctggctaacatggtgaaaccccgtcactactaaaaatacaaaaaaattagccgggcgtggtggcgggcacctgtagtcccagctactcgggaggctgatgcaggagaatcgcttgaacccaggaggtggaggttgcagtgagccgagattgcgccactgcactccagcctgagtgacagagcaagactctgtctcaaaaaaaaaaaaaaaaaaaaaaaaaaaaaaaaaaaaagatgacagtgggcccctcaagcatttttgagtctttttgttttttttgtggcgctgtcacttttgtgtttggttcgggccttgttggaggtttagggaaaagacagtctgttcagttcagttgggagcacatgggcctcaggctgtgtatagcaccctgtggcccgagggcccagaagcctggccccggagcccctgccaccccatgaatgagctttagggtctgatggctggggcagtggctccctaggtaagagccaggtgtcacatgtgaaaagtggacccagctgccactccaggggtgggaggactgtggaatcgcaagaccatgtacaagaggccgatggaattgttctcgttactttgtaggctttatgtgctgtgcttgagaaaatgcaaacaggctattagtcggtgacaggcaattagttccacccccggccttgctgcttctgctgacgcaggttccgaagtctcctggttacccagcctggcaccctcaggcacagcagggtgtctggcccggcacccgcccctgtgggggcagcagcacgccttgtcttcgcttccctgccatgccattcccctccttcagcccccgagagcaccccagggtgctccctcctccagcaaccttcacctgaatgctctccctctagattaccccatggctcactctttcagctctgccagctcttggttcaaatgtcactgatcagggaggccctctctgactccactgccccaaactggcctccactggctctcctccccacccctgccttagttctttctgtactcatgtgacacaccaagcagcactcagctcatggggatggcctggctcctcttccctgtgccagtgtttacacaacgaagcttgcacgtgtctggcagacactggtgccagcaaactttcaggggcacccacagcccctgcctttctcctttcacacatggctccttgacccagaggtgctctgtgggctggagctgacctttcctcggggtgcaccccaccccctgccaaagcagccagccctggccacagtctgcacgcagctgggggcagatgttttaggagcttctggaaggccgggcagaccctccttggctaatgtgctgggctttgccaggagtggtcttctgggcctcagtttccccacgagtaccctgagccagggagggatggggactccattctgcccactccccatcattccggggagggaggtggctccacaggtcctcgctgcctcctgacagcatcactgtcctggatgaggtgggtgaggaggcttctctccacggaaacaagtctcaggggttccagggaggttgcagcctggtctccatggcaatgggtgagctggtgcggcttctccgcgggcggcccttccccctcctgggcctgccctgggctggaggctctttctgaggcagaggggaaagaagggggatgtgccttcctcactctcttccccctcattgtaactcctagtaattccccttcacgtctctcccatttctgccaacagggcttgttccaaaacctctggctccatcccatcacccgtggctcctgactgtgccctccataactcccacgttgcaggccacagcccctgttaacccctctcacagtccacccggctcttgaacctgcgctgggctttctggcatctctctctccttgtgcctgctggtccctcggtggagcgcctttcctcctcctcttgccccagcaagcctggcttgaaccccaggactgctttgtgaagccttcctcaggtccccccagcccttggttcatgggtcccagactcaggtgtctccagggaccaggctgataatataaaagaggagagtgtctagattatgcaatgataatgtcatctgccccttcaccccagggctgggtggcagtggggagtggtggggtctggcgcaagctggagagtccacacccccatccccaggggcagcttattgctgccaggtgggagtgcaggctcactgttgccacagcctccagttcttcaagagaagccagaagttaagaacttttggacaaactttccaatttaagaactgttcgctctcgccgggtaccgtggctcacacctgtagtcccagcactttgggaggctgaggcgggtggattacttgaggtcaggagttcaagaccagccttaccaacatggcgaaaccccgtctctactaaaaatacaaaaattagccaggtgtggtggtgcatgcctgtagtcccagctattcaggaggttgaggcagaattgcttgaacccgggaggcagatgttgcagtgagctgagatcatgccactgcactccagcctgggtgacagagtgagactctgtctcaaaaagcctaaagaccaaaacaaaacaaaagaaaacaaaacaaatgaaaactgttgactcaaatcaaaacattacagcgaccaagctgagcattcctgcagattgagcttgggcagccctggcatatggtcaggtcggttggccccccgtctggcttcgtcttttctgacactaacagggttgcactatcatagtttactccctctccaggccctcccccaagtctgtgcctcttccaagagaggagtccctccttgtttatctctgtgatgtccccagagcctgcggaggctctgggggacaggacgagcgggagctgtaaggactgaggaccgacaatgctcctgccaggctccatgctcctgcctctactcactgccccacttagttccacaccaagagcgaggcaggggctgtgagaatgctgcctttatggaggaagaaagggggtcggagagggaaggatttgcccagtcatggggtgtgaagtggggcagctagaacaaaataggatctattttcgttcccaaggccaagcacatcacaggggtgcagtatgctctctctgtctctctctctcccctaggtcagggtggtccctggggaggcccctgggttaccccaagacaggtgggaggagcttcctacccgaccctcttcctgtcaacctgggctctgcggctcccagggctgctccttgtattggggccccagcctggctggtaacagagggtccctccactgggctcagtcttctgagcatgctctgcccccaggaacctggaggatggaagttgggggccctgggtcccttccaaatgcccttgggtcctgtgcctggtccccagtgcccattttcagagcccctggcccctccctgccttgtggactgtgtgacgtgatgccagtcccctgggtccaggggcatggcagccggcggagaggcctctgcggccccgatgtctccttgagtggcttgactctgccagcccagcggtggcccagctaaatataccctggctgacgtcaagcactcttctgctcctggggtttttcttaagctgcatttatagtttgcgtattgctttgtaaagatgtaaaaatttcactttttttttttgttttgccccttagcagactgtcttattgagtgtagtcttagatgattatgaaaatcatttacagctgccgcattaggaagctggcgtgtgtgcagaggcagggcattttggtcaatgttggtctttaggtgaagaaaacttccctcccttcccccagtcacgcacatgctcacacacgcacacatgcgctcacacaggcacacacacgctcacacgtgctcacacatgcacacacgtgctcacacgtgtacacacgctcacaccgcacacacgcacacccgtgctcacacgcacacatgctcacacatggacacacgctcacacacgcgctcacacgtacacacgctcacagcacacacacatgttcacacacaacctcacacgcacacacgtgctcacacacgcacacatgtgctcacgtgcacacaggtgctcacacacacacatgcacacacgtgctcgcacacgcacacatgctcacacacgcaaacacgtgcccacaatgcacacacatgctcacacgcgcacacacacgtacacatacactttccttctctcctttcctctttgtttctcaccacctccacaaggccacggaaggggctacttgggctgggctgggcaggggggtgtgagctgcctcctggggcccagcctgggaggaagggtcagcatgcttcctctgggaggaggcttggccaacttctctccgtaggtctctggcttacctgggcctaatcccttctttctttttctgggctctctttgtctctctcctaggccagggcggtccctgaggaggctcccctaggccacccactagacgggtgggaggagcttcctaccccactctctccctgtcaagctgggctccgcagctcccagggctgctccttgggttggggccccagcctggctggtaaaagagggtctctctgctgggcttggtcctctgaacatgctctgcctccaggaacctggaggatggaagttggggggccctgggccccttccaaatgccctcctccctgtcttttctgccctggcagtgatgccccacagctctgtgtctacctggagacctcagccctctgcttggggtccaagtctctgttccatatgcccctatggaactcccccctccatggcagcaggagcaaaggctctgaggcaagtgtgcaccagtgtcagcaggagcagctgggaggccggttggtggagtgaagtcagggagggtgcatgtaggaggataacgctgagtctgagtgtcccatggcacgtgggagagaggatggattttatctgagtgtcccatggctcgcaggagagaagatagattttattctaagcatgataagaagcagttggagggttttagttgtggtgggagtggaggggggaaacaaatgatcctgtttgcacttggaagggctcactctgcctgctggggagaagggctcaggggccaggagtggagtaggaggctgcagctgctcccaggcgaggggcagtgaggcgtgagcaggacatggccaccgtcgcgggggaagtggttggattcacaggtgacatttgccagtagacaaggagtgtgggaacagggagaattcaggacgcctcaagtcctaggacgtggcaggtgcagatgccagatgccatctatgtgtttcatatgagaaggtaaaaagcaggtggaagggaccctctgcagcctctagtccacgctgttctggttgttcccaagcgctcttgctcgccttggtttggccgggactgatcatcagggtcagccctttcattctggtaggaattggaaggattctaggcaggtgtgggagttgaggctgaacctcctgagggatcagaagctggcagggccctggattagggcagcaccacgggtttccataaacgctccttcgtgtctctctttgcatgtcctcagagcgggatgccttcgacacgctgttcgaccacgccccggataagctcagcgtggtgaagaaggtgagctattggtgggatgttggatgtgctctcccctggctcgcggctttttgacagcacaaacgccccgctgggaagaaggtgggaaaatgtttggaatctcagaaatgtttgccacatggattgaaatgtaattacagtcaaaaacctaaccacagtgcataaaatcagcgccttttaactcaacctcgctgctccctgggtgtcttcctgcccgcccgctccgcttctgttaagtgaattacccagcccccatttctttctgactcgagaccttttttcaatgtggaaatgtttttaagcatgtcagcctgctgctctcgctggcctcatttaccatctacagcctgcccagtaaacacgcaggcctgtgcggctgagctgtgccatacatggatttggcccgtttccctccagacagagaatgggccctcactagcccaggcagcctgctggtcaatctgtggatggaaaaatctccgaggctctggagttgggggctgggtgtgatcagcttctgggggatctgccagggaggcttgttcccgtcaaaaggaactggagcccactggctgctcattaacttatccgagtgcctgcaggcatcccattcaggaggctgctgcatccctccttcccataacatcggaggagcgctcatttcaacccatggtgcaggcaagagagttctcctttgtctaggacagcttacccaaacagctttcttagtgcaagacttgtcagaacctttaataggctgacctatactgtacttctccaagagggagcttggtaggaagcatttttcaaacttgtttgtttatagtgggatttatttatctatcaattttggggtaagacgcattgtattttagtggaacccacttttggaaaatgttggcctgggtttggacgatgagatcattcatttttggaagcattttgcaaaaggctgttggaaccgtgctaatggtccttctgggacaaagccttcctagcactcttgggtggtgagggatatacttggagcatcagagtcccccacctccacctcgtcacatgtggcccccagggaccctgacagaaccggttcagggaatgaatcaaatccagcttccccacttatcagctgtgtgacttctggcgaagggcgagattataccccccagcctcagtttccccatctgtcaagtggggacagagatgttacccacctctcagggcactgtgaggataaactgggattctctctgtgcatgggcttagccggcagcgtatagtcactggtagcattgagaatggtgtggcctgagattgctttcatctctcggtagataccatgttaattcattctgcgaaagacacattttcggcactggagccaccagcaaggaagaagacagaatcctttgatttgcctggtagcttcccactccagcctgtcccttcctcacctccacattgcaagtttaggtgtctgtagctctctgtgccccagaatgaagtcaggggcccctgcccacctctgcaggtttctccctgggtcgtcccctcctactccttcccatcccacccacatccagccacagcctgaagaccccaaagggtttgcagatgtgtctgggtgcccactcggctcactctcaccttgcactggcccaccctcaggcccagctccaatgctccctctccatggtcttaacgggggtccgcacacccattaatggctcatgaaatctcccttgcattgcgtgtttccctgtagtgccctatctcttgacttctccgtcccaccactacacgcatatggagaattacatcacaggccctttggcgggggccaggggtggagctctctgtgtttgtgtccttagcaccaagcagcatgcctggcacatagtagctgctcagtaaatttgagcagaatgggtaagaaatcatatcatgggcaggctgggcgcggtggctcacgcctgtaatcctagcactttggaaggccgaggtgggtggatcacaaggtcaggagatcgagaccatcctggctaacatggcaaaaacccgtctctactaaaaaatacaaaaaaattaggtgggcatggtggtgggcacccttagtcccagctactcgggaggctgaggcaggagaatggcgtgaacccgggaggtggagcttgcagtgagccgagattgcgccactgcactccagcctgggcaacagagcgagactccatctcaaaacaaaacgaaacaaaacaaaacaaaacaaaacaaaacaaagaaatcatgtcatgggcagtggtggatgatattgagtttctatcaaagttggctttggtcactgaggaattacaggtgacaggttttaagcttgtgccggagagaagccagtgccccttggtacttacataatagggctcagagagatcaccctgggtggatctccccatgtattgcaaatcgataggcaggctgggcgctgtggctcacacctgtaatttcagcactttgggaggccaaagtgggtggatcacctgaggtctggagttcgagaccagcctgatcagcatggggaaactccatttctactaaaaatacaaaattagccgggcttggtgacgggtgcttgtaatcccaactactcgggaggctgaggcaggagaatcgcttgaacctgggaggtggaggttgcagtgagctgggatcatgccattgcactctagccggggcaccaaaagctcggatgatcctcagtggtctggggtgcaggcttcaaacctgtagctgtctagtgacagagtggttcaattccacctttgtaggcccggcgcagtggctcacgcctataatcccagcactttgggaggccaaggcgggtggatcacgaggtcaggagatcgagaccatcctggctaacacagtgaaaccccatctctactaaaaatacaaaaaaattagctgggcgtggtggcaggcgcctgtagtcccagctactcgggaggctgaggcaggagaatgatgtgaacccggtgaacccgggaggcggagcttgcaatgagccgagatcacgccactgcactccagcctgggcgacagagtgagactgtctcaaaaaaaaaaaaaaaaaaaaaaaaaaaattcagtaggtgtggctcaaggcagcactttcctcagtcttctgagtatgccgtttattgttccaggtcacacctaagatacatttgcaaatgtaatgatcctcccctggcagtttcatctttcttaagagcacagggtgctctccagtatgattgttaaatatgtcatgcgtgcacggattggcatatgtgtgcatgggttggtgagcagagacgtgtagccaggatagatgtgggcattatgccatgaaaactaggggctactgtcaggatattgagtttgaaacatgggctttttattttagcaaacaggagatgatgaaagcgtttcacagagctggggctggcaaatgtcaagcctgcccctccagatgggacctgcatgcgggccattcatggctcctgtgtctcttttattcttggcagtctctcatcacttttgtgaacaagcacctgaacaagctgaatttggaggtgacggaactggagacccaggtatgtgctgctttggcttgaaggatcctttgtccaccgccattttcagtcagtgttttgatcccaggtggggcgcgtgaacaaagctggcgccattttgttcatctcacaaggaactcccgtggtgcaggcagaaataaccaccgtggccttctcagcccctctgtcttcctttcctggggctgctgccacaaagcaccacaaacctagtggctgaaacaacagacctttgtgtcctcgaagtgctggaggcctgaagtccaaaatcaagatggggcctgggtgggttccctccaaggctgtgagggaggagctgttcctggcctccctcccagcttctgtggttttgccaggatctttagcattccttggcttgtacacacatcactcccttctttgccttcatcttcatgtggtgtcgtccttgtgtgtgtgtctctgtgtccaaatgtcccccttttatcaggacgtggtcatgttggattagagcccacccatggcttcatcccaacctgactgcatctatgtaaaccctgtttccagatacggtcacattcagaggtcctggtgattagggttccactgtatcctttttctttctttttttttttttttaaagacagagtctcgctctgtcacccaggctggagtgcagtggtgtgatctcggctcactgcaacctccacctcccgggttccaaccattctcctgcctcagcctcccgagtagctgggactacaggtacatcccaccatgcccagctaatttttgtatttttagtaaagacggggtttcaccgtgttggccaggatggtctcgatctcctggcctcatgatctgcctgcctcagcctcccaaccactgtatctttttttgggagacacaaaaccccaaaacacctgagtggtgttattcaacccataacacactccagggctccaccccagcccaacacagggcctttgcacacgcagttcctctgtctagaacgtgctggccccttcagcctctgctcagtgctgctgtcacactgtggccaggacctagcaaatgtccccctggtaggtatgtacaacacatttcttctgcaataagtatatcaagtctacttccccagccccgacccctactcaaagctaaaggagcatccttaaattatatttttgggcactccgagagcattaaagacaaaatatgattttcccaggattagcagggtgcttgaatgcggaggtttttgagctcttggtacagacatccctaatgcacagctgatccttcttaaaccccaaggtgaatgcattcattcccttctctttctttaactttcctcatttgcttttctaattaaaaaactaattcaggttcattgtagaaatgtctgaaaatgcagataagcaaaacaaataaaaatcacccataatcccgtcacccggagatgaatgcacagagggttttgttcaggccttttctctacacatatagcgagtcatggacagtgtgggtctgtatataaaagcatcacggtctgtttttaatgtatatatttatttgtgtatcgttggccaacacatttcttattttccgcagtttacaaatgttgcacatttagcctcagattattttctgtttgagacgttagcaccccagaagccactgaggtgaaaagtaaaaatcttcctttctctttttctggagacctcccccttcagactctccaggggcagctaactgcagttcatggttggatgtgtatttttctagatattttctttttctttctttctttttttttgagacagagtctcattctgtcccccaggctggagtgcagtgacacaatctcagctcactgcaacctccacctcctgggttcaagcaattctcctccctcagcctcctgagtagctgggactacaggtgcgcctcaccatgcctggctaatttttttgtatttttagtagagatggggtttcaccatgttggtcaggctggtctcgaactcctgaccttgtgatccacctgcctcagcctcccaaagtgttgggattacaggtgtgagccacattttctatgcacaaaggtatttttctaaataacagtggatcttaccgcccactgttttgtaatgtgttttgtgtcactaaatacactgtgggcatcttttggtgtaagagaaagtgtgtgtgtgtgtttctatctgatcctttttcccttgctcgatctatcggtctgtctatattttgtcacttttaatgggaagtgtatctcatcagcgggaaggctgcactgcacctcattaaaccagtgcctcacgactggatgtttttctgctcctgtaaacagcagtgcagagagcagctttgtgcacggctgtctgtgctcgtgcctgcttcctcggaataaaagcctagaagtggagtcattagagcgaagcctgcaccgcacactttgaaggctcaggaagatttgctgtgtgggggcccctggtactgtcatggggcgtgtgaggggcactgctcccccacatccataccagctgtccccacagcccttctcagaggtgtctgcacatcagtattagcagctgagcctcttacattgagactctaaaattaaatttgcatttgtttttatttactcaatatcttcatttttttccccccgattaatcgtactatatagagtcttaaaagtacatttaaccactggtcccccagaaaaggtcgctggttacagaaatgcagggatttttgttttgttttgttgcaaaggaatttgggtatttttataaataccatatatcatttatgaagactgtaaatcattaacgtcttgatgccctaggagtcggagaggccctggtttaatttcttcaatttctatttgtgtgtgggtgagtgtggtttatgtagtctggtatgtgtggtttatgcagtctgttgggggtgtgtgtgtgtgtgtggtttatgtagtctggtgggtgtgtgtgtgtgtgtgtgtgtggtttatgtagtctggtgtgtgtgtgtgtggtttatgtagtctggtgtgtgtgtgtggtttatgtagtctgtgtggtgtgtgtgtgtatttgtggtttacgtagtctgtgtggtgtgtggtgtgtgtggttttcgttgtctgtgtggtgtgtgtgtgtggttaagtagtctgtgtggtgtgtgtgtggtttatgcagtctgtgtggtgtgtgtgtggtttatgtagtctgtgtggtgtgatgtgtgtgtgtagtttttgtagtctgtgtggtgtgtgttgtgtgtgtggtttatgcagtctgtggtgggggtgtgtgtgtgtggtttttgtagtctgtgtagtgtgtggtgtgtgtgtggtttatgcagtctgtgtggtgtgatgtgtgtgtgtgtgtgtggtttttgtagtctgtgtggtgtgtgtgtggtttttgtagtctgtgtggtgtgtgtgtgtggtttttgtagtctgtgtggtgtgtgtgtgtgtgtgtgtgtggtttttgtagtctgtgtggtgtgtgtgtggtgtaggtgtgtgttttccctccttttccaaaccattcttacattgcggacagcgtcccagctctgtgatggtgagtgaactcctcagcctccctgagcttctgtccacagaattaaactggaggcgatgggcagtgtgaggactgggtgagatggcgcactgagatcaagtgggcagggctcggcaggggttagcactgcggatgaggaggcggtggtggggcctctgggcctccgtggggattctgctccctgctgagctagacagcaggttgtggagagagggcaccacgctgggtgcttgtgaaagtggagggtcacccgctcgcagctgggccccccagccctgccctctccttgtggccgtccctccctccttcctgtgagcccgtgtgctgggacagtgaggagacaccacggaaggaagaaaagactcagcaggctcagggcctgcgggagcagcggcgtggccaccccagacctcctggggagaggtgtgggttggtgccttcattcacgtggcagcttccattccctggaagttagtccatggagacgtgggcatggcagctcaatgttgttctgctgggaaggtgccagcacgcttaaccagggtgctgtgggcatgaagcttccatgtggagacacacttaaaagaattcttcaaacccgtctgatctccttaatgataggagtggctggctgctttgtggtgtggaaggctgagggcatgtgacatggaggccaagtgccatttgcccatcaactgacagcgtgttgaatttccaggcgcagtggctcatgcctgcaatcctagcactttgggtggccgaggtgggtggatcatgaggtcaggagttcaagaccagcctgaccaacatggtgaaaccccatctctactaaaaatacaaaaattggcgggtatggtggcacgcgcctgtaatcccagctactcaggaggcggaggcagaagaattgcttgaacccaggaggcagaggttgctgtgagccgaggttgcagtgagccgagatcgcaccactgcactccagcagggcccagaccctgtcctgagtcccttaagggactgttgcccactggcactagctttatgctttacagctctagctgcagctctccctgctaaaggtcagggcttctgatattggatgtttgtgattttgacttttcatctttttttttttttttttttgagacagtttcactcctgttacccaggccggagtacagtggcgcgatcgcggctcactgcaacctctgccttccgggttaaagcgattctcctgcctcaacctcccgagtagctgggattacaggcatgcaccaccacacccgctaatttttgtatttttactagagacggggtttcaccctgttggtcaggctggtcttgaactcctgaccttgtgatccacccaccttggccacccaaagtgctaggattacaggcgtgagccactgcgcctagaagtttttacttttaatttttttaaaaattcaaatttaagaattctggagattgtttgtacaataacgtgaatgcacctaacatgattgaactggacagttaaaagtagttaagatggtaaatgttatggtatattttatggtatattttaccacaatttaaattaattaaagagaaaggttagcataagcgagacacaaaagataaatggatatgcgattccacttacgtgagatacccagaggagtcaaattcatagagacagagagcagaatgattggtggttctcaggggctggggggaaggtagaatagagaattgggggacagagtgtcactttggtaacatgaagaagttctggagatgggtggtggtgagggtgacccaacaatgaggatgtacttaatgctactggcctgtgcgcttacacacggttaagatggtacatttcagcttatgtatattttatcacaataaaaaataagttagcaacattcaaacaaaaacattttaatttaaatagctgcatgtggccattggctaccatgttgaatagcagctccagaggccccctggagaatggggccacagtcactgtggtctctgctgcaagacagagtggtgagggccaccaggtcccagctctgcaccctgcagatttgaatgaatccttccagcagctgatgctgatggagcactcacgtgtgccaggtgctccctcccagccgtctcgctgtgtcttcacgacagccctgaatgatgggagtcactactatccctggggtcaggagtgggggacagttccagaggcacggtcctagccaggcagctgcactcagctccaaacactcatcatatttggtctttgcagagccccatgtgttagagccccctccccttttgcttttttctaggttaggagccaggtctcaaaagacttcacattcaggccttcacttgattccagattctcctgcctaaagtgagaggagggatggattgctttactttaaaatatttccagctgggtacagtggctcccacccgtaatcccagcactttgggaggctgaggcaagtagatcacttgagcccaggaatttgagaccagcctgggcaacatggtgaaaccctgtctctacaaaaaatacaaaaattagccgggcatggtggtgcgtgcctgtagtcccagctacttgggaggctgaggtgggagaatcgcctcagggaggatcacctgagcctgggaggccgagctgcagtgagccttgattgcatcagtgcactccagcctgggtgacagagtgagaccctgtctcagaagaaaaaatatgccccccttaagtttgtgcaaagcatttgccaactccttaccctgcccggaaacatcacaagtctttctctgcagtttgcagatggcgtgtacctggttctgctcatgggccttctggaagactactttgttcctctccaccacttctacctgactccggaaagcttcgatcagaaggtatgtgcatggtctccatccttggtaggggctcaagaaatgctcattgaaatgcagagcatagactatcccggcagctcttcctgcagcctggctgcattcttcagaaagtaaaaaatgcacaagtgatattgcaattagatgtaactctcagcaaaagaaataagaagcccatcagccgtccacaacgcatccgagttttgtttgccacattttctttgcggtcttttccatgggaccgtgtagtttttaataattgtgatcacatctcggtagagttgtaaacccttcccccattctgctgcagctccaccacctgtggttttccctgctgcttcccaagctttccaaataccatctccagtggtggcacgaagtcccaaggatggctctgttaccagcgtctttccattccccattcttgggcagtcaacttgaacatgtttctattgtttttccctactgaaacaacagagcatctttttgatacagattttttttttcattcctgtggattgttttcttaggaaaatttctcaaatagggtcaaatttggggcattcctttcaatctgggctggcccacgccacccggtcccgctgtcactgccctcgtgcgtgggcctctccctgctgtctgccctctgtccagggcttcccgcagccaagcctctcacagcagtatttagcacattgcctttaaaaacttggccatggatggtctatgttgctttggattcatgggcatctgtcattttattttcccaaagtgttagacccatgagtcagggaggcagacaatgtaagctggtggcgacagccagagaaatagcagaaatggggccagtgtttatcaatctgcccacttctggcacgttgcagtctgtttgcttgtggccaaatgttgttcctatcttgcctgctgagatggaatcaggacagattagagaggtcttggcacatggagtccatgttgaatcgagagagagagagcgagcgagcgagcaagagggagtgcagagggaatgagcagaattgtgcagaactcaccaggaaactcaccaggtgcctgtgctgtcatcctggaaatgaaaggtcagaccatccagcgaagaagcgcatgcatttccaggccccgatatggctggttgcagacacattgttttggagagatcttttctttcttcaaactagtaagaatgctggcgagaacagtgagtttagccaggagacctagggctggtttctttccaagacaaggctttgtacaaatgtcagaggcatcatctcctgggccctggccttcttccctttgaaactgggatgaaagtctttgacaattgctgccctggcctgcgaggcttgaggaggcttgagtcatctgccttcccctctgaatcggagcgaggaagggaaggctattttcaggtatagcatgcagcacaccattcatcctgttcactcaggagaaagggagcctggggtggcggtgtggctctgcgggtggctggaacactctccttcggaggatgggaggctgtcagtagttcctcctccagcccctgccttttttccctttctcctcatggcagctgctggcaaggtcttcatgagcccatagtatttattatctaccttgtagtcttcgtgaatcctggacaggtgggtggtccctgctgtggaggactcacccacttcaggctgggcccaacacccgtgtactcaaaactgcttgcggatgggatgttgatggcatcccttgctaatgtctcctgtgggctgagaccccgaggtgcgtttgctctggccctgggaatcctgacagctgctccacatttttgggaggagggactgaggttcagtgagcaaaaccagagatgcgtcatgagctgctgtccccgagggtagtaatgacttatggtttaaaacaattgcattggatttaaaaaatatcacactggacagctcagagcctgtaggctcgtgccccatgagctatctcagaggcatgagtgtggccttcagtttttttgttgcaaagccactgtttgagccttaccctgcactggccacgtgctgagcaccttgcacccattggtcatcattttgggagactctgcaggctccctctctctgtcgagtggggtgcatcctggagacgtggagatctttcctagaagaagacacgagttgcttccccctcagcattactggatgaggacagggaatctcaggaaggcttagagaccagcccagggttgcacggccagcaagggcagagccaggagggtcgactcctattccagaaccctctattctttcctcacctggccaagttgattaaaaccttttgaattgcagagagaaaggatttctgcccatgtggctggctcgaagcaggtgtgtatatggcctggtctctgctgggccttggggcctcctactgcagtcacagctggggtgagcggtccccaggcctctccgggatccatgtgctgggtatccagggatctaggctcaggggacacttctctgcctggcatgaaagagggctgggggaggaggcatggccttgagagataacaggcatgggagggtggcaatttcctgcctggcatttcctcagcctgagaagaaagcagaaggaaaatctcacttcaaaaccacttactgtggggccgagcggctgcagagcaatgaggcttggaaggggctttgctctccccttaaactgttctctcatggtgtaggggtgaccacctcgtcacccgatcacactctccagccgtctctgagtgtctccacgtgtcatgcatctcatccccagcccctcctgagcatccactccctcagcgtggaagaggattcctcaggcttaagaggtgcacgggagaggcacgtgaaaagaccggtccaaattggtgctgacttttacaatggagaagaatcttttcttaaaagaaaaatcttttctcgctattccctctctttgctatcctgtctccatctcgatttggggtcaagcctgttgtgtgtgtgtgtgtgtgcacgtgtgcatgtgcatacgtgtgtgtgagctcatttgatgatatggacggtggtcagctaaagggacctgtgttgctaggggagtggaggtgggaggctcttggaggagaacgggcacagattctacgtttcagtcctggttccatgcctgtgagccccgtgccttgtttttcttttcttttttttttttttttggaggcggggaaggaatctcactctctcacccaggctggagtgcagtggcacgatctcggctcactgcaacccccgcctcctgggttcaagcgattcttctgcctcagcctccttagtagctgggattacaggcacatgccaccatgcctggctaatttttgtatttttagtagagacggggttttaccatgttggccaggctggtcttgaactccagacctcatgatccacccgcctcagcctcccaaagtgctgggattacaggcgtgagccactacatccagctgccccatgcctttttagggcaccgatgtcctagcccatctcagcccagcaccaccctcctttgtgaaggaagatgatattcacctcgtacagggctgggaggggaaagggaacctgtatggaatacactgaccccatggtggatgcacagcacccgcaggtcgctccctgctctctccttaggggaactgcgttctgcaccctccgcacgggccgtcctcactcctcccccattgccagtgtttggccatcctcaggcccagccctggtgcagcactcccgcatctccaggcaggctgtcctgcagggttggggtgtctgccatgtggcccagtgttcccattggcagtttctgagttggcctctggagcagggtctccgtctgctgcacccccgcccctgggtggacatggcctgccctcctgccgggctgtgtcttccccactgaccctatgactagccagaccctcttgcggttggtgctggcaggtcattcgcccctttgcttctccgagcacaggccgtgtgcactgtggaagcttttccaaagcaccccacactgttttccagtgttgttcgtttgattaactcagggaagcctctttttcctggttaattattaaattacattgcaagtaaaattgttcttgtttctgattcattggcctcaaaatcatgaaaatatgatcgttgaaaggattttttgtttgtttgtttgcttgtttttttgagacagagtgttgctctgtcacccaggctggagtgcagtggcacaatctcagctcactgcaacctccgcctcctgggttcaagcgattctcatgcctcagccacccaaatagctgggattacaggtgtgcaccaccatgcccggctaatttttgtatttttagtagagatggggtttcacccattggtcaggctggtctcgaatgcctgacttcaactgatccacctgcctcggcctcacaaagtgctgggattacaggtgtgagctaccacgcccagccaggatgtttgattactaagagccctgaagtcccttgcactgtgacatctgtgcttgtttgctgtttgtttgtttgatgtcccctcctcccatcagccttggcttgcggcaggtgggtggctggatgtaatctggttcattgccggcatccctctgagtggtctttaaacacagcccagaaggcttttattttaaacctgttcagccatcattagcaggataaaagcttcaggtacatttgggggctgaggagtaatagaccctttaatttcaggggaagtcacggtagggcggaggtggccacgtttctgtagcatctaacaggaccaaggtcctgcaggctgacgcttgcagccaccatcgatctgacttccgttctgactggtccactgtccctactcagtgctaaggccctccctcccctgagggcaccccatcctgcagagacacagcctcacgtgcaggtctttacagcccttcctggggcagtgccaggcctgcgtgcctctgcacgggactcatcctttctgggcctcagtttccctgtctgtgaaatggggtcactgtgggccaggcgcagcggctcacgcctgtaattccagcactttgggaggctgaggcgggtggatcatttgagcccaagagttagagactagcctgaccaacatggcaaaacccgtctctaaaaaaaataataataatacaaaaattagccgggcacagtgatgcgtgcctgtagtcccaactactggggaagctgaggcaggaagatggcttgagcctgggaggtggaggttgcagtgagctgagatctcgccactgtgcactagcctgcgctctagaccctgtctcaaaaaacgtaaataaataaataaacaaagaaataataaataaaatggggcccctgtgacttctcatcaggtggctggcatctggggcagagcaggctcttggtggccgtgagccctcgagagcaggccgggcacctcatccttccatctctcagcccagatcactggtgtgaggggtgagaaccacctagtaagcgcacatggccctccgcagacttcctcacccgtgtctgcccaccctgtggcccgccccgggctcactgggtccttgtggacgtcagcgttgcagaggctcggtcctgtccatgccggctgtcctccagcagtgggccgtgtgtgggaacgactgttggaccctaacgctgacccaccccccttccttggcaggtccacaatgtgtccttcgcctttgagctgatgctggacggaggcctcaagaaacccaaggctcgtcctgaaggtaatgcccctggctcaggttcccccgggagaggtgcgcacggaggggaagaaaaacgggtcctagaagtggctggaaggctggcatgttgttccccagatgggccccacgtctctggctctggggcaagggtctgccaaccccagctcctcagtctcctcattttgggaaccaggaggacttcgctggtggagctggcagtgccggttctttaataaccacttgactttgaaggacgtggcctctgcccacagacctcaggattaagtgcgtctctagctggccactcaggctggaaatgcagcttcgtgccctgagaagaaattaaaggcttactcaactgtaatgactgttgggctggaggtcccctgatgctcagccaaaggcagtacttggtagcagggacttggcatgctctgcgtgggtcggagctggaggcaggaggccagcagagctggggcgggcggttgcttccctgtcccccccccggctcctgtgccaagttacctataggaggactctctaacctgagtgagcatcacagttccccaaacacacttcctaggtgtttggggacagccaggctcagcagaacatgggtggcactgcctgtgaaccctgctggaaagttacagggcagagctgaacattaaaggctttgacaagtcctatatgaagacatctgtttgcctccatcaaaacctttgccatgcaggaggagcccacagaactcagacactgtggtttagtgccctgggcccccactttgaccgtggccccctacctagccctgctccctctcctgagtcccccatggtgctatatgagttgggagcccatgatgcttcctacacctgttgccagcatccgctcaacggcgggctttgtagagtctccaaaatagctagaaaatggatcctgtcccttccatctacccactgcagccaccgcttcctgccagtccacgcggaaggttcctggccggtcccttcctgcctgttcatcctcctcttggggtttcacaggacaatttcacaccctcctgtctcgtgtgtatggctgtttattcttttttgttttgagacagggtctcactctgttgcccaggctggagtgcagtggtatgatcacagctcactgcaacctcttcctcttgggttcacagcatcctcccacctcagtctgtcgagtaactgggactaaggcgcataccaccatgcccggctaatgttttaacttttcttttttgtagagacaaggtctcactatgttgcccagactggtctcgaacttctgggctcaagcgattcgcccattacaggcacgagcccccatgcctggccttgtttattttttattgtccctccctccccactagaacagaagcctcaagggagcagggctttgtcccctgcatgccggtgctgagaatggtgcctggcctggaaactgctcgacagcacggatcaaagcacatgtccagcagggagtgtggcgagctgctgcctgtagataccggcccggcctgggtctctgggacccctcgttgctgctgccctgcagcccttttgttgctgtgaggcagggccatgagggagtggctagaggcccgagggatgctgctttgcctctccccagctgtgcatccttgaacaggttactttgcctttctgtgccagggcctcctcctctgttgaggggagtgatgatggcacctgcctccacgcgtcatggggtcgctggatggggggcggatgttcatcacacaggacttgtcagagccttcactgttcaactctgccctgtaactttccagcagggcccacgggcagtgccaccacgtgctgctgagcctgactgctcctgagcacctattacgctcaagtgagctgctcccatgagcactggaagagggtcctgcccacagaacacaccaggtccctgctgatggtggctgctagctcggcgttagtgtctggtgggtcgcacactgtcagggaggagaaatccttgctcatgtccactgtgggcttggctggggcttcctttagtttcctgtagcccaaagcctgggccctatctgcagcatggggtgcttcccccgtaccctcagaagagcccctggtggccctttgcctctgagctgctgagggagccctgcttctttgtcctcccgaacccacgactttttttttctgagacagagtcttactttgtcacccaggctggagtgcagtggcgcgatcccagctcactgcaatctccgcctcctaggttcaagcaactctcttgcctcagcctcacaagtagctgggattacaggcacccgccaccatgcctggctaatttttctatttttagtagagatggggtttcaccatgttggccaggctggtcttgaactcctgacctcaggtgatccacctgccttgccctcccaaagagctggggttacaggtgtgagccaccacacctggccctttgtcccgtttttgaggagtgaggcaggagcctgtccagaggccaggatatcctctgacaggccggcctcctaggagggtgtttgcccctgagcccggatgtgtttcctactcatctgccgctggacggcacgttagggaacccaccacggacgtgtggaaaccaggccagaggcagaggcactggtccagggcaaatagcaagttctgcagcctcccaggcagggtcccttgggtgtcccagggcctctgtccagcccaggcagggggcagagctggtctgcagtgctcattagcaccttcgctgggccagcactgggcaggggccaagccgcagagatttatgagatggggtccctgctgggcctctttattttgtggctgatgcaatgaatgagagacttttccttcttcattcaaaatcagctggggagcaagaatcaggaggtaacagagataagaatgacacggagaatggggtgcagtggctgcggtctccctgacaccctcctctgagctaggcagacttacccgggtacccagggctggtggggagggaggcagtggctgtggcctcccctgcaggcctgagactgccctgttggtccccacccggaggaagcagagcagtctcacaccccctgcacgtgggcgggtctgaagagccaggcctgcacctggttccctaggcccccagcaatgatgggcatcctggccccctgcccccttgtggggacctggcggagactccagtggggtccccgaccctgctcttaaggaggccccttgcctgggagaaaggcttgtggctcgctccaaattcacagagccgagtgcggagctcgatggtggggtgggtgtttggggagcacagagggactgaggttcatgggtcacagaaggtgattcctatccctgggcgcaggtgctaaggggtggctgtggttagcaggtctggcaggggtgtgagggttaagttctgtttgtccagcgaggctgtctggaagttctcagagctcagacctgggggctgctgcgtgggggcatcggtgtcaggctgctgctctggtctccctgtgagtccaccatgggagtggagtcagagggggccaggaggtgatggcccccacccctgggagctcctctgtccttgctgcccccctcgccttggccacctccaactccatggccgccattctccctcccctgcctccactgggctgttgggagctggggtggactcttcaggtcagggggagaccctgggatccctgacagagccccgggtgtgtccccaagcccgccgagccgagttccccgacagagccccgggtgtgtccccaagcccaccgagctgagttcagccctgcttttgctctgacagcacactcgtgggcaggtcatttctccatgtgagtcttggtcctctttgtaaaacgagagggaaggaaaggaggctgtgcaggctctgatgagggtgtgtgagtcgagaaactccatgcccagtgacaaggacagttgctgattcttagcatccaccccacctgctctctcagtaaccgatgtcgtttcttactcttgtgatcaggactaaagcacagggtcatcccatggctgcttttggatcacagggagtcaggactccaagggcctcgagcgttacctggtccaggcccattttacagatgaaggcactgagccccaaatcacggaagtcacttagaggtcacagagcaagtgaaatgaacaaggtgtctgattcccaggaaggttcttgtccacataaagaaagtggcccaagacttccagggccccagagggagctgtcgggtccattaagtgttactggggtttttggtcccggtaagtgtcattagccatgtcccccaaccggttcttagacatgtcctgatgcagatccaggaggggctgtgggagtgtctctgttcttgtcaccccaggtgcctgtccccgcagggtgtcagcccgcgccaggagctctcacaaaacctgtgtgtctggggaggcactgcccagagcgtcctggacatggtggtggccagtctttaaggggaagcgctgtgtgtggatgcggcagctggtgtcatgctggagacgtggcttctgagagtacctaccgcaatgacaggaggatggcacgcctctgaagtttctctgtttccttctgcagacgtggttaacttggacctcaaatccaccctgagggttctttacaacctgttcaccaagtacaagaacgtggagtgacgggggagctgtggatggtggcaggagtgtcccagcaagaaaggcggcatccgtctgtgccctgtgcctttccagggagccaggcgccatgggcttctggtccaagctgtgttgactgtcatccccaccccacccctacctcacgcctgccccaccccctgcctcttttggttgttgttcttaatctcctctccatgtagttcccagtgggcaagagcctttgaaaatgcaggattctaaacactcgtgcttgcgtttgaagcctcgcgtcactcagtcgcgtgggatgatgagtccgttgttgtctgccttggccgaaagatgaaaaaaagcctgaaccccaacccccagctggttgagagcaccctgcattctgcctcatggtgcagttagcgatcacaggccttcagaagtacaacatcagctcagcaggaacgccggctccccgaggacccaggcttgacgattcaccggggatctcctgggctgggctctccttggaagtgaggccttttattaaaaataaaagggttttgcagtttgaaaaactttaa

SEQ ID NO: 519 - DNA, 100117 bp, Homo sapiens
ggctgtgctggtctgcagagctgccgccagctgcaccctcctcgccagtgagttctgttgctttcgtatcattttcagcaggagctaaacccaggccagcccttcttttcttttctgctttatggcagaattttgttttgcaagaatggaccctgggtggctgcttgacttttcccaggaaggtgatggggacgttggtgttaggacgatgggcaagggggtccaggttgtctcactgcggccccagagggatgagggtctgacttgtggagtgaaatttccagcactctgctgggggcgagtagatcattgggcccagaagaatgggatttggaacattctcaggcacatgctgcaattaagattttctttttcataggggtacctgatactgtgggtttctctctctctgtcttttttttttctctctgagatggagtcttgctcttgtcacccaggctggagtgcaatggcgcgatcttggctcactgcaacctctgcctcccaggttcaagtgatcctcctgcctcagcctcccaagtagctgggattacaggctcccgccaccgcgcctggctaatttttgtatttttagtagagacggggtttcatcatgttggccaggctggtcttgaactcctgacctcaggtgatccacccacctcggcctcccaaaatgctgggattacaggcatgagccaccgcgcccggccatgggtttctcgttagtggtcttcggttctgtgtttcccctctaagtagctgatcgtggccggtgcctggctttcccctggtcaccactagatattctgtcttgtctttgggaggcagagtcagtagaaggtgctttgcactgggcatgcctgggagtgagcccagccttgctgttattagcgcccatcgtgacggtcggccaggctgccctatgttcgatttttcctcctgtgaaatgggaacaacagtagagctgatgtgtcctgggctttctgcatcccagggactatcccagctccttaacgtgctttgctcagtgctatcctcctaaaaagttttcttttacagttgagtaagctgaagcccagagaggttaagtaacctgcccaaggtcacaccgcagatcggaatgggagtcaggagtgtacccaacagcctggctccctagtcagtgctctcaacctcagcttgaaggccgcctccctgggccctgctaggggacccagtaagatgacagttattcacattctcctttgtttctgataccaagcaaactcctggtaaatgctccttccccacttttgtggaataaagaatgcacatttttttctgagctctgcctgggtatccttaaggagagggacgctgtgcctgggacgcagatgaacaagataggagctgtttcctggaggagctcccaggctgatttttgcctttgatgttctgcatctttttcacaggctttttgtagatgtgtggggatatttctagaggagaaaccagaggtggaaggaggggcataatgaaattgaatgctgggcatctcttagctcacattatatgaggctcttcagggacaatagaccttgcaataaaaggcaaaaaggtgattgcgcacagagtgcttttcctgcacagtgctgggcgggatggggtggatggggcttggcggctggaggagggtagaccctgcccgcacctcctgggacctgtgcgggactttgctcaccttgctgtttctaaccaaggtaccagattctcttcactcaggtgtgtcagattttaacccttgaggctagaaccttgccaggcttattcgaagtcagtggttcctagtagtcacagggcccctgccctagaccccagaccaggaccccccggcccctgcccgcccgccttggcctggtggggtaggagtcactgtgaaaggggtcctggagcccagtatcactccagcgacatttcccagagagcatcctggggccagtgtggggtgtgggggaacagatactgagcgctctgtcccctccccttggagaatctcacagtacattagcagagtcaagactctgagaagtccggtaggaaaagacacctgcttagcttcccttaacttcacgactcctccacctccttgacctttgcttgattcatgtgtgacctgtgaacgtctaaactgcaggactcactttgggagatactgatggagaccaaataggtgtcctgctcatatatcctccacttcttcagttttgctcaggatccactgggcttcctaaaatgcaaacgaattgaaaagctgtgctgaatgtgtttttctctgtctgaaagtacagccacccacgaaaggaggaggtctgctaagttttcttttagaaaaggggtccccaggctctgaatgcttgaggacctcattgggatcaccccctccattgtgggctacccatcctccacccgctgtggcctattgataacctcccagccaccacctatgctcctagaggccctgactggaatccctgtcctcaccctgagtttgtcacctccttccaaacttcgtgtcctctgttgcagttgaggacctggaagtcatgattgggctgattagtgatgggtgtttattttgaattcttaactaaacaaggaggaatcacatcctagctccgtattttactagttatgggaccttgactttcccaagatctactttccttgtcagtaaaatggcaataatcggggtaacccataccctgattgctgagaacccctgtaggcgtccatgcctggcccaaagccaggacccaggaagggaggcgcagctgggcggcctcttctgcgtctctgccagttgctggcttggattctaacaccctccttccctccctccctcgctctctaccagtgggatctgagaccatgaaaacgtttgaaggtttctcaagcgtctgtgactgccccacgtctgtcgttgggtggaaaggactttgtaattgaacggagtcagttgtaatgtgaatgtcatgtggagctgcttttccttggcaagtccttgctgtgtgagccattgtttccagatctgtagaaccctccctaccctgtccccctttccgggctattgggaggctgagcgagctcatcatgaggcccctgaaagatagtttctgtgccctgtggagctgagtccccgagtctctgtccccacctcacaggccccctctcaccaccctattgggttggtaaatttcaagttgggcatcagataggacaagggaaggggactggagaaggaagagccgacagtttgccctcaggacttcagagtcactcttttttgtttggttggttttttgagatggagtcttgccctgttgcccaggctggagtgcagtggcgtgatctcatctcaccgcaacctccatctcccgggttcaagcgattctcctgccttagcctcccgagtagctgggattacaagtgcatgccatcatgcctagctaatttttgtatttttaatggagacgggggcttcaccatgttggccagacttgtctcgaactcctgacctcaagtcatccacccaccttggcctcccaaagttgctgggattacaggtgtgaaccatcgcgcctggcccagagtcaccctttctttttgtgccttattagacatcttcctgctacaggatagcccagaagaaaggaacaagtttccgtcatgaataagtcccctacctactagggatgtagggataaaggactggaactctctttcttcaccctgcagggcaaactccttcaagactcagctccaggaagcctctctggactactacactccctcctgagcccccagccttctcacatacctcccttatgtgtctcctgggtgctggagccctcagagcagggcctgtatctaagtccccctgtggcccacccagtgccccgtgccaggcctgaccatagtggatgtcactaagcagttgttcaatgagtgaatgaacaaatgcaaactaggcccaatcttatcaaattatactagaataattgtataaaaaaccagacttctttaagtggaggaaatttaaagtcagaagtgggctgggcacaatggctcacacctataatgctagcactttgggaggctgaggcgggcggatcaccggaggtcaggggttcgagaccagccagcctggccaacatagcgaaacccgtctctattaaaaataacaaaatttagctgggcgtggcggtgcatgcttgtaatcccagctactctggaagctgaggcaggagaatcacttgaacccaggaggcagaggttgcggtgagcggaggtcgcgccattacactctagcctgggcgacagagtgagagtcagtctcaaaaaaaagaagtgaatgaatacgaccatacctgcttttccagctcctgactcttaaacgtctcgaataccaatgccaaataaagggaaccgagagatgaaaggtgtcactgtcctgatcttcagatgcagaaatttctgtgtagctgaggaggtggggcccgcttgcccccctttgaattttgggttgtgcttgagcagaagcattcattgcttggagaaagcagaggagaccccagaagcacttccctctgaaagggagaagcaggtaggccaaggcagcggttctgggaccagctctggggccacctgcttttcccacactgggtctgtggtgggctcggcagctggcctgcacacaggagatcctcaaaacagatgagcgagcatgattgccatttttacactccctcatttaatccgcagcactggaggaggtgtgattatggtgtgtattttgtgcagccatttggtggacacctaccgaggacccgccgtggggcaggctgctggctgggctctgaggatgctgacgaggacccttctttgggatcctctgttcgggttgaagacagtttatgaaaacataagataacagaatggccgactctgaggcaggagccaggggtgtgtgagtgggggtcctggaaggggtctctggaaaccagaggaggagtggtcctctgaggctggccaaggctcccagcagagagacgggggcatgggcagaagcctgtcgtgccagtgagccctggcatttctgagcccctgatcggttctgttgcctgcacgacggcctgggtgagcaacactgacaggagacccctgccttagtaccatgtctcctgggctctggctagtggcgcctcctggcagcagctgcccaggccacacaggatgctggctacatgcttggctggtctggccatccctgcatggccccgctgtcactggtatctggagatcacacccagccagagcctagtgccaccctcggatgcttccttggggagggaggatgccctgtttccatggcaaccctaggtgggaggccagggcttcaggcaagctgctgagcttttcacagccctgggagtgaggagcagggcaggctgaccctggcctgtggggcagaattagtagaggaggagccccaccatccctgagaagaggaggggagtggggtggggaacattagacaatgttcactgcccctccctcagcttcccagctgcccacggcagtcccaggccaggccagtgtgggcgtggggggcagttagagcgtggccgtgtggtgtgccagcacgcagtgcaacagccaagacaatggagtcatcccctgcccctgggcccttccctccaccccacctcatgtctgcactaggtgaggaagcagaggacggaggagcccagtgggctctgggagctcctgggactcctgagtcggtggggacggggcttcccagcctcaacactgaggattcttggttgtggagctctcctgagcattgcggggtgttgagcggcatccctggcctctacacacgaggtgtcagttgtgacaacccaaagtgtctccagatgccactacgtaccctcccagtgtgggggtggaggaatcgtccccagttgagatccgctgagctgagaggctccccggaagcaggtggtgaaggaagggaaggccctgggccctggagacatggatgcctgcctgggacacacacaaacacgcacgcacatgcacgcatgcatacactcactcatatgcacacatgttcatgcatgcacccgcagtgaccctgaagggactagactatttttagagcacttttaagttcacagcagaattgagtggaaggtgcagagatttcccgtgactgcacggccccaccacgcacactatcaacatcctccccctctaacaacgtccagaccagagggtgcatctgtggtacctggtggacccacatggccatatcagggtcacccagagtccacagtttccatgaggggcccctcttggtgctggacattgtgtaaggacagggacccccatggtagcagtgacactgccctgagatccccgtgccccacctgctcatccctgtctccctctcactcctggcaacctctgctcctttcactgtctccgtagttttgcctgccccacagggtcgtgcagttgggatcacactgtctgcagccttttcagactggtttttcactcagtgagatgcatttaagtttcctccacgccttttcacagctgacggcgcgtttcttcttggttccaagtggctctttctgcattgtctggacggatccatttgttccctgtttgcctcccagaggatccgctgctcttgctgcagatgtatagcccaggtgctgtggagttgggatggagcagtcgagctgggatcagagcccaggcccctgccctgaggttggagctctctgactgcacctggcctaggcctgtgcattgtctaaactgatggccgtggggcaggggacctggagcgcaaagcaggagaggatgctgaagggggcaggtggggccgggacttgggagtgtctggaaggaggaccgcctgcctcaacccagggctggtctgtggaggccagagcgctcagcccctcaatgctaggcctgttgtgagtttctccatgaggtggccctctcagaaagagtggctccacagcagctgagttgggggccccatggcagctgagtcgtggactccatggccgctgatttgggggatgcctgtccttgtagagactgtcacctctaggaatggtgaaagggcggccacccgcagccctgtgtcctctttctagtcctctgtcttgtaagcccggtccccacagtggccccagtcctcccctgccagaaattcgttctcctcagaaatccgttctcctctctgatctttcaggcctagagacaggctcttccctccggagggtgcagcccaggggttctggtaagatacagagcccagcctcaacatagcaggaagtttttccacaaatacacagttcttcaagaccacatgcagctgtgcgtggggtgtgttttgaagggcaatggcaggagcagtgtatgcctcgtggtgcagggagcacgagttgtttataggcgtgcctgggtcctgggtctctgtgcaccctcctctagattcatggggcatctgcccaccgtgagatagataagccagggtgcctgcccctttctcaggtgagatgctgagggccagaaacatgctgctgtgtcccatggaggaggtggcctgccccaactcccctgcaccctagggagagtgcccacaggctgggggctggggctgggtcctgtgccccctccccagccctcggtatgtggctcgctgaggtgtgcgccggaatgttgggcacatcctgtctgataccagcttggctggaagtcgaattatgatcagaatatcacatgatgtgtggcctgggtccccctttggttgacactcttgagtatgggtcctgtgcctgcccggggccaagcagcaggtgcaaccgggcctgccctggggcagcatggggtgtgctagtgtcctggggccactgtaacaaagcaccacaacctgagtggcttaaacaacagaaacatagtctgtcacagttttggaggctggaagtccaagatcaaggtgtcagctgggctgtgctccctccagggctccgagaggatcccccttggcctcttccaggctgtggtggctctggtgttccctgccgtgggccacatcactccagcctctgtctccctcttcacgtgggcctccttctccgtctgtgtctctgtcctctcctcttcttgtaaggacgcctgtcattggattagggcccaccctaatgaccgaatctgcaacttgattacatctgcaaagaccctgcttccaaataaggccacagtcacaggtgttgggggccagactccagtgtgccttttaggggagatacagtgcaatacacagcacacagtgaggtcttccagatccccagacctatcttcttccagaccgccagacaacaccgataagggtgaagttggcttacgagtcctggccaggatgtgacggggagtcgccaggtgggtgccggggaggtgggaagctctgcaggggattggagaaccacacgtcattgcccacatgtgactttaaaccttagcaatgatattggagggggatagttactctttttttttcttctgagacagtgtctcattctgtcatccaggctggtgtgcaatggttctagcgattctcctgcctcagcctcccgagtagctggtattacaggcacctaccatgacactcggctaatttttgtgtttttagttgagacgggttttcaccatgttggccaggctggtttcgaactcctgacctcaagtgatccgcccacctcagcctcccgaagtgctgggattgtaggcaggggatattactctttacagctagggaaacagttgggcttggtgacatgatagagacaccaggtcccttgaggacagggggccatttgcagagccgtgtggtggaaggagcctgaatttggagccccaagctcacagcgtgggtccttgtcacatgtcctgtgagctctgtttgcatccttagctcaggcaagctactgtgttgaactggctggacacagtgtgtctgtctctccctcttccagagaagtcctcacttaaggttgtgtcactgtttttactgatgttggaattggcacttggagatgtgaactttcccaaggccacacacccagatgagtggttagacccggacctgcctaactccagcatatctttttcagggggacacaattaaatccacagcatggactgagttcccctcttctctgccaccatcctgaccttttcctggccagggttaccatgtcggggcaggcatgggggaagtggtaagggaggtatctggacctagtaaaaggctctggtcctcctgcttcctcttgtaaggaccctgtcaatcacatcgggccccctgaataaccaggctaatctcccaccccaaggtccttacctaatcacatctacaaagtccccctcttgccatgtgaagtcacaggttcctgggacttgatgtgaacatctttgcagggaccatgatccagccttccatagaggcagtgacagatggagtagaatataggtcctttgagtatttatttatttaagatggagtctcactctgtcgcccaggctggagtgcaatggcgagatctcagctcactgcagcctctgactcctgggttcaagcgattctcctgcctcagcctcccaagtaactaggattacaggcgcagaccaccaagtgcagctaatttttttgtatttttaatagagatgaggttttaccatgttggccaggctggtctcaaactcttgacctaaggtgatccacccgcctcggcctcccaaagtgctgggataacaggcgtgagccaccgcgcccggcccctgtgagtttttacaagagacactgcagtagagagaatggtagagtcctcaaaccctgattcagtcgttcatgaattcactgagcactcaacgtttcccgcaatgtgtgtcctcttctttgccagcctgctggtgtgctcctggtgcttggtccaccatagatgggtgtgcttggtccaggaggctgatggtgctgacatctgggctgatattcaccgtttttagtgacttgaatgacgtccatgcagaagagctagtgcaccatccttgtgtttgaaaatgcccgggctccagcctgagaacctggtaggccagtaattggagggacagtagcaggatcgagaagccatctgtgtcacgtgttcttggggacaaagaggagacacaggctcaaggaacagcaaggtttgtgggacacagctgtgtctgaaaacgtcaagcagttagctcatccctggctacttcctgtgaacccattaaatccccaggctgaggaggacagagggtgagggaatctgaccccttactcagccctttagccagcggctgctgtgctaagccattctgagaagccaccggtggagaactgacttcaggtcgtgctgactgtgaggccatccagttgtttttgcacattgaaaacaatacattacactttgggaggccgaggtgggtggatcacttgaggtcaggagttcgagaccagcctggccaacatggtgaaaccccgtctctactaaacatacaaaaattagccgggcatggtggtgggcgcctgtaatcccagctacttgggaggctgaggcaggaggatcgcttgaacccaggatgtggtggttgaagtgagccgagattgtgccactgcactccagcctgggggacagagcaagactccttctcaaaaaaaacattgttccggatttgctaataaggaggcaacctcctcagaccttggtgtcacaggagaatggcccgcggcagccttagggccagttgtgattttatccacagtgttggtcagatgcgtcctctgtgcttgtttaatattcattctgcttgcgtgaacaaagccatgtcagtttcagtaacgcttgtgccagggggcacccggtgtggagcagggctcagtaaaactgctgcaaagaatgttccaggctttttgaaattacgtggagttgctggggctctcttgaggctgttaatttacttagggctgctgtgacaaaataccacaaacccagtggtttaaaccaacacaaatctattattttacagttctggaggtcaggagtcccaacatcaaggtggcagcagggccggttccttccggaggctccaggggagaatcccattccttgccttttccaacttgcagaggcacctgcgttccttagtgcctggcctcttcctctgtcttcaaagccatctcccgatctttctctgtctccttcgccacacctcctctggctctggccctcctgcttcctcttgtaaggaccctgtcaatcacattgggccccctgcataatccaggctaatctcccaccccaaggtccttacctaatcacatctgcaaactccctcttgccatgcaaagtcacagtttcctgggacttgatgtggacatctttgcagggaccaagatccagccttccatagagacagtgacagatggagtagaaagtacatcctttgagtttttacaggagacactgcagtagagagaatggtagagtcccgaaaccctgattcattcattcatgaattcaccgagtgttcacggagcacctgcctcagtccaggcgtcatgttgggagcaggggagacagagcaggccatgcatctgtcctttcagagcactgtagacgcaaatcctgtagcacagatgtgccttagactaatagtgcctcgaaaggagaggaaggggaatggatgcggggagtggggaacctgacctgctttgtggggtcatggagtgactctccacctgccgtcatccctccatcccttgtttggggctgttcctccaaaggtgcagtctccagcaggggtgtggggacccctgtgggccgtgaaggcctttctccttttctgctgtgggcattgcatctgttcctgatgggtagagttgtctgtgcccggtggggcccaaggcagtgccatggtggttctttgagtatctcaggtgggaactgagctgccagcaccagaggccaatggcttccagcactccccaaatccacctgcttttggaaggggcctgtctccgaagcaggccgggtcctcctgttgggggaagctttcatggaggcatctgtgtcacttctgcaggggagacagccgctagagggcactgtccttctggcctttcccacatccccgtttccatggcaggtgcatagtaaagcctttctttttctaacgacttaatgatttaatcttcttattttctcagcagacaacgctttggacttccctggatacattgggacgttaccagtcacattaattaatacgagtttcacaacttgggaaccagcgaacgtgcttctccagacttagcttctgcacggccgtttctgctttcctttatgaagtgcgtttctctaagagcctggcagtctcatggggctcgtctgttgctggaagtgagcagcgggttccattgccccccgcctcggtggggctcattgtgcagcttgctggcaagtggctgggctcggaggggcggtgacggtgacacacgccaggggaaaggttggcatcctcttctgagaattgtttcttttgggtttcacaccctgcccccaccttctgctgcctcgaggctcttttcttcttattattagctaatgacagatttcatgaccagtgactgaaatcatttggaagtaccccctgaaagccagcgtgatgggttggagaaatgtgacagacgcagcctctgaaaatcacagaggcagaggcttgcgtcgaaggacttgctaaggaattaggatgagagtggtcaggaggcagtggctgctgggcactggagctgagggtgaggggccgagaaaacgggaggcaaatggggtagctcttttttggggcgggggaggctggctttggggatgtgtatcccactgtgcaccgcaaggtgggggcactgggcggtaggttcccgtgctccggaagggtggcaattgaagggaggaattaaagaagttggccaggtgcggtggttcgtgcctgtaatcccagcactttgggaggccgaggcaggtggatcacttgaaatcaggagttcgagatccacctggccaacatagtgaaacctcatctgtactaaaaatacaaaaattagctgggtgtggtggtgcacacttgtaatcccagctactcaggaggctgaggcaggagaatcgcttgaatctgggaggtggaggttgcagtgagccaagatcgagccactgcactccagcctgggcgacagagcaagagtccgtctcaaaaacaaaaacaaaaacaaaaaacaaaaaacaaaaactgactcatgtggctttcagtctgagaaaccaatcagatcatcattgtctctaaagaatgtgtcctcctttgtagacaagaagctcaccggcccctccatgccccggtttctcgcccaggtgggttagacggccaacctgacattttaccgtgcacctggaagtctttcttcctgttctccttcccacaaaggattcatttttctgtggttctaacattttcctgatcaccccagggacaaaggggaagaaaagaccgtgtttctgggccaagggaatcatctgtttaacatgggcttcggagctttttttacatttctatgtaagcaacttttcgtattcagaagacccagtttccctgagccagatggactccttccatctcggggtggtctgtatttcagattcctgcagcaggtggctggtcggaatgcacaccccaggaggtgaggctggggggatgttggctcctgggctgcttgtactagcaagtccctaattgcggagcggactccttcctcctgagcccatcagcctctacgtggccacatcagggtaattgggttccttgtgaaacacgactgccaggctaatgtaaaccttaatggaaaccctctttttccacccaattaagtggctggaggtgggatgctgtgtgagagccgtcagttcagttccctgactttctcttgtagaaattatctatgtagctccatttggcctacataagcttagcatttgtgttcattcattcattcattccacagatattcagagagcagttatccatgtgctgggttttatgcaggatgtgaggccatggtcatgaatgggacctggcccctgtgcactccttgcggggtcggggggtgcagggagatgagcacagtccacaatcacatgatcggggaatagggtttgtcattgtcatgtgcacggggagctgtggaaacccagaggaggggcccgaactgcacccagggatagaggatgtgcagagtgtgctttccagacggtgggaaatgggtggagctagctgacctgaagtgaagggcattgcaggttgtggggacagtcgagcagaggggcagagatatgacctacagaagtggcctggaatggcctcatcagacgatgagtgtggaagcatggtaactgcagctgtattgatgagaggaggggtctgctcattaacagtcatcgggtaccactatgaaggttttgcgttttaccctggagctggtgggagccatggggtgcactgcagcagggagtgaccaacgccagctttgtgtattggaaggatttctacatcagacaggactctcttggtttgcaaaggacagaaaacccaactcaaaatggcttaaaagcaaaacagaattcactggtacatttgacagaatggtctgtggggttggatggcctcaggtaaggcttgatccagcacatagaaggtgttgctagatcctagattctgttctccccttccccgagctctttcgatctggtgccttcatctccaggctctgtatagtggtaagatgatgggacggcttcaacctccatcctttctgggtcaaggccagtgggaaggagtgcctgtctcattctctattcctggtaaagtctcagtgcagttcattagctctaactgggccatgcccatccctgactgtgttcctgggaggccagtgtgccagctggctttgtcctgggatgcctgctccaccccagagctgaactacaaggcccgagcatggtggcaggaggggtggctctctctgagggaggctgagtcttgtttgcctgaaaggatcaatggatgctggagaagaaaagcaatggtgtccataacagtcacctccagaaggggagaggctgggctggggtgggaagagtttagggcagggcttgcaggggccaaggtggccatcctggtgagaaagccccactggccaatccaagaatagggcacgagatgtgagcctgccaagggtactcccaggtctggcatcttggttctttccgctgcgttcttggcacagacactcatgccagggcctttgctgtcacccatagtctcagagtcatgttattattctgcagtcatctgtggggatgggaccgtgcaggactttccctccccagcttcctccctccttcagggtagctcactgtgtcccccgaggcagccagtgctgccgggagaggcccgagactccttctgggtctcagagccatttctatggttgaacccagtgtgtgtccttccctgtagaattggctgccactttgtttcctttagggtccccactgcaccctgtacataaccctgccaggacatctgtttattttccattcttgtagctttatttttatttcaaaaggagtacaagaacacagtctggtggcagagcctccctctgtctcctccttaccttcagccactgggccttgcatcagtaatgctgctcttgtcattctggagcatgccctttcatttctttttctgtgaattttgatacgtacacatagaaatacatagtggtgagttttctagttgtattttttacataaatatcatgctgtatttattttaaagtgtctcaccatgttgcccaggctggacttgaacccctgggctcgagtgatcctcccaccccagctccaagtagctgggacaacagatgtacaccaccacacccagcctttgctgtattgttctgcaacatggttttctttttctttttctttttctttttaattttttgagacaagatctggctctgtcacccaggctggagtgcagtggcgtgatcttggctcactgcaacctccgcttctcggcttcaaactttcttcccagcctcctgggtagctgggactacagattcacaccaccattcctggctaatttttgtattttgtgtagagatggggttttgccttgttgccccgctggtctcgaactcctgagctcaagccatccacctacctcagcctcccaaagttctgggattataggtgtgagccactgcagctggcccaacctgcttttgcttttttaaaaaatctcaacaccatgctatgtattgcacttaattaattgtgcatcgaatccttcacgagccttctgtgccaggtgcgaggtcggctgctgggtggaagtgaccaggatacgtcttccctcggctacacgcagactctccacggtgcaagggcagggcctgcccagccccatgcccagccctttggcatccatccaccagtgttagttagatcagcaggctgtcatgcccaaggcttgctgccatctgaataggacagggtttcagcagtgagctcttgatgtggagtctgcgccacctgttgaccttctttggatttaccttattgaaatgttcacacatttcttttagcttctcaacttatttcatcttgagaaatgggctggaacctcatgccccagcacaacaagccccataaatcagatgttcaagctgagcgatccttccggtttgggccacagtcacggggctttcttactcctctagtcatgtcagcaccgttcagaaactcatccttggcttagagatgatagtgagttacatgtacataaatacaccgagctcattaccctgggccggcatcctgcatgacaagggcccacatccatttctcggcaaaaacaaactacatctgccacttgaaacgtcaagaagcgctttcttgtatgttgtgctccatggatcactggaagtcctttccctcttttcccatgtccgggccaggaggagcagctgctctctggcactgttagcctttgctgccttttatcctaggcaagacactttgttattcctccgatttgtaatcccaagaaccttggagattggacttggagttcgtaacctcctggggagggccaggcctcacatttcaaggcctttgcacgcgtgatgtgccagcaacagctcagccctttgaattatgatccgcgactccctccaatcaccttccttctggatgtcagaaaagactgcccaacagcatctcctcccagctgccgaggctgatgatgtttttattctgatttagatctcacttaggtcttattttaactccactgagctgcaagatcttcactgaagtacaactggacttatttttagaaaaactgctctgttaagaagaccttcgtgcctgatgaagttagttattctgataaattacagcttctacgaagaaaccacacccctctgagtacggatggaagttggaaaattcatagaaagctgtcatttcctggcagaggcctggaaaacctcatttaacagagatgtctttgggttcctgcttaagcccaagcgaaggatcccgatgccccctccccagctgggaagaggagctggtggcgtgagttggcacagagccgcacctttctttctcctcctgtatcctcccgcaagctctgaagaccactctgtttctttgagcaggatcagttgtaactagaagtgggtaggatttgaaaagggctggttaagtgtttaaaactggggcagctttcctgccattttccagttcttttagatgtgcagggatggagaatggctgtttttgttggggttttctctttgatcctggttcagacggggccctctgaaatttctcgccctgatcttttgttctctatgaaaaccaggaattgcacggatggtgtagaaagtccccgtaggtggcaaagcatctctgctgtgttgaaatgacacacttagaaaagtgtcagaaaatggagttgccattgctctggccccccaggacctgtggctcagcctccattgggcctttgtgtctgggccagaccctccaggcaagcccccagtgaggctcttgggcccgtgattgcaggggcgccttgccatcccccgtgtcctgccctggttctgctagtggagcaagaagctgatcagcctttgtgttttcagatttcttctctccgttaaggtaaccttgttctttaaaccagcttgctttcaaagttgttttcctaataatatcaaaagggggaaaaaaagctgcctgaaaatccttttttgggaaagagcctgggcataaataaataaatacaaccatacaaagaagaagattaaaaaaaaaaaaatcaaagatggaactttcgcatttggcctgaggtataaatggcaggcttctgatgacatgcttttagtttttgattctctttctttccttttatgttcttgtaattccaaatcaggaacgatggtgtttttttttttttttttcttttttcttttttttaaaccttgcccaatctttgggtggaggctttggaagccgcacatattccaccattatagttactcaaagctgacgcttcccgaggggtggctgcatgctggcgactgtgccgagggtgtgtgtccctgaatctttgtgatctctctgaggtgtgttaggccccactttacagatggaaactgagacacacagagccgtcaagcagcttgcccaaggtcacacaccttgtcagtggtcaagctgggatccaaaaccagcagcctggctctgggattctaagctctctgttgtgctgctccttgaatatattaaaaggcctactatgtgcaggaactgggttggcactggcaggaaggcaagttcgggaaggagatagttacatggctgtgtggcttcagctggggagaggggaacacccaggagggcttcttggaggaggcggccagtaagatgaggttgaagataggtaggatttagtagggcacagtgaggtgcaagatcaggtagaactggctttagtcctgactctggggcttcacatctaacagcacaggaccagccactccctcacagacttgtttatttattattattgttattatttttgagacagacggagtctcgctgtgttgcccaggctggagtgaagtggcacaaccttagctcactgcaacctccacctcccaggttcaagcaattctcatgcctcagccgcccaagtagctgggattgcaggcgcccactgccacgcctgactaatgtttgtatttttagtagagacagggtttcatcatgttggtcaggctggtctcgaagtcctgacctcaggtgatttgcccaccttggcctcccagagtgctggaattacaggtttgagccaccgtgcccggcctccctcagacttgttaggagacaaggtgaatggctggcatggaagatgccctgcacatagtaggtgctcaggaaacgttagtggtgctctccccctttccaatggacagtcagcaatatgggttggacaagtatgttctgtaatccgaggttgtgtgccctctggctggcccacaaaatttgaattaatggctcgtatttataaatggggagattccacaccaaaccccacatttccagcttttcttgaaaactcagatctggtgactgcagcctgcacttcccactctgccatcccgggctgagcgaggagtgcccgtctccagagacagtgtgccaaggggccctcctcctatcaaatgccctcctgtctctctcttcctacctggccccccgtgcaggccacagagcgtggtgctgcaggtgaactctgctgcggtgggaacgagttggcatcgactccctcgtggctggctgctgggtttcgtgtggacagagacattcatcttagaacaatgcagacacttaggaaaacaagcacaaggcggtctttttcccttaatcacccatctcatgaaatcaagccccagtcccttggaagctcacaccctccacaccctccagacactgagagaatgcatgccagcatgcctgtgccagcgcgcctgtgccagcacacccgggccagcacacccgggccagcagatctttctctgtgactgaagacagccggcacttcacatctttgaagggtttgtctttctggcaagtagaccggtactttaaaaaccaaaacattcctgggattcactgaaagccagtaaactggcaccgttcaggtggcgggggggtcgggggaggggggaagccaagggtgtgagaggagcccctccttccaaaaatcacaccgatcctctgaaggtgacgatcagatccaggctgcaagttcttctgcaaaggagctgtgtccataagggaacccaggctgcaaaatatagcaaggcccagaagggcatccctcaaaccttcatggggttcagctttggacatgctggctgtggtttgtctccactgcactctgcaaagagccccgaaggccctttccttagcctggccatatttcaaggccagttcaattgctgcctcctccaggaagccctccatgcttctctgtggaataggggacctcgcctgccttgtggtcactcttcctccagtctgtgtctctcttggagcctaatcacagagaccctgtacatccacagctgcctctcccacttgcagggagtagtttgtgggccatgtgtgggtgctcacggttccccttattcctcaggaaatgtgaggaagttcctgtgaggccggtattcccaccaccccatgttacagatggggaaactgaggcttagtgcggtgaggggacttccccgaagccacacaccaacaagtggcaatgcgagatttggactggggctctgtggccacaggcctgggctcctcctgccaaccgaggggtctgccagcctgtgcccccctcctcctggtccccgaagcctttgcttccctcaggccatcgtgcataaccagccccttcagaatgcgctgctgagcagtccctgggcggtgttcgtgagcacgtttctcatttattaaggtcacaaaatccctggccctgtttagtgtcatctttgatgttcaagggcggtgtggaaatctctgttttgatatgacccaatttctaggctttcaaaatgtggcttctctcctcctccctctctgtgtttttgaaatcaggtgagcagggctgcctcgaagcgttgaccacttgccccgaggtctccctccccacccctcaggcccaggcacatgggtgcagtgccagctctcgggccttgccaagaggactctcgggcgtagcccacctgtgtaatcctccacacatagggaaactgggtcttttgttcttcctctgccatcagcgtgagcactgcaggcagctgtgctggacgggacctccctgcccctgttgtgtcctcctatgatgccagccaggacatggaacttccaccccgaccccctgtgctccagggctatcatattcccaaggatttctgtgaaaaatcacttttccctgtttcctttctgccttttaagactctctgctggttacaactctctttgtaactcgtcatgtggtacaaatacttgctgaaatttggtccctgttttctcagctgatctgggtgacctgtgggggttcttctggattatttttagagaggtggggcagagggagtctcaaaactctatgtctgtatcatttccctgtgaaggtatttaacatttgtccactgctggtgtagcgttatgctaaggattttggaaattcaaggatgagtggtgcctggatcttcccttaggatgctggctgtgggtggaggacagtgtgtgcggcagccaggctggctcgcggctggaatgtgggttacctggagagggcctgctttttttttttttttttttttgctatttaaaaaaattgttgtaaaataggcataacgtaaactttaccatcttagccattttcaagagcagagttcactggtattaagtacgttctcattgtgcagccatcaccaccacccacccacagaactctttcatctttccaaaccgaaactctgccatcattcaacactacctctctatttgctacttcccccgcccctggcatccaccagactgctttctcctctatgcattcgcctactcgagggacctcctactggtggaattgtacagtgtttgactttctgtgtctggcttatttcactgagcagaacattctcaaggttcacccatgcggtagcctggtccgaatgtccttcctttttagggctagataatattccgttgtatacgtggactaccttttgcttactcattcatctggtgttctcaaatgccaagactcagtgactgcagcagtgcccgaaggttccctcgaatcaaagaacttcctaaccccaacctgtacctaggctctgatactcctgcatcaggcagtcctctaggataaggtgcctgtttaaaatgcaaatatattaccttcgggggagtgggtaactggcatcctggggccccgctgccattgtccttatgagggagggaggttgtgttgtcctggaagtcgggtccacggtcacgtcctgagagtcccatcacgtgccatgctctgggctggggacttgatgttcattgtttggttacatttagcccttccaaagaccctggcatttttgcagtgttacctataaattccatgtgcggaaacatgggttatttccactcttttttttgagatggagtctcgctctgtcaccaggctggagtgcactggtgtgatcttggctcactgcaacctccgcctcctgggttcaagcaattctcccacctcagcctcctgagtagctgggactacaggcgcacgccaccacgcccagctaatttttgtatttttagtagagacaaggttccaccatgttggccaggatggtctcgatctcttgacctcgtgatccacctgcctcagcctcccaaagtgctgggattacaggtgtgagccaccgcacccgacctgggttatttctacttttgggctattttgagtcctgcagctatgaaaatgggaataaaagagggtccgctttttaagaagctgaatatcggcctttgctgacatgagaggagctggcatccttgggccctgctgccattgtccttatgaaggatggaggttgtgtcgtcctgaaggctgggtccacagacgtgtcccaagagcccatcatgtgccatgctctggactggacgctcaacattcatggttacattcagcccttccaaaggccctggcatttttacagtgttacctataaatgccatatggagaaataggtgcagagaggtgagtgggatgtacctggggtctcacggccagcatgagtggggccctgttggcctgctgctccaaagccatcatgccacacccccttgctgttccatcatctgccgctgtggaggctggatgtccagagctagaggtgttcaaggttcaaggtgattctggtgttaaaagaggaaataccattttacttctgaacctgtttcatggagaaagaggtacagctccgggcacactggcctgggtacctttgcagcatgtgatcagggactgctccccagcggccctccaccagtgccatgaaagtggccagggccctacctgcacccggcaccatggatgcatcttggggctggaacctcgagtcttacatgcagcagaggctgaggctgtgactgtggagaaagcgtgacattacagaagcaagggttttggcacctggtgtctgtgtgggtgggtattcctccctggtggatgtggctgaaaggcctgcagggtctcactggtgcagggagatgaggggtcatttctggttctgggattgtccctaatcactgggcgttccagatcctgtaactgttcagcactcccttgagacaggaggtcatggtgtttctgacttggagcctctggctctctttattagattctgttgcatgttccagccatcctgacccgggtgttccatcagatttctgtgcctgtgaatgtggccatcaccagtgaccccactttaaactccagattcacctgtatgcatgaccggagggggttagcatcttgagtccgtggttcaggacgcagccccccggcagagggaaggcagccccactctctcatgccccatcgctgtggtccatgctttgtctgcctcagcagtcttggtcagatctggaagcatctggaggcatctggaagctttggtgtcttagttatgagtttcaaagggcagtgaaaacagactggcagagctcagcgagacctgggaaatatttggggtggggaggaactgcagaatgtattcttggttcagagcatttttccctctgactctttctgggcaacagaccttttaggaatgtttgttaaatgctgaaaaaaacaggaattgatttctctctgcgtccacagccaacatgtgaggccacggcactccgtgtatactaacctggtttttctttccttttgctcaacagtgagtgacctgcaggaagaaggcaagaatgccatcaactcaccgatgtcccccgccctggtggatgttcaccctgaagacacccagcttggtacgggggttcctccgctccctgccctgagacagttgagcttccgtggcactaagttggtcttggggaggccaatgaggagcccgatagatctggcctcttgatcagatgctgggggcatttgggagtctaagttcttagctcaaggtcatctttagaaaagtccattgggaaaagcaagtccttcattaagggtttctgccctagtcttaaaacgtaagttttatttttcaggtggtgaagcaaacagattgggagaagactgacttgaaaagatagtttgttaaactcatagttctgaaaggaggtgtagcaggccactcagggccatgccatgccacgccatgccacgccacgccacaccatgccaagccacgccacaccatagcacaccatgccacagaaggccacatggaaagcactagtgtgaggcagaggcagaaggagcagggctaatgcctttatttgatattttatgtatatattttttgagatagagtctcactctgttacccaagctggggtgcggtgatatgatcacagctcatggcagcctttaccgtccaggttcaagtgatcctcctgccttagcctcctgagtagctgggactacaggcatgtgccaccccgcccacctaactttttaatttatttgtagagatggggtcttgccatgttgctcagactggtctccaactcctgggctcaagcagttctcctgcctcggtttcccaaagtgcagggactacagatatgagccactgcgcctggccccaacacccttactgtggctttctctgaaggaatgggcaaggctgggtgaacaggcctaggcctggcttgttggaatcgtttcactgggctttgcggtgcaggagctgtcctgagtcttctcagtaagaagactcttcttcttccacaccacgtggcgtggcgtggtatggtgtggcgtggcgtggcatgtccccagggccaggggagattagggtgaggatattggctgggagtgtaggagccccgtgagagcccaaggaaagaggtggctggggactctgggctctgcggctcaggctctgagtggttttcatatgaaaggtgtgctcacagagggtggtttaccatctctaggaattagcttgccctggaggtgcaatctctccagagtcagcaaggccccgagatgccaagcaccagaaaatacagaaaacagggcgggcacggtggctcacacctgtaatcccagcactttggaaggccaaagtggacggatcacttgagttcaggagtttgagatcagcctggccaacatggcgaaaccgcgtctctcctaagaatacaaaaattagccgagtgtggctagcctgtaattccagctactctggaggctgaggcaggagaatcgcttgaacccgggattgggatgttgcagtgagccgagatcgcaccactgcactccaacctgggtgacagagcgagacatctcaaagtaaaaaaaaaaaaaagaaaaaaagaaaatgcaaaacacaattaatatgcttcttccctttgggccagccagagctgcccgcggcctgggcttgcagggtgggctctgccaagtggcccaggcccctgcgctcactgcctgatgtaatgggtaacagccaagacacattttccttaaagtgtgttttgggatctagctgatctggaaggcatttatggaacattctgcgtatttccaaaccctggttcgaagggaagtcccggttcatcccttttttgtggtttccgtgacgaggccaggccagcaagagcttatggagaagaaacgccgatgcaagttcagccgccaaccgacccgaagccagagctggtgatgctgcctgaggtcgcaccagggtccacggggctttctctccctccgcttagaagagagtggccccaccaggctcggtggctcaggcctgtaatctcggcactttgggaggctgtggcaggtggatcacctgacgtcaggagttcgaaaccagcctggccaacatggcaaaaccctgtctctactaaaaaatacaaaaattggctgagtgtggtggcaaacacctgaaatccccgctacctgggaggctaagtcaggagaatcgcttgaatccaggaggcggaggttgcagtgagccgaggttgcaccactgcgctccagcctgggcaacaagaatgaaactccatctcataaaataataaaataaaataattagccaggcatggtggcacacgcctatagtcccagctactcaggaggctgaggtgggaggattgcctgagtctgaagaagttgaggctacagtgagccaagatcacaccactgcactctagcctgggtaacagagtgagaccttgtctcaaaaaataataataattgaactcactcactgaatatttgcacagcacctgattctttctgaagtcctctttgtatatttcatatcctttgggctcataaatgtcatcattgtagcgaatattgggggtccactgtgaatgcttctactcctcagtcccttcagtgaccctgtgaggtgggttgtatcattatccccattgtacagatggggaagctgaggcacagatctaagatcacagagatcactagtaagtgccaaagtcttgaaccccgggcattttgcccccagagctaggctcctccccctgctctagaccctctcagtgaagatggtggccctcatcagaggtgagtaggacaggtccctgtccttgggcacgttttattgcagctggctatgacgcacaaggtggggagggcgggggctcggttcccacaaaacactggcacagagataccaccctggcctctgggcactgcttctcctctgactgaagtggagagaaacctgaaccaggcccacctagcctgtgtggacccagacctgctgaagattctgagcccatgtctgaccccccggcaccccctggatggagcagcgcttgctgtacccactgtggtgtcccgggactgtgggctcctcgaggggtcctgcctcagtcttggagccaccgagaggagcatggcacagtttagcgaccactaaagtcacacagctcagagatggcatggcggctggtgtctgctctcagcttccttttaggaaaaacaaggagcctctcacagcccttttcttctctcccagagtccctggagtcctgttcctcaatgcaggatgtcagaaagtcccagggcacttggcagtgagggttcctggccacccgaagacctaccaaatgggagtatgcgggcccaggcccctctgctttaaacatgcctgcagtgactccggggcccactgaggtttgggaattgctcccctctaggccgcgtgagcagcccgtagcagactgagggccatgatgtgcagtggcctgcgggggtttcatgtccagggtccccggtcaaggctagcaggtcatgaatgctgacaggcagcaagggctgactgtgagctctggagcccccagatacagaggtgtttctcatctggagcaagcgcctgctctgaatcaggcccctgccccgtgagacgcagctgctccctggtctgtgcagagcctctgattctggcctactgtcaccatcaccaggtgaccaggagatcccggcgggatctgcagacatggacacactgccacacatagctgcctgcctggggcctgctgtccaccctctcaggcccactgttcccctctaggcggggtcaggaatgaaagctaccccacggggacaggtaaagaccggagatgcctctgagaaagtgtttggtaacagtaagcctcgaaacggcatctctgtcctccacctttcacagtctctgggtcagacgccccattcctctcagtggtcccgccgactgaggcaggacccctcaagaagcacacagtcctgggacatccgagccaccatggcatgctgcccagtctggggtcagacgtgggctcagagccttcaggagggagcagcgagttccctgtgggggccacatgagctgggcgggcccgaatcttgcttctcctcagttcagcgagagcaaggtgtggggacatgctagatagggcaatgctgagatttttagtgtgggttgaaggggatgtttccagaaacgggctctctgaaggctgggattgggtagtgacctgctcactctccgtcctgcaccccctctcatacacgtgtggactcacggcctggccctgctccttgcccgcctgagatgggtggtccagagggggtctcagacatgggtcacacaggcacacaaagtcctctttggggctggagagcttggaagatttggcattcgggctcaaggatctcagctggggagctgaggtctgaagggtgaaggaaacatgggccagggagagagtgtcagacagcgggagcaggtgccaaggctcagggcaggtggcagcaaggcttcaaggagtgagggaaggccggatgggctggagcagattgcaccaggagggcaggaaatgaggcgggagaggggccttggaggccacatggaggacgccggccttgatcccagcaggagtgggaggctgcggaggcctttgcagagatatcatcaggactcccgagaactccctgcacattacctggagtgtccttttcaggcatcagatctgtatgacttcaaaattagtttctccatgttgtcagagtttacactctgctgccgggaagttgcatcacatccgtgtcagcagcaaagtttcactcaaagccattttctttctttcttttgtattttattttattttattattttatttatttttaaaaatagagacagggatttcactatgtagcccaggttggtctggaactcctgggctcaagcaatcctcccgcctcagcctcccaaagtgctgggattgtaggcaggagccacttacgctcagcttcaaagctgttttcattctgaccgacatggtcagtgtccccagccccatgggagcctgtctgggctctgggaccctggtctcaactgtgtcctggccatctccacttgtatgtcctgggggtaactggcttctgcctggagcccctcttgtgccttttttcctctttaagagagaggtgtggtatagagcctcccggtgagtggagcctgggccccacccgacccatgctctgtgcaggtcccggagctggacagtgtggcagcctgagacccccttgcccttccctgtgtgtgttcagaggtgctcggcgcccgctggcttctgtgtggtgctgggcatttctgctgtggagcacgcctagccttggtgggtgccccctccgcagtcccgcctccccactgtctccacggcactgtcctccatgacgggctcagctggctgcctggtgtctgtgggatccaggctgaaacgtggagggaaagcaaacaggtagagaaatagaaagagggtgaggctgaacacgttttgctgttacacatcatccccccccacctttttttttgctatttatttctcaatattttttctgcatgttattttacatacaacattgcatattgattcttttccatggaatgtaccaaacattttccatttcattataaccatccagactcttcaaatgtatttataaatagtggccacagggaactacctggtgcctgaagctttcccacataccagattccggccagcggaggcatctcatgccctgtgaatgctgctctctccttatttctcctgaaaaatggaaatggtttggaccagctgctggcggagtctgggaggagcgaggccgggcagaatgatgagtttgacttcatccctttccagaagaggggaaggcgggaggatgccccatccaccttccagaaggcggttccttgcagtcaccctcccctagtgctgggttctctgcttctccatttgtcagagatgagttggcctccccctggttccccgtgtccctgccacccccacaatcgctgaccgtgacttccttttgtccctggcagaggagaacgaggagcgcacgatgattgaccccacttccaaggaagaccccaagttcaaggaactggtcaaggtaaggagctccgtcttggttggaatcttcctcttagggcgaggacttggctttggggttcagggctctcatggacaaagggagctaaacccggggctcctgaaagggatgttggtgctgcatgagaaggtgggcagacatgttggcagaggaggacggcagagaggatccagcccgaagtgccaagcgcctcccatgtgccctgctcggctggggctttaacgaccagtcttgtgaactctttgctggacagagctcggcaggaggggattttaggattaggaatgagtgctggcgtgagctagtgtagtaccttacagatggagttggaactccgtctggagcctggtggggtctagattcagatttaaccctgaaaagcaggaggggtcaccctggccactcctggccaggagccatctgatgccgatgcctgcgctgagtggacagtcagtttccaccacgtctggaggcgtgaatcccagctgggcgaggaacctggctgccccgctcccagaagtcagggaacagtgagggaaggggcccatggtgctggccttcttgggcagcggctgtccttctccagcgtggctcctgctcaccgtgaggcagtgcttgtgtgggtccaaggacagattgcagttttggttgctctgatcgaaaccacggtagggcttgagagagaatcccctgaagaggagaggctgtgggctctgcctgaccttggtgaacccagggtgggctcttgggcacacggctgtggcagacacttggcttccatagcccacggcgagcttgggcaccccgggattcttgaaaatgccgatggtgacagtgtctgccagaaacagacatttttctattaaaagtgctttttaaaaagcttctccaccttcaccaccacagtggacccaatgctgggctgtacaactgtgttttcatgagggctcattcagaataagtaagacggcttgcaagttatgttcttttaaaatctacattgaggctgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgaggtggcgggcacctgtagtcccagctactcaaaaggctgaggcaggagaatggcatgaaccccggggggcggagcctgcagtgagccgagatcgcgccactgcactccaacctgggcgacagcgaggctccgtctcaaaaaaaaataaaaaataaaaaataaaatataaaataaaataaaataaaatctacattgagaccgggcgcagtggctcatgcctgtaatcccagtactttgggaggccaaggcaggtggatcacctgaggtgaggagttcgagaccagcctggtcaacatggtgaaaccctgtctctactaaaaatacaaaaaatttgccgggcatggtggtgggtgcctataatcctacctactcgggaggctgaggcagaattgcttgaacctgagaggcagatgttgcgttgagccgagatctcgccactgcactccagcctgggcaccaagagtaaaactccatctcacagaaaaaaaaaaaaaagaaattccaaatgtcagttttagggtccacccaaagatgttgattattaataacttaaattatttaatttgttttattttttccctctgaatacccactttgttatttcaaacagaagaacgttgatgaggaaagtcactgtcttttagccacgaaaatgttgttcttgggggatatttaagcaagggatgcatgagaattatcaggcttctacaaagaaacagacccaattgtgtcaatatctagagagaggtttattatgatattggctcacttgactacggaggctgagaagtcccccgacctgccatctgcaagctagaaagctggagggccagtggtagagatgccagcctgcgtctgcagccctgagtaccgggaacagggtgggagaagatccaggtgctggcactagcagtccccggcagagagaggtgaatcccaacttcctccacctttttgttctatgggatcagatgaggcccacccgctttggggagggctgtctgctttactctatccaccaattcaaatgctcatctcctctgaacaccattccagacacacccagaaacaatgtttcattggctatctgggcaccccagagcccaggcaagttgacacagaagatgaaccatcccatgcacctttctaaagatttttttctttgatttttgagcaatgcttgagagttcacaaactccattcacaggattatctccttgaaacaacaccctggggagctgtgtcattcttgcttccatgtggagactcagagagaggtgaaggggctgggcgccatggctcacacctgaaatcccagcgccctgggaggccaaggttggggggaatcacttgagcccaggagttcaagaccagcctgggcaacatggtgaaaccctgtctctaccaaaaaaaaaaaaattaactgggtgtggtgggaggcacctgtaatcctagctatgcaggaggctgaggtgggaggattgcttgagccccggaggtcaagggtgcaatgagctaagattatgcctgtgaatagccactgcactctagcctgggtgacagagcaagaccctgtctcaaaaaaaaagacaggtttaagtaactccccacccccaggtgctggggttagtgatgtgtctgggcttgaatggctctgtccatttggtgctgtgttcactgagccaagttgagtgcgtgtggggtcctgtgctgggccctgggattcggggatggataagtgacttccctgctatgcaggatttgatttatgttcctcctggatgtctgcagtgccacccacccctgcctttgctgctttgctgccaaagacccccaggctgttttggccttggtggggcgagggctggctgctgcatgtcttccaggtttcagattgagaagaaggccacattgaggggcatggggtggactgatgggaaagctaattagcatcctttggggcaaagtacaactatggggcaaaatacaactaagaacaggaaggagctgaggaataaatgcctctccccgacttccctgatgtgggcttctgagaccatggctcatggagatgggctgcatggctgatcatcagctgggttttcttctgaagccatagccagctcatgcacctgcctcacctcccttcccctccctgttgctcgtctagggtgccctcccctcacccccaaacccctgccaaagaaaaggcatcagcagtgagctttgtcctggctctgtttttcagggaacctgggccagaatcatggtccccaaagatgaccatgtgataatccctggagccattgactatcatcttacatggcaaagggacatggtgggtgtagttagtgaccttgcaatgaggaggtcatcctggatgatccaggcgggcccagtgtgttcgctagtgtctgtataagagggacatggggagctttgactgcccatgaacatggcagcttgaccctggaggcaaggtggtagcttctggctctgaagatggaagaaggggccatgcactaatggatgcaggcggcctctgcctctagaagtggaaaagacaaagaaatggattctccactagagaacccagaaggaaccctggagcctccagaaggaaccagccctgctgacacctggattttagcccagtggaacagattttggactttgacctctaggactgcaagagaatccactgagccgttggaagcccctgggtttgtgttaatttgttacagtagccacaagcaactaacaccatcctgttctccaggctgctgcctccagctgcagctggcgtgccctggccactggggccaggcagggtgggttttgatacctgcagcggcagcatccttggccatttcctggaagggccagttgccagacactgagatgcctgttactgcaactgtcccaccagcctggagcacgtgtttctggagacaggcaaattctggaaggctccacctgctctcagactgcaggttgcgtctcaaagcaggctggcagacattttccactcttgatcaatcattttccaaaataagcatagacacagcaacccggagagcagcttcggtttggctgtcggtggcgtgttagttactgtagtggtggcacagaggcgatatacgttaaatattagttctcactgactatagccttttaaacagagcagcgtgtgggtggcagcaggtgagttggctatactgagcttgggctgcccttggttgattcttgtttgtcaggcatgcagggggctctctgtgcgtccaggcatattccctgtctggatttgcttgtgttcatggattttcagcacctcctttcttctggtttgggaatgagtcaggtcctcactacacaaggccagagcagtatgcgtgtgtgggtaggggtgagcaggtgtcattccctgcctcccctcctccttcactgccccagccaccctgaccaccttgctgttctgaggacacactgagccagtgcccactgggcatcaggtgaaaggggacatcccacaagcccaccctcacttctgacaccaatggcaagttcaggatctccaacactgccctgaggtttggtcatttgctagagggactcccagaacccacttaaagctgtcaccctcacagttacagtttctgatggtgaagggatacacatgaaaatcagccgagggaagagttgcccagggcagagttgaacgcacccacacagcacctccattgtcctttcaccatggggtcataggcagcgttactctcccggtgatgtgggacaatgcgcatgcagtattgccagccggggaggtcatctgagcctccgtgtccagagtttctgctggagctcacttgcatgggtgtggctgactgtccacatggctcatctgtctccagcccctccagcagctggctgatagagtgcaacccaaagccccctccctgaatgacatagttactccctggctggcccgagggccccaggtaagcagaggtactttatctggcagggcatttcggagcttaggagatcacctcccaggggctgaggtcacaggcccaacctctctgtgggcaaggttaggttcattatcacgtacctggtctttggactttcaaaggcccatgcctggagctgtcttcaacacttctttcagttttctctcaatgcttcctccttggagacgtatttcctgcccctgtcactccatcactctcctcctaaccccagttactttttctttgctgggcttgctgctgcctggagtcatttcctatttactagtttgtttttggtctttctcctcccctagaatgtaatcttatgctgtgagggaccatgaccattctcttcccagctaaatccccagggctggagttgtgctgcacatgcagagctaattcatccttgatagatagtaagagaaccgatgggggtctgtgtcagcagcaccaacatgaggttcacaccagcgtctcccaagatggcatgcggcttagagacaagacagatgtggttgctttttgttgttgttgttttgtgttgttgttttgagatagggtcttactctatcactctatcacccaggctggagtgcagtggcatgatctcagcttactgcaacctctgcctcccaggctcaagtgagtctcctgcctcagcctcccaagtaaatgggattataggtatgcaccatgatgcccggctaattttttgtatttttagtagagagggggcttcaccatgttggccaggctggtctcaaactcctgacctcaagtgatctgcctgtcttggcctcccaaagagctgggcttacaggcgtgagccattgcatgcccagccagatgtgtttttttttttttttttttttttttttgctctaccccaaacctgtgagatggcagggaggaggctctgggaagagggggtgagggttggggtaaacctgtggattggatgctgatgtaggtggtcccaggtgctcccttgggaggagatggacagtccggatggtgcagacaaaacacctccatccacattacctgcgtaattctctttgctttccagaacatcctttgtgtactgtggactgtgatgatctaatgctagtggattacatctaagtaggccttagtagaagccacctcccagtggttcctcggaggcatttggtccagaagcagatgattttagtgcaaagcacagaccgtatgcaggcctgagcagatcaggggacagacagatctggctgacatcctgatccgctggctgtggtggtgtggccattgcttgtagccacattgcagtcttgaatgtcccccttggaaatgggggacatttccaaggatgcctgcctggtcctctagttttctctttctctgttctctgtcatctgcacttttttcctcttgtcttgattgcttgtcctgtctcccctagtagacaccccctctgacctctgctgcctcaggactgttgctgtataaaatattgtgagatgccctctgctcctgtttaaaaaaaaaaaaaatccttagctctgggtaagctaggcactgagaatgaggccagtcattcaaaacttgtctctgagcattgattatactcatgtattatactgttaaggggtgaaggtcggctctagggtcagcttcctggatttaaatcccaactcagattaaagtgggagaataatagcaccaacgtgacaacctcaaagtgtcatttgtaaggataatgttagatcatacacttgatcacccgttagcagtgtaagggcagtgtgggaacatgagcatgaacagggcagcccagaagggagttgaatggacagatgggcaatgccagtttggaagtgggtgcatgcatccggtgggttcaggagcctggaagacttatccaaaagtcatctttgctggtgtttcttcctgtgtattttctctaaccttctccagcagtgacctgaattacttatgggtgaacactgaatgctgcccaggcaactagaggtttatagatgagatactttaaatttttaatgattcttaaaagagggagtggctattcttatgctttccagaatgaatagccaagggaaacctgtacagttgccatataaggagaaacctagacctggccttagcctctaggtcctggtgcagattcttagcacgtagcgcctaaaacctttgcgatttcctgagtgataggagcgtcttttgttattcataatgagatctgggtttatgctaacgaggtgactcagggtgggggctggccccagagtaaccaacacaggattagagggttgggtctatcagtcctacccacccccagcctctgggtggggtggagaggggctggagagtgaatcaaatcaccaatagccaatgatgtaatcagtcacacttacataatgaatcctccgcaaaacccatcaacagtggggttcagagagctttggcgctgggaaacacacatggaggtgctggagggggacacgcagggagagggcatggaagccccgcctccctccccgaaaactctgtcctgtgcagtgtttcttattaattacactgtccctgagttctttttttttttttgagacggagtctcacactgtcggccaggctacagtgcagtggtgcaatctcagctcactgcaacctctgcctcccgggttcaagcgattctcctgcctcagcctcccaagtagctgggattacaggcgcccgccactacgcccagctaattttttgtattttagtagagatggggtttgaccatattgccctggctggttgcgaactcctgagctcaggcaatctgcctgcctcagcctcccaaagtactgggattacaggcatgagccaccaccacgcctggcctgctgtgcctgagttctaacctttatagtaagttggtaatcctcagtaaaatgcttttctgagctctgtgtgttctgccaaatcactgaacctgaggtgagggccctgatttgtaatcagtgggaagaggctcaagtagcctgggagccccatctgcagctggtgtctggaatgaagtcaatttggtgggactgagccctcagcctgtggggtcaactgtagctagtgttagaatcagactgaactctaggacaccccattggtatcagataatcagagaattgctgttggaattttcatgtgcgtccgtgtgaagagaccaccaaacaggctttgtgtgagcaacatggctgtttatttcacctgggtgcaggcgggctgagtccgaaaagacagtcagcgaagggagataggggtggggccgttttataggatttgggaaggtaatggaaaattacagtcaaagggggttgttctctggtgggcaggggtggatctcacaaagtacattctcaagggtggggagaattacaaagaaccttcttaagggtgggggagattacaaagtatattgatcagttagggtggggcaggaacaaatcacaatgctggaatgtcatcagttaaggctgtttttacttcttttgtggatcttcagttaatttaggccatctggatgtatacgtgcaagtcacaggggatgcgatggcctggcctgggctcagaggcctgacaggaatgacacgttgggtgtcagaaaaaaaacacagaaaactccctaagcagattggttgaaagcaggctgactgcatgtcatctgggggtgcgtctccccccaagagcaggtttcacatctcattccccggttgattggacaagacccttcctgtctttaagttctgttttcttcctccctttgtctctccgaagaaaatcagctgcatgaaaacgatcctctgggcagaaattggtgctgttggagccgcacagaggtgccctcccgtgccccctggcccccaccgggccgtgtctcctcctgcctgttgcaatcagccctcgtccgactctttttggaagtgattaaaacataactgtcatagctctgggggagacaggctgcagatcctgattataattcagaaggatctaaagaaaaagtaattttttaaaaaaattctggttaaagccaaagctcataagacgtgtgtgatggagtggtatgcaagagcacaattaatgtatgtcctagacatctgcccacaggattcagggctggcaaatgagtgcgtccctaaaaataatgactagtgctatctttaaaaagtcttttgtggcatagcagattaagatggatggcctgggaagtacagtggcagcgtgtgctgtggtatccaggaataagttgtacctcctcggggtggcagtggaactgggccgtgaacagcttttgcttcccagagaggactgccatggcctgctgcatggaatttgattttaatctgtttgttatttttgggtttggtcttggactgggtttgaaatccagatgtgacttttttttttcttttttcagttttctttatagcagcaatgttgtatcttgtgtgtttcctaacaagactgagctctgagcaaggcagcctctggaaccaaatgtctgcaggcccaggagacctttctagaaagttcataggtgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaagaaagttcataggcggttctgcagtttgagccccttctgtgggtctgtgcctgctttagccgcttgagatatggcattgaacaaaacacaggccccgcctgggagaagctgccaggccagctggggagacagacctgataagtgaaaatgagatcgcgtggcctgcatgctccgaagaagactaaggcaggaaacaggactattttctcccgactgaattgtcctggtatccttgttaatatcagttgactgtgacttgagacttatcttggacacccctttctgttccgtgggtctgtgtctgccttgatgtcagtcccacagtttcgacgactggagctttgtagtcaggtgtgaaacagtggagtgtgggtcctccagttttgttcatctttttcagattgttttggcaatccaggagtcctttgaatttacatatgcattttattttattttaattattaatattattattattttttagatggagtcttgctctgttgctggagtgcactggtgcaatctcggctcactgcaacctctgcctcccaggttccagagattctcctgcctcagcctctcgagtagctggaattacaggcatgcaccaccatgcccagctaatttttgtattttcagtagagacagggtttcaccatgttggccaggctggtctcaatctcctgaccttaagtgatccaccagcctcggcctcccagagtgctgggattacaggcgtgagccattgcgcccggcctatatatgcatttaagacctgcttgtcaagttctttagaagccatctggatagtgattaatttgtaaaaatgatacttattatctttttgaactgccaaagtaatatatgctgctgaaaacctggaagacagaaaaatccaatagaaggcagggctaattttttttttttttccatgtatgtcccttcaggcttctctgtgtttttcatttttcctacacaaatttggaatcattccagagctagtaagcatctagggccacatttggactagtaccttgggataaattagagctggaattgccgggtcatatagtgtgcacagggctagggactgacttattttcctttctgaatgaagactctgaggtctagagaggttaaatgagtgactcaaggtcacacagctaaaactctggtggagctgggtcttaatgcagaccctacatattcatgccatgctgtatttatacaggcatgtacaccagcgggtcgggattttagggggtgttttaaaattctgcctgcaaaacctttttttttttttttttttttttttttttttttttgagacagggtcttgctctgttgcccaggctggagtgcagtgtcaccatcacagctcactgcagcttcctcccaggctcaagcaatcctcctgcctcagacccctgagtagctgggactacaggtgtgcactgccccacctggctaatttttaattttttttgtagagatggggtctcattttgttgcccagggtagtctcaaactcctgggctcaaacactcatcctgcatcagcctcccaaagtgctaggattgcaggtgtgagccgctgccccaggcaaacccattttaaagccatgagccaaaaattataaaagacatgcaaaatattatgagtagtcacttatctagtatttgcggcatctctcaggcttggggctttgctgggagctctgagggggtggaagaggctctgtcactggccttacctggctgtcaagggctgagtgtttggtggagggaagacgtctgcagcctgggaggctgcgggtcagaaggaggtcagccggggagctgggaggatcgtggggaacccgtggtggaaatcagcatggcgagagagtggaagcaggcagaggagggctttgaagaccaaaaagggtagttaggattgctgctctgtgtgtctgtaaacttggtgttgtctctcgaatttaaatgacatgctttgaaaacaaaaaaacaaacaaaaaccaaacccataaaatctcactaagtggccagagcaagttcccggggggtggcgcatagatgcagcggtctgggttctgtggctgggggagttggcttggggtccgtggctgggtcagtcttcaagagccaccctgggtggcactccaggtctcttggtctggggggaataccctgaccccagcggtttcacggcctcctccccactcagcctgggggagagtccagggtcggccctgtccccctccccccactcctgtcactatcagtcccctgtgctcagcttactggcagggttcctcctggctgtcccctctgcctccagcgctctttcctcaggtgtccacgcagctcgtcctcacccttttctgtctctgctcagatgccgcctgaggctcccaaaacagggtctcactctgtcacccagggtggagtgcagtggtgcaatcacagctcactgcatccttgacctcccaggctcaagcgatcctcctgccagcgagcttgttacaattcctgcaccaacacggatacattgttactaactaaggccctacaccagcaaagatacattgttactaagtaaggccctgcaccaacacagatacattgttactaagtaaggccctgcaccaacacagatacattgttactaactaaggccctgcaccaacacagatacgttgttactaagtaaggccctgcaccaacacagatacgttgttactaaataaggccctgtaccaacacagatacattgttactaactaaggccctgcaccaacacagatacgttgttactaagtaaggccctgcaccaacacagatacattgttactaactaaggccctgcaccagcacagatacattgttactaaggccctacaccagcacagatacattgttactaaggccctgcaccaacacagatacgttgttactaagtaaggccctgcaccaacacagatacattgttactaagtaaggccctgcaccagcacagatacattgttactaaggccctacaccagcacagatacattgttactaactaaggccctgcaccaacacagatacgttgttactaagtaaggccctgcaccaacacagatacattgttactaactaaggccctgcaccaacacagatacattgttactaaggccctgcaccaacacagatacattgttactaactaaggccctgcaccaacacagatacgttgttactaagtaaggccctgcaccaacacagatacattgttactaaataaggccctgtaccaacacagatacattgttactaactaaggccctgcaccaacacagatacgttgttactaagtaaggccctgtaccaacacagatacattgttactaactaaggccctgcaccaacacagatacgttgttactaagtaaggccctgcaccaacacagatacattgttactaactaaggccctgcaccaacacagatacattgttactaaggccctgcaccaacacagatacattgttactaagtaaggccctgcaccaacacagatacattgttactaactaaggccctgcaccaacacaaatacgttcttactaagtaaggccctgcaccaacacagatacattgttactaactaaggccctgtaccaacacagatacgttgttactaagtaaggccctgcaccaacacagatacattgttactaaggccctgcaccaacacagatacattgttactaagtaaggccctgcaccaacacagatacattgttactaactaaggccctgcaccagcacagatatattgttactaaggccctgcaccaacacagatacattgttactaactaaggccctgcaccaacacagatatgttgttactaaggccctgcaccaacacagatacattgttactaagtaaggccctgcaccaacacagatacattgttactaactaaggccctgcaccaacacagatacgttgttactaagtatggccctgcaccaacacagatacattgttactaaggccctgcaccaacacagatacattgttactaagtaaggccctgcaccaacacagatacattgttactaactaaggccctgcaccaacacagatacattgttactaaggccctacaccagaatggatacattgtacattgttactaaagccttgcaccaacatggacacatcattactaactaaggccctgcaccaacacagatacattgttactaaggccctgcaccaacacagatacattgttactaagtaaggccctgcaccaacacagatacattgttactaactaaggccctgcaccagcacagatatattgttactaaggccctgtaccaacacagatacattgttactaactaaggccctgcaccaacacagatatgttgttactaaggccctgcaccaacacagatacattgttactaaggccctgcaccaacacagatacattgttactaagtaaggccctgcaccaacacagatacgttgttactaactaaggccctgcaccaacacagatacgttgttactaagtaaggccctgcaccaacacagatacattgttactaaggccctgcaccaacacagatacattgttactaagtaaggccctgcaccaacacagatgcattgttactaactaaggccctgtaccaacacagatacattgttactagctaaggccctgcaccaacacagatacattgttactaagtaaggccctgtaccaacacagatatattgttactaactaaggccctgcaccaacacagatacgttgttactaagtaaggccctgcaccaacacagatacattgttactaaggccctgcaccaacacagatacattgttactaagtaaggccctgcaccaacacagatacattgttactaactaaggccctgcaccagaacggatacattgttactaagtaaggccctgcaccaacacagatacactgttactaactaaggccctgtaccaacacagatactttgttactaagtaaggccctgcaccaacacagatacattgttactaactaaggccctacaccaacacagatacattgttactaagtaaggccctgcaccaacacagatacattgttactaactaaggccctgcaccagaacggatacattgttactaagtaaggccctgcaccaacacagatacattgttactaactaaggccctacagcaacacagatacattgttattaactaaggccctgcaccaacacagatacattgttactaagtaaggccctgcaccaacacagatacattgttactaactaaggccctgcaccagaacggatacattgttactaagtaaggccctgcaccaacacagatacattgttactaactaaggccctacagcaacacagatacattgttattaactaaggccctgcaccaacacagatacattgttactaactaaggccctgcaccagaacggatacattgttactaagtaaggccctgcaccaacacagatacattgttactaactaaggccctacagcaacacagatacattgttattaactaaggccctgcaccaacacagatacattgttagtaactaaggccctgcaccaacacagatacattgttactaaggccctacaccagaatggatacattgtacattgttactaaagccttgcaccaacatggacacatcattactaactaaggccctgcaccaacacagatacattgttactaagtaaggccctgcaccaacacagatacattgttactaagtaaggccctgcaccaacacggatacatcccattactaactatggaggtgctttattcagatatcctcagtgtcacctgttctcctttggccgtctcagggttcctcccaggacaccacattgcattcagtcctgaggcttctctgggctctgacagtttctcagactttccttgtttctgttgaccttgacagttttgaggattactgctcagagagtttgtagactgtccctctgttggggtttgtctgatgctttcttcatgattcgatcaggttgtcactttggggaggaagtctgtgaggtcaagtgccattttcatcgcatatcggggcacacccatctgcacaccttcgctattggcgtcggtcgtcatcacctgtgcaggcgtgctcacccggtttctccactggatccagctttattttcctttctatcaaccatcacaacctgaaactgtgggcgtccgtgtgtctcttggagtctagtagaatgtaaggccctcaaggcagaggcctcgtctgtcctgtttgtcaccagagcctggtccgcagtggtgcctagtaagttagtccacccattcaccacatccttacagagctctggcgccaggcagcaagtgctggtgctgcggacagagccacagacaagccggtcatagcttctggcctcatagaccttggagtctaacaggggagagcctttcaaagatttgctcccattgctaatgggacaggatgagacagggtgctgggggactgagagctgtgatgggggatgctgcctggagggctggggtggtctgagctctggaggaggaagtgctgctcaggtagtgagggagggggtggtatctgggttaggggaagtggcgtgtgcagaggccccgtggcgcagatgagcttgggctatttgaagaaccccagcgaggaggcagggtgttcaggtggctgtggctgtggcccaggggcaagagggagatggggaggagtggaactggttaagaagtggacagaagtagggtgagaaggcaaagtccaggatctgagacaggaggatggtggccttcctgcctcccttccttcctgccttccctggaaaggagcacgcctggggtgtggtgagtcctgttagagatgctcacggaaccccctctccccaccccgccccgtggcaggggcatggagaggcgggccctgtgcttagggggtcctgggttagggacggcgctggaagttgcaggagggcagaaaccggcctctgaagagagtggggagggagaaggggagctgtccagggccctcaggcatgcatcatgtaagggtcaggggagtcagggaggatcccccaaaggaggctgtagagggtgaaggaggagggcaggaagccagtgagtgtgggggtctgtgggccatggggggtgggggaggcagctctttgggaactgagggggttcgggtgcagccctgggactcccaggccagtgctctccctccccctgccagccacctcgcagagagagcccggggtggaagcagggtagttggtgctgtgccctgaccttcagaggtggcattgacaagaccagaatgccacagggccatgcacctctccctgcaaactgccctttaatttatttttacctctgttccttgtgggcttgtgtgtcaggttcgatatttttatgttactgggaaaatagaatgtgcttcacagaaatttgccttgtggccaatattgcaggttgcagctgtttcagagtgacaggggacggtatattctggacttgtgcccttttgttcatctctgagaggggccataaactcccatttccgagaggttactgggaccaatgagatcatttattagttttccttgcacaggaaaatcacacactctgtgccattgattgagtccattttattttgtggaatagacatgtcagaagcaggattggccaggtggaattgtgtttggcgggagtcctgtctttccataggtactttcataatggaagcaatctccttctgaagtgtatcacccggtgaactgaatggaaaatctcttgtgaaaaggcttaagaggaaggctggcctggaaaaatgaaactcacatccacagagagacttgtacctgaatgttcatgtcagcaccactcacaatacctaaaaaggggtgataaccgaaataaccatcaaccaagggatggagaaacaaaatgtggtcccccatgagatggaatatgattcagcgtaggcacgaaagaaggacggaaacatgctataacatggatgaaccttgaaaacatgctcagtgaaagaagccacacatgaaagggcagacatcatcggctcctattaatatgaaatgtccagaaagccaaatccgtggagaggggaagtagatcgaatcacacacttttaaaggatgaattgtgtggagtgagaattctatctcaataagggtgcatacaaaatgcagctgacggtggtcacaccaagcctgtcagtaatgatgcataacttccctttgctgtcctgggttagggtgggttgagacttagggtgaccagggaggaatggatatcttgtgggtcaccttgactgtcttggggtgatgagagggcagtattaccaatgcttaatcatttgcccccataccaaggtgaacacgagatgctctggtcctagtggctgcagagttgtgcagcctctgtccctgtgctagctctggacctggtggtggccgcagagctgtgtagcctctgtctctgtgcttgctctggtcctggtggccacagagctgtacagcctctgtccctccgcttgctctggttctggcggctgcagtgctgtgcagcccctgtctctgtgcttgccctgtccttgtggtggctgcagagctgtgcagcctggccccagagctgtgcagcctctgtccctgtacttgctgtggtcccggtggtggctgcagagctgtgcagtctctgtttctgcactttccctggtcactgcctcattgccgtggcgctggtggactgaggccataatgcctgcgtctcctgcaggtcctcctcgactggattaatgacgtgctggtggaggagaggatcattgtgaagcagctggaggaagacctgtatgacggccaggtgctgcagaagctcttgggtgagttcacagcagggacagctctgtcccacccccatctccctgcagcggccctgggctgggccaggattctctgcatagtgacatcggccacaggtcctaggaagacactcaaagctgcagtgtgcatctcccaggtggtgcccaggccctgggctgtggcttcagggtcctctctccccttgccgtttctacagagcacccagccatggggcagcagcaggttggggacagcttccaaaactgcctgcggctcccatcctgttgggtctcaggcccactttgtgtccctgccaccctcttttgacttgaactccttcggttcaggatgggaggcagcaggagggaagcgggtctgcagcaatattctgtgagtgaatgtgtcaccaaatacatgatagctcatgttccctcaccaggggcgggctctagtgtctgcatttgctgggtgaaggcagtttagtgatcttcccgggactgactgatgcatggtttgatgtgcagacaaaccggttgtttattcatcagatgttggatgagtcccgagggctgggtaccagggatacggtgatctttgaaacagacgtggtccctgtcctcagaacttacagtctgtctgaaaagacaaatatttttgaatggttacagttactgttcagattgcttgtgatgagggccttcggagatgccgcaggttctgagtagaggacgccggcctggcctgggggtggggcggccttgcagctcatatggaagaacgagcgaagagttgccaggcaaagaacggaagagcagagttcgcagatgatgcatgagaggaattcttggacttgtagtgggttctcacgatgcctggcactgtcatgtctcattgtcacaatggtcctagggggcagtactgccatcgccttcgacaggtggggacgttggggcccacagtctcctggtgaacagccgggcagcctggccccaagcatagctcttgagcccggccgcggggcctttctctgacctgtctacggagcagccccaggtacagggcctgggtcaggcgctcctgcatgatcacagctggttctcacaacagccctgggggtctggctgaatgagcagatgtccctggttgtccccacgatgccttttgtttggatccaggagtgaatcacacatgaacgtttgtctcttcttttaggcttctttcatctggaaccgccttccctttccctctctccgttctgttctgtctttctgtcttttatgacgttttggaagggtctgggcctcttgtcttgtagaatatcctcccatcgggatctgtctgtctcctcacgatgagatctgggtcacatgtttctgctgagagtgtgactgcgctgcctgcttgtcctcctgggggcatcgtatcaggaggagcacacaatgtcaggctgcctgtcattggtggtgctgacagtttgatcactgggttaaggcagtggcctatgggtttctccattgtaaaggtgcttctttcctgttaaaaaaaccacttttttatttgttctattttggtagagtcaggatctcactcagttgcccaggctggagtgtagtggggtgaacatagctcactgcaccctcaaactcctgggctccagtgatcctcacaccttggcctctagagtagctaggactacagatgtgtaccaccacacttggctgttttttttttttctttttttgaaatggagtcttgctctgtcacccaggctggagtgcagtggtgcgatctcagctcactgcaacctccgactccctagttcaagtgattctcctgccttagcctcctgagtagctggggttacaggcacataccaccatgcccaggtaatttttgttttttagtagagatggagtttcaccatgttggccaggatggtcttgatctcctgacctcatgatccacccacctcagcctcccaaagtgctgggattacaggtgtgagccactgtgcctgactggctaattgttttgtattaaatttttaaatttcatttttttgtgttagagacagggtccttgctttgttgcccaggcctgttttgtactggcctgaagcaattctctcatgttggcctcccaaagtgttgggactacaggtgtgagctaccatgctcagcccttctttcctttttaatacatggtctctagaggggcagactctgggactttgtgaacgtcctgttcacccatgatgcgctccccatgattttatcatccgctgattatcattctctaaattatgctaaatatcatctctaaatattatgctggaggttgcaaaatagtgatttctgtatctttatcatggcttccccacttattagctggcattttcttctgtaaataagtgcttttcttctcctgtgtccttttttaaaaaaaaaaaatcccctaaaatagaataacacattcccctggactgatgaattattttatgttcaaaagagaatggtaattagatagcaaaatctgggccttatgggtgcttgtggctcctggggtgtcattgcttctagtctctttaagccaaaagaggtagcaaatatatagttttttaaaaattgtgagttcacactgctacttctaattccagttcaatgctacaagtttatcccttaactgtcagcattcagtattccagtctccagggagaaccttggttccagaaatatatttgctatttactctgattgcatacaaaaatagtgtcagaattacaataccaatacctctatcaactacaaacatgctaggtacaagatttctttgccattattttttaagtacaatatatccactaagagtatatagtcagaattctgtgttcagaacttaactgaattattttctttttgagtggtcatgtcatccatttaatgtataaataaattaatttgtttctctctgtatttagtttttgtgtatatgtttacatttaattttatttaatattacttttaaaaatgtaaagcatttacatgcttcaaaagtcaaaactatggaaatgacataccttgaaaggtcttagccaggtgtggtggctcagcctatcatcccagcaccttgaggggctgagccaggaggatcacttgagccgaagagtttgagaccagcctgggcaacatagtgggacctcgtctctacaaattaccagtcgtggtgatgtgcaccgtgcacctgtattcccagctgctcaggaggctgaggcaggaggatcacttgagcctaggaagttgaggctgcagtgagccatgattgtaccactacattccagcctaggcaacagagtgagaccctgtcgatcaagagagagagagagagagagagagagagagacagagagacagagagagagagagagagagagagacacagagacagagagagagagagagagagagagagagagagagagagagagagagaggtctcactgctttctctcccacgtatacactcccaggtaacaattttcaatggattctgattttatccttcttatgtttctttacaaaaatgtccatatacacacctactcatttcccttttattccttgcataaaaggtgatgtattttgtacattcttttacacaccctgcttgtttcgcttaatatgttctaggaatccttgcatgtggagatcacctttctttttctttatggctgcattgtactccactgtgtggatgttccttcgtttattcacccagtctcctatgtggggcatttttgtcatttctaatatttttctatcaccagtaatattgtgggaatatcctcgtgcagatgttacagaaactagaattgttgacctcaagtgtaatgggttgcttccttgagctgaccactgtagaggaaggaattctcaaattctgagaggcttcacctctctcacctctggccttcccaggtctgttgtgccttggttgatctttcctgtagccactttctgtcttccctggactgttcagtgtgcagacatgatgtaatatttccattaaaaaatggctcccttgctcctgcaacactccaatttctctgcatcactcaaatgtattgaccattagatttggcaccggatgggtcattggtggcccagatgagagcagttttggcgcagtggtgggggtaacacgctgatcggggagggtccaggggcagagaactgtgcctttgaggtacataattttgagagggagagagaggaagggagtgaacctgtggttgctgcagctgcttttcttttcaagacagggtctcactccattggctggcctggagtgtgggggtacaatcatggctcactgcagcttccacttcctgggctcaggtgattctcccaccttagccgcccgagtagctgagagtacaggtgcatgccaccatgcatgacttattttttgtattttttatagatacgaggctttgccatgttgcccaggctgatcttgaactcctgggctcaagcaatccacccacctcagcctcccaaagtgtggggtttacaggcatgagccactgcgcctggccaatacgaggctttgccatgttgcccaggctggtcttgaactcctgggctcaaacaatccacccacctcgggctcccaaagtgtggggtttataggcatgagccactgcgcctggccatagtagctccttttcatgtctgtccactgggaaccatgcaagctgcctgctgaaattacgtggatggagcccctggcacagtgcctggcacaggtctgtcgtcaataagcaggagttgttattgctgttgttttttaaacagacaaataaatgccaagagcagaactaaggagtatctggctcgctgctgggtaccccatccaccccaagtcccctgggtgactggcacatgacaaatatttgttgattaagtcaatgaaagaattcctgcagtttcattacctatgaagattgtggggtcctcttgtgggacatgaaagggggacagatagatgagtattgtttggatttttggtcctcagtgccatccacagactccagaagggatcagctatttgctgaacaatctttcagttctcatagagccctgatatgttttcagggtccacaaatgcctgtgacggtggcctcaagaacccagtgtccccttgtaggtgggatagcatacctcttaaaggtcagcatgagattccacccatgtcatccccagcattggtggggtcagcagatcctctctctggggtttcttttctgctcaacctccctgctttgatggactgcacagacaagccccatcttggtggaagggtctccccatgggctgtcctggagggtcactcccacagatatgccccatcctggtggaagggtctccctgggggctgtcctggagggtcagtcccacagacaagccccatcctgtgggagggtctccccgtgggccatcctggagggtcagtcccacagacaagccccatcctggtggaagggtctccccgtgggccgtcctggagggtcactcccacagacaagccccatcctggtggaagggtctccccatgggccatcctggagggtcactccctcagggcagggctggtgactggggtgggatcatgtttttctccgctgttgtgacagaggagtatctgctgcaggggatacgtggactgcggggggactgccacaaggatgtgaatgggtagggggtggggtgctgtttaggagagagagagactaggggagcccctgccagagaaacttggccctgaaaacacaggggtgcagcatctgtagctgcctctggacagagtttgcacactctgcacaaatggctcttacagaccagctcttggagggaaacctcctaggcttgtgacaggtggtggtgagggtggggggatgaggtgctggggaggccatgtcccataactcactctgaaggacacagtgatgcttggaccacattgtttgtccttattcatctggccctcagaaagtatatttggagggaaacatgtctgtgtttgttttggtcacacattcattcattcatctgatgaatgaatgttcattggcttacatgtgtcgggtggctcttggctgtagagacacagtgggaaacaagagagatgagccccgcaccctgcgcctgcccactcccccagcacacattctagcagagtgaagaaagagaagtattatggggtggagtggttcaacctgaaacctagatgatgttttaaaggaatgacaagtgctaggaggaaagtaatagaaggttatggggtacagtggtgggtgggggttggggaaggcaatccagggaagctcctctggggaggcgacatctgagcacatgtctgcacagtgagcttgggaagggcgttctgggctgaggctctaaagcgagaaagagcctgttgtgttggaggagcagtgaaaagaagcggaggcggggcccaggtggcagagagggagggagagagccaagagatgaggctggggccagatctcattcagccctgctagacaacagtctattccaagtgacaggaagccattggaggttttgggtagggctgtgacgtggattgggttagagtttaaaaggtcacttaggcttctgggtgcaggatggatggggaggagagtcaggagttggaactgagagatcagtcaggacaccattgccatggcccaggcatctgatgaagtagctcagcccccagagtggaagggcagacatggggaggtactgtacagttaaactgccataggaaccaagactgatggccaggtttgtggcttgagcaactggtaaatgggaagccgttgggagtagggtgggaggttgggaaggcgggggtctgtgttgtacatgctggggctgagatacctgcccttttggaggtgatgctgagcaggtgagcctggagtccaggctgcagtgtacgtgtgaacccagcagcactgagctgatgtttagcaccgtgggactgcacggcttcacccaaagagggtgttccaaattttatttggctgaatgccgaatgcccaagaattaacatctatatttggctaaggtgagaatccccatcttagaatgagatcccatggtacaagaataagtctgaaatgttcatcaagattgtgtcataattatcacaattttattattaaaaacgttagtggccaaagttttgatgttttgcattgcagtatcagtacagtcacacccagcactgttgggtaccacttgctcttgaggtcttcaaaccagacatttgtgatgctagatgctcactttcaactcagaaggctggaggagcacgtggacctttggctgatgctgtctgaagggatactcctcatgtgaagctgcccctgggctgtcagtttttctctctctgagtggctggttatggtagagacttacctcctctttgatcttggatgtgaagattgggctgttgctggtgatggccctctgttgaagcagtccccccaattggtactttgctccctacctgaagcagatattttctaatattttcagaagcaaacttgagtgttttgttcactttcattttttatttctgattcttttgcctgcacctgtggcttctcccacccaatgacttgaaacagtatgtcagcaagccttgtatctggcagcctggctgtggaactggccctcagaatctcaggacaggctctgaatttgcatctgcatctcagccgtggttgcctgtaaaccatgccagtgccttctatagagcagaattacaggggcatctttaaagctgcatcttcccctctcaaggcacatccttttggttccctcttcagttagtgctagcaaatgcagcacttactccggagttgctgtgattgtccatgagtcctgctatatcagttgtgttatccataaagtataacatgaggcttcctttggctcaagcagcctttttcttgtggagtagctgctgttccatcttgtttgaataatcacataagcacttgagaaggcaattctaaaatctcttgagtgtcaagtggtttgacatattaaaaccactttttttttttgtactgaaaaaaagaacagtggactagaatattcagatagtaacacagcatcagaatgtcttgcctcattttgtgaatgttgttacactgaaatgacataatatactgttgatgtgagatcctcttgatgtgatactactgatgtgatcacctgatccttgagctccaggatgccaggaatgacactgatgtaggcattcagctctttggctttccaaaggcagaagcccaaaccaaataggagattttagctgaataccaaggtcaaagccaacttctgtgcatccgtagtagagaagaggtctgaggactgggtctgggctgtcagccattagtggtcaggaagaggaagttctggcaaaggtcagtcacaagggagggggagccagaggagtgttgcattcaggaagggtaaaggaggtgtttctaggaggtgagaggaggaaagagaacagacttctggtttggccatgtggaaattgcccagagtgaaccagcaggacccctgaggagtccctcttctttttttttttttctcttgagatagtgtctcactctgttgcccaggctggagtgcagtggcgtgatcacagctcactgcagccttgacccctaggcttggatgatcttcccacctcagcttccccgggaagctgggatcacagatgcataccaccatgcccagataatttttgtattttctgtagtgctgaggttttgccatgttgcccaggctagtcttgaactgggctcaaacgatcctcccaccttggcctcccaaagtgcagggatcacagggatgagccactacacccagccgaatccctcttcttgagagaagattctggaagcagctgccgggttctctgccacatgccaggtttctgggggtgtagctcccctgtgtttgcagtgcagccctcaaggtagactgcatatggccagagtgaggtgcccgtgctgtgggagctcctggctgtcgtcctgctggtcactcacgggcacaccctctccttgtgaaggtgaagttcttcatcacatgtgtactcaacccccatgtggccatcactcagggtcacctgctacatgggagaatcctccccagttttctctctttctgtgctaggaagataggggtcctggccacaacagagccctgagctgctcctgcggcccccgccagtgggcacagtgatgtctgatgatgcaagtgatcatgtgccgtattctctgttgcacaggagtcacccaagacccagcctaaggcagcacacaggcatggccagtctctttggtctctgttgcctgctgtttccaccaccaaattcatattttcaagtcctacatgcagggcccacccatgtgacctcattttaccttaactgcctctttaaatacaggcacattgcaaggtatgagagcctcgcccactaggagagatgggtagcctggcagcctcccactgtccctgctaccagccagccctgcaggttgaacctcggaatgtgactgtatttatagagataataataggctgggtgtgatggctcacacctgtaatcccagcacttccggaggctgaggtgggcagatcacttgaggtcaggaattcgagaccagcctgatcaacatggtgaaaccctgcctctactaaaaatacaaaaattacctgggcgtggtggcacatgcctgtaatcccagctactcgggaggctgaggcaggaggatcgcttgaacctgggaggcagaggttgcagtgagctgagatggtgccattgcactccagcctgggtgacgagagtgaaactccatctcaaaaaaataaaaaaattaaaagaggtaatgaaagtaaaatgaggccatacgagtgggtgggccctaattcaatatgtctagggttcctataaaaagaggagattaggacacagacatgcacagagggagaccaagtaaggacacaggaaggagagggcagccatctacaagccaggagaggggcctcagaagggtctaccctgccggtgccttgatcttggacttctggcctccagagctgtgacataaatctccgttgtttaagccgcacggtgtgtggcatgcttcgttgcagcagcccagacaaacgaatccagtgtcctccgctcctctgccgactcctcttcctccaccctgggtgacgtggccatgttcagtctgcggggccggatggtggcaggtgcaacgggggcgcgtcaggcttcccatctccctggtgggcgaggctctcagaccacccagttctgtatgatcctatctctctccttccttctccaagctgccctgctctgccctttccatggttgttgaacacctgtgggacctacttgctctctacttccagggcgcaaattcagacagacagctgtggatgactcagcgaggagctgttagatccagatggagggaaatcagatgaataagcgggaatcgtttccactcccctgcaggatgtgttttgttgggctgctttgttttttctcttgcagtcattgccacccaatcagatgttttttacgggtgtttatctccccactagggacctctgttatctgtgccatatccagcacctaggacagtgcctgtcccatagtaggtgttcagtccctatctgtgagccaacaaacgcatgatcgaaggggtattccgagcccagcaggccttgctctagaattttattatcttgaaagggatgccaaagctgtttgttttctaattgagggaggggaggctgctggggagataacactgaagacatgggggcctccagctaaaatgttttaaacagaactttgtgctgggaaccacttgcaaaacagaaaccccatttgtgactggcctggacttgattgctttcatgatggcatgtcaatgccgcgtcactgacagcagctgtgtattgaaggctctgtgctgagtgcttgcagtcaccctcccagtgaaccatctcacgatgctctgtgacgtcgcttttgttgttttgcagagtggatctatcagtaaacactggagtcttagaatcgaagactagcagggaaactgggggtccttcctgctgtgtggccctgcagcgggcgtggggtggggcgctggtggccggcacctgccagtacctactgctaacaaaagggaaattgaaggaggtgcaggctgggctggagctcagtctcagtaattgaatcttgatgaaatgtgacagttcttgtctgtgctcctccggattgtttcctgttcattcttggtaataaaatcatcgccagttctgtgaatatctaatctaacttcctattgtggcattagaatgtttaagaaacaagaatgggagcctcaggtgtgtggggaggcagaggcagcttttaagaccttttttaaaattatctttatcagtcctctcccttttgggacccacagggacagtcttctcacctcctgactcccactttcattcttcccaggtaacctccttgcctctcaactacatcttattatgttttttccattttgtatgcatagaatgttcccgagtataacacccacagttttatccttaactattcttcccttttcaatctggcgtcattctctaaggaagattagtgacctggaagctcagcgttcatggttcaacatctcaagacgcccccatggccacatggtaacctgccccgcttcggggacctccttgaggctggggtcttggtggttttgagttcctccagtatatctctctccccttcctccctccctccctccctccctccctccctctctctctctctttttttctttcttctctctctctctccttccttccttccttcctttttctttctttctctctctctctctctctctttctgaggcagggtctcactcaggttgcccaggcttgggtgcaatggcatgatcttggcttactgcaacctccacctcccgggttcaagcacttctcctgcctcagcctcccgagtagctgggattacatgtgtgcgccaccacgcctggctaatttttatatttttagtagagacgggatttcaccatatttgccaggctggtctcgaactcctggcctgaagtgattcacccacctcggcctctcaaactgctgggattacaggcatgagccactgcgcctggcccttccagctttttctgaccctcttctcttgtgcttctcattgcagaaaaactggcagggtgcaagctgaatgtggctgaggtgacacagtccgaaatagggcagaaacagaagctgcagacggtgctggaagcagtacatgacctgctgcggccccgaggctgggcgctccggtggagcgtggactgtgagttccacgccacagggggagggactgtctggagggagcccgtcctctcgacattcgtcatccacatttgtcatccacattcatcatcatcccatctggccttgcatcttaaaattgggttcatctccctgctctgtaagaggtagaacattgcaggggagaagaacaggagaagggttagggagatcctagaaaagggacctggtcaggccacaattctccatcctccccatgctgcagaggagagaggcaatgtttatggatgggtggatcagagggactttgagagagagaagcagccttggggggttcttgttgggactcaaccccaaatactggtggcagcaacacctagtgggctgtttgtctatgaccctggcattatgagatgtgacatcacggtattttcagccaagacatgaacccggcaggtgaaagactaaaccaggagaagctggaaagttctcctcggtcctgcccactccttccccacctccctcccctggaagcagggccatgagggtgtggcttcagggctctctgtgctgggccagaggtctccgtgctttggtgagctgggctctcagtggtaggcaggagaccctggagcctggccttgcacccggtttcttggtatcgagaccttgggcagacccaggctgtctcgtgggtggctgggtccgtgggtggggaatcgggtgccttgtaaactgtaaaaccctgcaggagaagtggtgatgttgaccaaacctgagtccgcatgctgaggaagagagaggacagactcaggcaaggcaggggctaatgtctaatgtccccagagtggcctctgctcttggcagcctacccttgttgggatggttcattgcggagagggagcccttttttagtgccagagataataacgcacatccttgtgatgggtaagtggccgtgacctgctttccatgctcttttcccttctgtgctaattttactatcctgttcctttccctcatcactgcccaatttattgcttttaaaaacattgtgcttctaaaagtggttgcacaagtcaccttaggccaacaggaaaggagacagtgaagctagaagtaaattcaccaggttgctcatcagctctcttgatttgtccacacttcgctccatccttgtctcgctggggtctcatttagatgctgtgtctctgttgccttctgcacgtgggctcaggttcctgtgtaacctgatctaaagcgtctcccttcctccttcctcctgcagcaattcacgggaagaacctggtggccatcctccacctgctggtctctctggccatgcacttcagggcccccatccgccttcctgagcatgtaacggtgcaggtggtggtcgtgcgggtgagtataaccgagtggtcggcctgcctgtaactccgccagagaggcaacatcttcctcctgcagttttcctgccctccccctccttttttccccccaggaggctaccttctatttttcccttttgacaaaatgtgtgtctcaccctggctccgagataaatgattggaacgggaacaatggcattgatttgatgagaggcagaagcagaggcatgagggtgttgaggtttaattttccacatttttgaaaagaacattcatttctctccaaagccaactggttggaattcaatccccttgaatgtgcttattactcattggaggaggttggccccgcgggatgaaacagacacccaaattaaagccgctttgcattcgttggggattattcatcatgccccatcatctctttttttgggttcatttctcttgattcacttggagaaatggaaccagaacccaggtccttctaacagagggtgaagtagagttacctttctcttgctatttcccttacatttattttttattttattttatgttttgtgaaagggtttcactctgttgcccaggctggagtaccatggtgcagtcatggctcactgcagcctcaacctcttgggctcaagcggtcctcccgcctcagcctcccaggtagctaggactacaggcacatgccaccgtgcctggctaatttcaaatttttgtagagacaaggtctcgctatgttgcccaagctggtctcgaagtcctgggctcaagcgatcctcccatctcagcctcccaaaatgctgtgattataggtgggagctgccatgcctggccttatttcccttacatttaagtggacagtcgctgcctagggttcgtgtgtgcagtttccctcagtaaatgtgcaatgagcgcctactattctctaagcactcagcataggctgccgagccactaaaggaggaacacatgcctggcgtctgtgggggtgaccactgcggccagagttgaggtcacgctcggaaccttggatgcctctgtgtttattttactcgagacatccggctccactttcctctggtttttaaacttctcagtcccgtggtctctgtggtcggggaggacctggctgtcactgtgttttccgaacccattctggcccctctgttaccctgggagctcagtcttgaccggacgggaatgctcctctctggcatccggcaagggccacctgccatgtgtccatgtttccttcctaaggaggatgtttgtggctggtggtggtgactcgggacctggggggccattcctatggccccgtgtcttggccactggttcacaggcagccggcctgaaaaggcttccctaggacacattgggatgtggttcccaagcctacctacgtcagctcggggccccaggagccctgtgcaggctcagaaactggagtatttcctttcaggcttgcacttgggtccaagataatctttgcggtttgcagaaagtttgaaccaggcaagcacttgctggtgcttcctgccataacgggttagaggagtgttgtttggccacgaccaaagcagaatgaaacgggagcagggggtcctgtgaaccgggcgcagttactccccagaccttagagccgccttctgtcttctctgcagccccctggcctctgagcttgctcaggggaccccttatctaaccccagatggaatggttggtgtaagggatgtggcatttccagggtggaaggaaggaaggaaagggccttatttactgcctggccacgtggctttgggctgatcacttgcttttgctgagctgcaatgcttttccccataaaaccaagattttactacaaacctgtaaaacatccagcttcatgtctacaatcctagacctgggcccagcacctggtgggtgcctcaggcatgtttgatccttgactaggtgaacacaatgtctggaccttccttggcaggcactcctgagaatcaggataaatgtcacccacactgttgttcaataacaagcaccaaccctgagtattccatggaggtcaaactcaggaaagggatggaagcccagatcttggtggtgtccactgtgggctggcccagcgggaaatgagttcccagtcccttgaggggttcagtggtggttggattagccacccaggctccatctggagctcctgtgacaggcgggctgccacccctaccatcaccactgccatgcccccctcactaccatcattacttttttttttttgagatggagtctcactgtgtcacccaggctggagtgcagtggcacaatctcagctcactgcaacctctgcctcctgggttcaactgattctcctgcctcagcctcccaagtagctgagattacaggcacatgccaccacgcccagctaatttttgtatttttagcagagaccgggtttcaccatgttggccagaatggtctcaatctcttgatctcatgatctgcctgccttggcctcccaaagtgctgggattacagctgtgagccactgtgcccggccatcattgcttttctatacctgccacgctctgggagaagtgtgacatatactgtgtcagtttcctagggcagccataacaaagtaccacaaaccaggtggcttaaaacagcagacatttattctctcgcaattatggaggccagaagtctgaaatcaagatgttgtcagggtaggatgtcctccctcatgtctcctcctctaggggaggggtcttcctgcctcctccagcttctggtggtggctgtcagtccttggtgttcttggcttgtggccacatctctccagtctctgcctctgtcatcacatggcctcctccctctgtctgtttctgtgtctgtttcctcttctaataaggaggtgagccatattggattaaggaggggctcaccataatccatgatgacctcatctgagctagtatctgcaaagacccttatttccaaatgagatcatgttctgaagtttgtggtagatatgaactttgggggaccctcttcagtcccgtgcacacacatgattgcaggggatgttccctgttatttatgttccttccaattgcatgcctcacctctcctggctgcaaagcatagaggatccctttggggaatcctgacctggggtgtttctcctgagacccacacaaatgccaactctcaaggccacgtggagaccagagggtggggaggaggatagggacaggttgtggtcgctgaaaggcaccctgcccagggtcccctgctgtgtactcacccaggcctggcatgcgtgttcaacaccacccctccttctcctgttgctcttttctaagatgatctccggccccgcagcttcgtctgccctgtcagtgcatctttcctcaactctccactgcctgattttgtatgtttattttggggttttcagaaacgggaaggcctgctgcattccagccacatctcggaggagctgaccacaactacagagtaagtggacccctgtcttgcccttccaggccctgctgccccgagtgagtgggaccccaggctgccacttcagccagggacaccagcgcccatggggctgctcccgctccacaccccttctctgtagcatgtgattctcatgctggttcccaccccagctctcctccctctgcacactttcttcagagtttttaacattagaactgagttaccttccacagactttgaattttttcattcctatcttaaaaggtgagctgtaagaacattgcaaagtggggcaggcagagagagttcaggatggttagagagaaccattgtctcagttcatttatccatctacattagccccatcagaggtgggagctacatctttaaaccagaactttcctttgacagacactactaagccatctgttatctcctagagaaagccagagggcaggtgttcagaagtctaaaaggcttcaaatctattgaaaatagcaaatcaaacagtatctgtggtatgtggttttaaggactccttgtgataacctgctaagaatctttagaattcactgcatttgtgcctcttgactaaacctgtttcagatgaaacagaacatttaaaaattgattgtctcagctaatccatcagctaagttcacagagtgattaattactgtgttgtgaattcatggatggtatttcaaaaattggagctgacacaggaaaccactcgtggcttgcaagctctcagggaagatgatgggacagtggagtgcaggctgatgcatgtgcagaggcccatgaagaggcctcccagtctgccccaggcccacgaagggaacagggagagctggaaaaggggaggatgagaatgtggttctttgcccagcacagtgggcctttggcagcagctctgcctattcagcagtaggagaagggctgctcgtggggaactgggattgggctggtgtcttagttgtttattgttgtgtaacaaatcacccccaaagtcaagtggcttaaaacaacatctgtttcatttgctgctcacaattctgtgggtcagcaatttaggctgggctcagctgggcggttgttcagccagtctcgcctggggttgctcatatgatgcagacatctgaaggctggatggaggctggggaggctgagatgggctccccctacctctggtggttggtgttggcctcccctgggtctctttcctcctcacagtgctgggcatcttcccagggtgctctcagggtcctgagagagtgagaatgcagctgcagtccccttgaggccttgtcttggacatccatacctatgtcctcaattctgtgagtcaaagtgagtcacaggtcatcctggatcaaggtgcaggaaacagactctgcctccttgtgcaggaatggcctgtgcacattgttgggtggtgggcatgctgtgataggagttcccctctaggtgagggggtcccatatgaggacagcaaggaggagctgggccccctgccataaaactagaatggtccagagacagagaatgagcaagtgggtgggagaattgtctcagctattcatcagcagtaagtggccccaaggacctgctgcatgccagcctccttgctggatcaacagagacactgagaggtgggctgagtgcagttcttttcctccagggcgacccatcctgctgatgagaaaggatgcatccacagacatgtacagtctaacacaggggcttgtgggaagtgcctcggggccctaagggaatttccaggaggaggggagcaccccaaagtcagggaaggggagatttcagtgaaagccacctcaatcagatatcagatggccctgagcagtgaggaagggagttgggattttctagcctgagtcagtgtccctctgccagccagggtcagggtaaaggagaggctgggtcacctctccaggatgatgccccaggtaggttctcctcagggctggtcatcccatccttgtctcctgttccttcccctccccgtggctgcggaggctctgacggaacatttgaatcattggatgtctgctgaaaaccagcggcccaaagatccacattcagtttcctaaggcagcattgccacctcctatccagtctcagtgttcccctttctctttcaagaggtggctatgaggtcaccccttccaggaagccctcctgtctgccaagcaggagtgcttggcttcctgttagttcccttagcctctggacacatgtggccaacattgaaatattggcttatgaggtctgtcactcccaggcatcctgagggcagggccacatagtgtttatctccaggggatgttaatttctgtatctgcacagcctgcacatagtaggtactcaagtaagtgcttgttaaataagatggagccaaaggacttgagcctagagggatttggggacaaagtaaagacttccttgcctctcaggaaggcagtgcatggaaaggatctgtgcactcactcactgggaatctttgaggagaagctgctcaccactcccgtctcccccattgcttccgctgccgcctgcctgagatcagggcctggcctcgtggttctccaggatcctttagttccacaagtcctgcaagtacattgtgtttactcctggaaacatgagtaacctgcaaccttgtgtgtgtgtttgtttgtttatttatttatttgagacagggtcttgctctgttgcccaggctggagtacagtggtgcgatcccagctcagtgcagtcttgacctcccaggctctagcgatcctcccacctcagcacctgagtagctgggactagagcgcacgccatgacacccagctaattttgtatttttcttagaggaggttttgccactttggccaggctcgtctccagccttgcatttttttattgttttgtttgtttgtttgtttgttttttgagacagagtttcactcttgttgcccaggctggagtgcaatggtgcaatctctgctcactgcaacctccacctcctgggttcaagtgattctcctgactcagcctcccaagtagctgggattacaggtgcctgccaccatgcccggctaatttttgcatttttagcagagatggggtttcgccattttggccaggctggtctcgaactcctgacctcaagtgattgacccgattctgcccctcaaagtgctgggattacaggcatgagcccctgtgcccggcccagcctgtgttttgagcgttccacggctgctggaagacctgttgtctgctgaaatcttcatattaaccactcttctgatttaagtacctcccctccaaacaacattaccagggtggttaatgtgcaaatagagatggtgatttgctgctgaccttgtgcaaacattaataattcacacaagcacctctcgtttataattagagcaggctggaacacagcaccatgtgacttgcgttcttatcagtaggcctttacctgggcagcgagggcccagctttctggctggctctgtccctcatcctccattgtgctgcttgtgaaactgtgttctgagtgacccatctcatggctctctctgtgttcttgtttgcaggatgatgatgggccggttcggtaagtaaccccagggaaagtggggagatggaggcatgttagggctcccccaggaagctcccagagagtgtacatggttatctggagggagtgggaaactagatgggtctcactgcccccatagttctggaatcctagagaaagtgcacagcccacccccacctttctgtataatgggcttgtttctcagagctgagagtggctgggttgtgctaggaggagtggggtggaaggctgggtgaccagctaggggagcaggaggggcctgggatgtaacactggctggaactgtcaggggctggagcaagagtggttgagggtaaaagggagggaggagaggcagccagcacatggagcgtcgttagctggctggaagagagtggctcagctctgtggatgtccttccatgtgtattatttcctcctggaaaccactggtttagcagacttccttagagtcaggcagccagggctcattcctggctggtggcttgtggcctgccccttcctctctctgctcctcatccgtgaaatgggagtgtaaaaggctctccccaggcaggggctgctgtgagtattgggtgagatcacaggtgagtgccctgcttggccgggggacagccctctatgtgggctggttttattagtgttggttttcagtggctcttcccaaagagagagaggtaatcactctctcttccctcatgaaagcctgagacctcatcttcatctcggtgagggatggtaacgtttcaaccctcagtaccaggataccccggccctcggcctggccagcctcagtgctttgggaagcatttcaaaagagaaacctcttgacccccagataccctgttctccagtgagcagggaggggagaacagctcttaaaaggaaaaatggaaaccagatagaagtctcccacctgcctctctagcggagctgatatctgtcttttgggggccctctgggtgggggtgccaccccctgagtcctatacaatgagggctgggccagcttggccatggggctctgtaacctcaagttattatggggaccagctaggatgccattgctgcttatctattgtattagggttctctagagggacagaagtaatacgatagatagatatatataaaggggagtttactaagggtattaactcacacgatcacaaggtcccacaatagtccttctgcaagctgaggagcagggaagccagtttgagtcccaaagctgtagaacctggagtttgatgttcgaaggcaggaagcatccagtatgggagaaagatggaggctgggagactaagccagtctagtcttttcatgttcttctgcctgctttttattttggctgtgctggcagctgattaggtggtgcccacctggattaagggtggtctgccttttccagtccacagattcagatgttaatctcctttggcaacaccctcacagacacacccaggaaccacgccttgcacccttcaatccaatcaagctgacagtattaaccatcacgcctgtggagaggggaagtggctcagatcctgcggggcttgaattgagaagatgcagccagcgtgtcccccctaggctttctttactagaccttaagctgtgctgggaacattcacaggccttctctgttttttgtttgtttgtttgtttgtttttaaggagaattccagctcttttaaattgtctctattattaaaaaacaaatgcaggaagagaaagagaaacatcctgtatatagttgctgagggaggcgaaaccgcagtggggtcacagctcatgggaccggggtgaggcgtctccccaccctgcgtctaggtagaggcgcgttttgggggcccagtgcccccctctgtcacctcttctccatcttttcttcctggaggaggctcagaacccctttggaattgtagaggcctaaagatgaggagagggccgggcgcggtggctcatgcctttaatctcagcactttgagaggccgaggtggatggatcatgaggtcatgagatcgagaccagcctggctaacatggtgaaaccccgtcactactaaaaatacaaaaaaattagccgggcgtggtggcgggcacctgtagtcccagctactcgggaggctgatgcaggagaatcgcttgaacccaggaggtggaggttgcagtgagccgagattgcgccactgcactccagcctgagtgacagagcaagactctgtctcaaaaaaaaaaaaaaaaaaaaaaaaaaaaaaaaaaaaagatgacagtgggcccctcaagcatttttgagtctttttgttttttttgtggcgctgtcacttttgtgtttggttcgggccttgttggaggtttagggaaaagacagtctgttcagttcagttgggagcacatgggcctcaggctgtgtatagcaccctgtggcccgagggcccagaagcctggccccggagcccctgccaccccatgaatgagctttagggtctgatggctggggcagtggctccctaggtaagagccaggtgtcacatgtgaaaagtggacccagctgccactccaggggtgggaggactgtggaatcgcaagaccatgtacaagaggccgatggaattgttctcgttactttgtaggctttatgtgctgtgcttgagaaaatgcaaacaggctattagtcggtgacaggcaattagttccacccccggccttgctgcttctgctgacgcaggttccgaagtctcctggttacccagcctggcaccctcaggcacagcagggtgtctggcccggcacccgcccctgtgggggcagcagcacgccttgtcttcgcttccctgccatgccattcccctccttcagcccccgagagcaccccagggtgctccctcctccagcaaccttcacctgaatgctctccctctagattaccccatggctcactctttcagctctgccagctcttggttcaaatgtcactgatcagggaggccctctctgactccactgccccaaactggcctccactggctctcctccccacccctgccttagttctttctgtactcatgtgacacaccaagcagcactcagctcatggggatggcctggctcctcttccctgtgccagtgtttacacaacgaagcttgcacgtgtctggcagacactggtgccagcaaactttcaggggcacccacagcccctgcctttctcctttcacacatggctccttgacccagaggtgctctgtgggctggagctgacctttcctcggggtgcaccccaccccctgccaaagcagccagccctggccacagtctgcacgcagctgggggcagatgttttaggagcttctggaaggccgggcagaccctccttggctaatgtgctgggctttgccaggagtggtcttctgggcctcagtttccccacgagtaccctgagccagggagggatggggactccattctgcccactccccatcattccggggagggaggtggctccacaggtcctcgctgcctcctgacagcatcactgtcctggatgaggtgggtgaggaggcttctctccacggaaacaagtctcaggggttccagggaggttgcagcctggtctccatggcaatgggtgagctggtgcggcttctccgcgggcggcccttccccctcctgggcctgccctgggctggaggctctttctgaggcagaggggaaagaagggggatgtgccttcctcactctcttccccctcattgtaactcctagtaattccccttcacgtctctcccatttctgccaacagggcttgttccaaaacctctggctccatcccatcacccgtggctcctgactgtgccctccataactcccacgttgcaggccacagcccctgttaacccctctcacagtccacccggctcttgaacctgcgctgggctttctggcatctctctctccttgtgcctgctggtccctcggtggagcgcctttcctcctcctcttgccccagcaagcctggcttgaaccccaggactgctttgtgaagccttcctcaggtccccccagcccttggttcatgggtcccagactcaggtgtctccagggaccaggctgataatataaaagaggagagtgtctagattatgcaatgataatgtcatctgccccttcaccccagggctgggtggcagtggggagtggtggggtctggcgcaagctggagagtccacacccccatccccaggggcagcttattgctgccaggtgggagtgcaggctcactgttgccacagcctccagttcttcaagagaagccagaagttaagaacttttggacaaactttccaatttaagaactgttcgctctcgccgggtaccgtggctcacacctgtagtcccagcactttgggaggctgaggcgggtggattacttgaggtcaggagttcaagaccagccttaccaacatggcgaaaccccgtctctactaaaaatacaaaaattagccaggtgtggtggtgcatgcctgtagtcccagctattcaggaggttgaggcagaattgcttgaacccgggaggcagatgttgcagtgagctgagatcatgccactgcactccagcctgggtgacagagtgagactctgtctcaaaaagcctaaagaccaaaacaaaacaaaagaaaacaaaacaaatgaaaactgttgactcaaatcaaaacattacagcgaccaagctgagcattcctgcagattgagcttgggcagccctggcatatggtcaggtcggttggccccccgtctggcttcgtcttttctgacactaacagggttgcactatcatagtttactccctctccaggccctcccccaagtctgtgcctcttccaagagaggagtccctccttgtttatctctgtgatgtccccagagcctgcggaggctctgggggacaggacgagcgggagctgtaaggactgaggaccgacaatgctcctgccaggctccatgctcctgcctctactcactgccccacttagttccacaccaagagcgaggcaggggctgtgagaatgctgcctttatggaggaagaaagggggtcggagagggaaggatttgcccagtcatggggtgtgaagtggggcagctagaacaaaataggatctattttcgttcccaaggccaagcacatcacaggggtgcagtatgctctctctgtctctctctctcccctaggtcagggtggtccctggggaggcccctgggttaccccaagacaggtgggaggagcttcctacccgaccctcttcctgtcaacctgggctctgcggctcccagggctgctccttgtattggggccccagcctggctggtaacagagggtccctccactgggctcagtcttctgagcatgctctgcccccaggaacctggaggatggaagttgggggccctgggtcccttccaaatgcccttgggtcctgtgcctggtccccagtgcccattttcagagcccctggcccctccctgccttgtggactgtgtgacgtgatgccagtcccctgggtccaggggcatggcagccggcggagaggcctctgcggccccgatgtctccttgagtggcttgactctgccagcccagcggtggcccagctaaatataccctggctgacgtcaagcactcttctgctcctggggtttttcttaagctgcatttatagtttgcgtattgctttgtaaagatgtaaaaatttcactttttttttttgttttgccccttagcagactgtcttattgagtgtagtcttagatgattatgaaaatcatttacagctgccgcattaggaagctggcgtgtgtgcagaggcagggcattttggtcaatgttggtctttaggtgaagaaaacttccctcccttcccccagtcacgcacatgctcacacacgcacacatgcgctcacacaggcacacacacgctcacacgtgctcacacatgcacacacgtgctcacacgtgtacacacgctcacaccgcacacacgcacacccgtgctcacacgcacacatgctcacacatggacacacgctcacacacgcgctcacacgtacacacgctcacagcacacacacatgttcacacacaacctcacacgcacacacgtgctcacacacgcacacatgtgctcacgtgcacacaggtgctcacacacacacatgcacacacgtgctcgcacacgcacacatgctcacacacgcaaacacgtgcccacaatgcacacacatgctcacacgcgcacacacacgtacacatacactttccttctctcctttcctctttgtttctcaccacctccacaaggccacggaaggggctacttgggctgggctgggcaggggggtgtgagctgcctcctggggcccagcctgggaggaagggtcagcatgcttcctctgggaggaggcttggccaacttctctccgtaggtctctggcttacctgggcctaatcccttctttctttttctgggctctctttgtctctctcctaggccagggcggtccctgaggaggctcccctaggccacccactagacgggtgggaggagcttcctaccccactctctccctgtcaagctgggctccgcagctcccagggctgctccttgggttggggccccagcctggctggtaaaagagggtctctctgctgggcttggtcctctgaacatgctctgcctccaggaacctggaggatggaagttggggggccctgggccccttccaaatgccctcctccctgtcttttctgccctggcagtgatgccccacagctctgtgtctacctggagacctcagccctctgcttggggtccaagtctctgttccatatgcccctatggaactcccccctccatggcagcaggagcaaaggctctgaggcaagtgtgcaccagtgtcagcaggagcagctgggaggccggttggtggagtgaagtcagggagggtgcatgtaggaggataacgctgagtctgagtgtcccatggcacgtgggagagaggatggattttatctgagtgtcccatggctcgcaggagagaagatagattttattctaagcatgataagaagcagttggagggttttagttgtggtgggagtggaggggggaaacaaatgatcctgtttgcacttggaagggctcactctgcctgctggggagaagggctcaggggccaggagtggagtaggaggctgcagctgctcccaggcgaggggcagtgaggcgtgagcaggacatggccaccgtcgcgggggaagtggttggattcacaggtgacatttgccagtagacaaggagtgtgggaacagggagaattcaggacgcctcaagtcctaggacgtggcaggtgcagatgccagatgccatctatgtgtttcatatgagaaggtaaaaagcaggtggaagggaccctctgcagcctctagtccacgctgttctggttgttcccaagcgctcttgctcgccttggtttggccgggactgatcatcagggtcagccctttcattctggtaggaattggaaggattctaggcaggtgtgggagttgaggctgaacctcctgagggatcagaagctggcagggccctggattagggcagcaccacgggtttccataaacgctccttcgtgtctctctttgcatgtcctcagagcgggatgccttcgacacgctgttcgaccacgccccggataagctcagcgtggtgaagaaggtgagctattggtgggatgttggatgtgctctcccctggctcgcggctttttgacagcacaaacgccccgctgggaagaaggtgggaaaatgtttggaatctcagaaatgtttgccacatggattgaaatgtaattacagtcaaaaacctaaccacagtgcataaaatcagcgccttttaactcaacctcgctgctccctgggtgtcttcctgcccgcccgctccgcttctgttaagtgaattacccagcccccatttctttctgactcgagaccttttttcaatgtggaaatgtttttaagcatgtcagcctgctgctctcgctggcctcatttaccatctacagcctgcccagtaaacacgcaggcctgtgcggctgagctgtgccatacatggatttggcccgtttccctccagacagagaatgggccctcactagcccaggcagcctgctggtcaatctgtggatggaaaaatctccgaggctctggagttgggggctgggtgtgatcagcttctgggggatctgccagggaggcttgttcccgtcaaaaggaactggagcccactggctgctcattaacttatccgagtgcctgcaggcatcccattcaggaggctgctgcatccctccttcccataacatcggaggagcgctcatttcaacccatggtgcaggcaagagagttctcctttgtctaggacagcttacccaaacagctttcttagtgcaagacttgtcagaacctttaataggctgacctatactgtacttctccaagagggagcttggtaggaagcatttttcaaacttgtttgtttatagtgggatttatttatctatcaattttggggtaagacgcattgtattttagtggaacccacttttggaaaatgttggcctgggtttggacgatgagatcattcatttttggaagcattttgcaaaaggctgttggaaccgtgctaatggtccttctgggacaaagccttcctagcactcttgggtggtgagggatatacttggagcatcagagtcccccacctccacctcgtcacatgtggcccccagggaccctgacagaaccggttcagggaatgaatcaaatccagcttccccacttatcagctgtgtgacttctggcgaagggcgagattataccccccagcctcagtttccccatctgtcaagtggggacagagatgttacccacctctcagggcactgtgaggataaactgggattctctctgtgcatgggcttagccggcagcgtatagtcactggtagcattgagaatggtgtggcctgagattgctttcatctctcggtagataccatgttaattcattctgcgaaagacacattttcggcactggagccaccagcaaggaagaagacagaatcctttgatttgcctggtagcttcccactccagcctgtcccttcctcacctccacattgcaagtttaggtgtctgtagctctctgtgccccagaatgaagtcaggggcccctgcccacctctgcaggtttctccctgggtcgtcccctcctactccttcccatcccacccacatccagccacagcctgaagaccccaaagggtttgcagatgtgtctgggtgcccactcggctcactctcaccttgcactggcccaccctcaggcccagctccaatgctccctctccatggtcttaacgggggtccgcacacccattaatggctcatgaaatctcccttgcattgcgtgtttccctgtagtgccctatctcttgacttctccgtcccaccactacacgcatatggagaattacatcacaggccctttggcgggggccaggggtggagctctctgtgtttgtgtccttagcaccaagcagcatgcctggcacatagtagctgctcagtaaatttgagcagaatgggtaagaaatcatatcatgggcaggctgggcgcggtggctcacgcctgtaatcctagcactttggaaggccgaggtgggtggatcacaaggtcaggagatcgagaccatcctggctaacatggcaaaaacccgtctctactaaaaaatacaaaaaaattaggtgggcatggtggtgggcacccttagtcccagctactcgggaggctgaggcaggagaatggcgtgaacccgggaggtggagcttgcagtgagccgagattgcgccactgcactccagcctgggcaacagagcgagactccatctcaaaacaaaacgaaacaaaacaaaacaaaacaaaacaaaacaaagaaatcatgtcatgggcagtggtggatgatattgagtttctatcaaagttggctttggtcactgaggaattacaggtgacaggttttaagcttgtgccggagagaagccagtgccccttggtacttacataatagggctcagagagatcaccctgggtggatctccccatgtattgcaaatcgataggcaggctgggcgctgtggctcacacctgtaatttcagcactttgggaggccaaagtgggtggatcacctgaggtctggagttcgagaccagcctgatcagcatggggaaactccatttctactaaaaatacaaaattagccgggcttggtgacgggtgcttgtaatcccaactactcgggaggctgaggcaggagaatcgcttgaacctgggaggtggaggttgcagtgagctgggatcatgccattgcactctagccggggcaccaaaagctcggatgatcctcagtggtctggggtgcaggcttcaaacctgtagctgtctagtgacagagtggttcaattccacctttgtaggcccggcgcagtggctcacgcctataatcccagcactttgggaggccaaggcgggtggatcacgaggtcaggagatcgagaccatcctggctaacacagtgaaaccccatctctactaaaaatacaaaaaaattagctgggcgtggtggcaggcgcctgtagtcccagctactcgggaggctgaggcaggagaatgatgtgaacccggtgaacccgggaggcggagcttgcaatgagccgagatcacgccactgcactccagcctgggcgacagagtgagactgtctcaaaaaaaaaaaaaaaaaaaaaaaaaaaattcagtaggtgtggctcaaggcagcactttcctcagtcttctgagtatgccgtttattgttccaggtcacacctaagatacatttgcaaatgtaatgatcctcccctggcagtttcatctttcttaagagcacagggtgctctccagtatgattgttaaatatgtcatgcgtgcacggattggcatatgtgtgcatgggttggtgagcagagacgtgtagccaggatagatgtgggcattatgccatgaaaactaggggctactgtcaggatattgagtttgaaacatgggctttttattttagcaaacaggagatgatgaaagcgtttcacagagctggggctggcaaatgtcaagcctgcccctccagatgggacctgcatgcgggccattcatggctcctgtgtctcttttattcttggcagtctctcatcacttttgtgaacaagcacctgaacaagctgaatttggaggtgacggaactggagacccaggtatgtgctgctttggcttgaaggatcctttgtccaccgccattttcagtcagtgttttgatcccaggtggggcgcgtgaacaaagctggcgccattttgttcatctcacaaggaactcccgtggtgcaggcagaaataaccaccgtggccttctcagcccctctgtcttcctttcctggggctgctgccacaaagcaccacaaacctagtggctgaaacaacagacctttgtgtcctcgaagtgctggaggcctgaagtccaaaatcaagatggggcctgggtgggttccctccaaggctgtgagggaggagctgttcctggcctccctcccagcttctgtggttttgccaggatctttagcattccttggcttgtacacacatcactcccttctttgccttcatcttcatgtggtgtcgtccttgtgtgtgtgtctctgtgtccaaatgtcccccttttatcaggacgtggtcatgttggattagagcccacccatggcttcatcccaacctgactgcatctatgtaaaccctgtttccagatacggtcacattcagaggtcctggtgattagggttccactgtatcctttttctttctttttttttttttttaaagacagagtctcgctctgtcacccaggctggagtgcagtggtgtgatctcggctcactgcaacctccacctcccgggttccaaccattctcctgcctcagcctcccgagtagctgggactacaggtacatcccaccatgcccagctaatttttgtatttttagtaaagacggggtttcaccgtgttggccaggatggtctcgatctcctggcctcatgatctgcctgcctcagcctcccaaccactgtatctttttttgggagacacaaaaccccaaaacacctgagtggtgttattcaacccataacacactccagggctccaccccagcccaacacagggcctttgcacacgcagttcctctgtctagaacgtgctggccccttcagcctctgctcagtgctgctgtcacactgtggccaggacctagcaaatgtccccctggtaggtatgtacaacacatttcttctgcaataagtatatcaagtctacttccccagccccgacccctactcaaagctaaaggagcatccttaaattatatttttgggcactccgagagcattaaagacaaaatatgattttcccaggattagcagggtgcttgaatgcggaggtttttgagctcttggtacagacatccctaatgcacagctgatccttcttaaaccccaaggtgaatgcattcattcccttctctttctttaactttcctcatttgcttttctaattaaaaaactaattcaggttcattgtagaaatgtctgaaaatgcagataagcaaaacaaataaaaatcacccataatcccgtcacccggagatgaatgcacagagggttttgttcaggccttttctctacacatatagcgagtcatggacagtgtgggtctgtatataaaagcatcacggtctgtttttaatgtatatatttatttgtgtatcgttggccaacacatttcttattttccgcagtttacaaatgttgcacatttagcctcagattattttctgtttgagacgttagcaccccagaagccactgaggtgaaaagtaaaaatcttcctttctctttttctggagacctcccccttcagactctccaggggcagctaactgcagttcatggttggatgtgtatttttctagatattttctttttctttctttctttttttttgagacagagtctcattctgtcccccaggctggagtgcagtgacacaatctcagctcactgcaacctccacctcctgggttcaagcaattctcctccctcagcctcctgagtagctgggactacaggtgcgcctcaccatgcctggctaatttttttgtatttttagtagagatggggtttcaccatgttggtcaggctggtctcgaactcctgaccttgtgatccacctgcctcagcctcccaaagtgttgggattacaggtgtgagccacattttctatgcacaaaggtatttttctaaataacagtggatcttaccgcccactgttttgtaatgtgttttgtgtcactaaatacactgtgggcatcttttggtgtaagagaaagtgtgtgtgtgtgtttctatctgatcctttttcccttgctcgatctatcggtctgtctatattttgtcacttttaatgggaagtgtatctcatcagcgggaaggctgcactgcacctcattaaaccagtgcctcacgactggatgtttttctgctcctgtaaacagcagtgcagagagcagctttgtgcacggctgtctgtgctcgtgcctgcttcctcggaataaaagcctagaagtggagtcattagagcgaagcctgcaccgcacactttgaaggctcaggaagatttgctgtgtgggggcccctggtactgtcatggggcgtgtgaggggcactgctcccccacatccataccagctgtccccacagcccttctcagaggtgtctgcacatcagtattagcagctgagcctcttacattgagactctaaaattaaatttgcatttgtttttatttactcaatatcttcatttttttccccccgattaatcgtactatatagagtcttaaaagtacatttaaccactggtcccccagaaaaggtcgctggttacagaaatgcagggatttttgttttgttttgttgcaaaggaatttgggtatttttataaataccatatatcatttatgaagactgtaaatcattaacgtcttgatgccctaggagtcggagaggccctggtttaatttcttcaatttctatttgtgtgtgggtgagtgtggtttatgtagtctggtatgtgtggtttatgcagtctgttgggggtgtgtgtgtgtgtgtggtttatgtagtctggtgggtgtgtgtgtgtgtgtgtgtgtggtttatgtagtctggtgtgtgtgtgtgtggtttatgtagtctggtgtgtgtgtgtggtttatgtagtctgtgtggtgtgtgtgtgtatttgtggtttacgtagtctgtgtggtgtgtggtgtgtgtggttttcgttgtctgtgtggtgtgtgtgtgtggttaagtagtctgtgtggtgtgtgtgtggtttatgcagtctgtgtggtgtgtgtgtggtttatgtagtctgtgtggtgtgatgtgtgtgtgtagtttttgtagtctgtgtggtgtgtgttgtgtgtgtggtttatgcagtctgtggtgggggtgtgtgtgtgtggtttttgtagtctgtgtagtgtgtggtgtgtgtgtggtttatgcagtctgtgtggtgtgatgtgtgtgtgtgtgtgtggtttttgtagtctgtgtggtgtgtgtgtggtttttgtagtctgtgtggtgtgtgtgtgtggtttttgtagtctgtgtggtgtgtgtgtgtgtgtgtgtgtggtttttgtagtctgtgtggtgtgtgtgtggtgtaggtgtgtgttttccctccttttccaaaccattcttacattgcggacagcgtcccagctctgtgatggtgagtgaactcctcagcctccctgagcttctgtccacagaattaaactggaggcgatgggcagtgtgaggactgggtgagatggcgcactgagatcaagtgggcagggctcggcaggggttagcactgcggatgaggaggcggtggtggggcctctgggcctccgtggggattctgctccctgctgagctagacagcaggttgtggagagagggcaccacgctgggtgcttgtgaaagtggagggtcacccgctcgcagctgggccccccagccctgccctctccttgtggccgtccctccctccttcctgtgagcccgtgtgctgggacagtgaggagacaccacggaaggaagaaaagactcagcaggctcagggcctgcgggagcagcggcgtggccaccccagacctcctggggagaggtgtgggttggtgccttcattcacgtggcagcttccattccctggaagttagtccatggagacgtgggcatggcagctcaatgttgttctgctgggaaggtgccagcacgcttaaccagggtgctgtgggcatgaagcttccatgtggagacacacttaaaagaattcttcaaacccgtctgatctccttaatgataggagtggctggctgctttgtggtgtggaaggctgagggcatgtgacatggaggccaagtgccatttgcccatcaactgacagcgtgttgaatttccaggcgcagtggctcatgcctgcaatcctagcactttgggtggccgaggtgggtggatcatgaggtcaggagttcaagaccagcctgaccaacatggtgaaaccccatctctactaaaaatacaaaaattggcgggtatggtggcacgcgcctgtaatcccagctactcaggaggcggaggcagaagaattgcttgaacccaggaggcagaggttgctgtgagccgaggttgcagtgagccgagatcgcaccactgcactccagcagggcccagaccctgtcctgagtcccttaagggactgttgcccactggcactagctttatgctttacagctctagctgcagctctccctgctaaaggtcagggcttctgatattggatgtttgtgattttgacttttcatctttttttttttttttttttgagacagtttcactcctgttacccaggccggagtacagtggcgcgatcgcggctcactgcaacctctgccttccgggttaaagcgattctcctgcctcaacctcccgagtagctgggattacaggcatgcaccaccacacccgctaatttttgtatttttactagagacggggtttcaccctgttggtcaggctggtcttgaactcctgaccttgtgatccacccaccttggccacccaaagtgctaggattacaggcgtgagccactgcgcctagaagtttttacttttaatttttttaaaaattcaaatttaagaattctggagattgtttgtacaataacgtgaatgcacctaacatgattgaactggacagttaaaagtagttaagatggtaaatgttatggtatattttatggtatattttaccacaatttaaattaattaaagagaaaggttagcataagcgagacacaaaagataaatggatatgcgattccacttacgtgagatacccagaggagtcaaattcatagagacagagagcagaatgattggtggttctcaggggctggggggaaggtagaatagagaattgggggacagagtgtcactttggtaacatgaagaagttctggagatgggtggtggtgagggtgacccaacaatgaggatgtacttaatgctactggcctgtgcgcttacacacggttaagatggtacatttcagcttatgtatattttatcacaataaaaaataagttagcaacattcaaacaaaaacattttaatttaaatagctgcatgtggccattggctaccatgttgaatagcagctccagaggccccctggagaatggggccacagtcactgtggtctctgctgcaagacagagtggtgagggccaccaggtcccagctctgcaccctgcagatttgaatgaatccttccagcagctgatgctgatggagcactcacgtgtgccaggtgctccctcccagccgtctcgctgtgtcttcacgacagccctgaatgatgggagtcactactatccctggggtcaggagtgggggacagttccagaggcacggtcctagccaggcagctgcactcagctccaaacactcatcatatttggtctttgcagagccccatgtgttagagccccctccccttttgcttttttctaggttaggagccaggtctcaaaagacttcacattcaggccttcacttgattccagattctcctgcctaaagtgagaggagggatggattgctttactttaaaatatttccagctgggtacagtggctcccacccgtaatcccagcactttgggaggctgaggcaagtagatcacttgagcccaggaatttgagaccagcctgggcaacatggtgaaaccctgtctctacaaaaaatacaaaaattagccgggcatggtggtgcgtgcctgtagtcccagctacttgggaggctgaggtgggagaatcgcctcagggaggatcacctgagcctgggaggccgagctgcagtgagccttgattgcatcagtgcactccagcctgggtgacagagtgagaccctgtctcagaagaaaaaatatgccccccttaagtttgtgcaaagcatttgccaactccttaccctgcccggaaacatcacaagtctttctctgcagtttgcagatggcgtgtacctggttctgctcatgggccttctggaagactactttgttcctctccaccacttctacctgactccggaaagcttcgatcagaaggtatgtgcatggtctccatccttggtaggggctcaagaaatgctcattgaaatgcagagcatagactatcccggcagctcttcctgcagcctggctgcattcttcagaaagtaaaaaatgcacaagtgatattgcaattagatgtaactctcagcaaaagaaataagaagcccatcagccgtccacaacgcatccgagttttgtttgccacattttctttgcggtcttttccatgggaccgtgtagtttttaataattgtgatcacatctcggtagagttgtaaacccttcccccattctgctgcagctccaccacctgtggttttccctgctgcttcccaagctttccaaataccatctccagtggtggcacgaagtcccaaggatggctctgttaccagcgtctttccattccccattcttgggcagtcaacttgaacatgtttctattgtttttccctactgaaacaacagagcatctttttgatacagattttttttttcattcctgtggattgttttcttaggaaaatttctcaaatagggtcaaatttggggcattcctttcaatctgggctggcccacgccacccggtcccgctgtcactgccctcgtgcgtgggcctctccctgctgtctgccctctgtccagggcttcccgcagccaagcctctcacagcagtatttagcacattgcctttaaaaacttggccatggatggtctatgttgctttggattcatgggcatctgtcattttattttcccaaagtgttagacccatgagtcagggaggcagacaatgtaagctggtggcgacagccagagaaatagcagaaatggggccagtgtttatcaatctgcccacttctggcacgttgcagtctgtttgcttgtggccaaatgttgttcctatcttgcctgctgagatggaatcaggacagattagagaggtcttggcacatggagtccatgttgaatcgagagagagagagcgagcgagcgagcaagagggagtgcagagggaatgagcagaattgtgcagaactcaccaggaaactcaccaggtgcctgtgctgtcatcctggaaatgaaaggtcagaccatccagcgaagaagcgcatgcatttccaggccccgatatggctggttgcagacacattgttttggagagatcttttctttcttcaaactagtaagaatgctggcgagaacagtgagtttagccaggagacctagggctggtttctttccaagacaaggctttgtacaaatgtcagaggcatcatctcctgggccctggccttcttccctttgaaactgggatgaaagtctttgacaattgctgccctggcctgcgaggcttgaggaggcttgagtcatctgccttcccctctgaatcggagcgaggaagggaaggctattttcaggtatagcatgcagcacaccattcatcctgttcactcaggagaaagggagcctggggtggcggtgtggctctgcgggtggctggaacactctccttcggaggatgggaggctgtcagtagttcctcctccagcccctgccttttttccctttctcctcatggcagctgctggcaaggtcttcatgagcccatagtatttattatctaccttgtagtcttcgtgaatcctggacaggtgggtggtccctgctgtggaggactcacccacttcaggctgggcccaacacccgtgtactcaaaactgcttgcggatgggatgttgatggcatcccttgctaatgtctcctgtgggctgagaccccgaggtgcgtttgctctggccctgggaatcctgacagctgctccacatttttgggaggagggactgaggttcagtgagcaaaaccagagatgcgtcatgagctgctgtccccgagggtagtaatgacttatggtttaaaacaattgcattggatttaaaaaatatcacactggacagctcagagcctgtaggctcgtgccccatgagctatctcagaggcatgagtgtggccttcagtttttttgttgcaaagccactgtttgagccttaccctgcactggccacgtgctgagcaccttgcacccattggtcatcattttgggagactctgcaggctccctctctctgtcgagtggggtgcatcctggagacgtggagatctttcctagaagaagacacgagttgcttccccctcagcattactggatgaggacagggaatctcaggaaggcttagagaccagcccagggttgcacggccagcaagggcagagccaggagggtcgactcctattccagaaccctctattctttcctcacctggccaagttgattaaaaccttttgaattgcagagagaaaggatttctgcccatgtggctggctcgaagcaggtgtgtatatggcctggtctctgctgggccttggggcctcctactgcagtcacagctggggtgagcggtccccaggcctctccgggatccatgtgctgggtatccagggatctaggctcaggggacacttctctgcctggcatgaaagagggctgggggaggaggcatggccttgagagataacaggcatgggagggtggcaatttcctgcctggcatttcctcagcctgagaagaaagcagaaggaaaatctcacttcaaaaccacttactgtggggccgagcggctgcagagcaatgaggcttggaaggggctttgctctccccttaaactgttctctcatggtgtaggggtgaccacctcgtcacccgatcacactctccagccgtctctgagtgtctccacgtgtcatgcatctcatccccagcccctcctgagcatccactccctcagcgtggaagaggattcctcaggcttaagaggtgcacgggagaggcacgtgaaaagaccggtccaaattggtgctgacttttacaatggagaagaatcttttcttaaaagaaaaatcttttctcgctattccctctctttgctatcctgtctccatctcgatttggggtcaagcctgttgtgtgtgtgtgtgtgtgcacgtgtgcatgtgcatacgtgtgtgtgagctcatttgatgatatggacggtggtcagctaaagggacctgtgttgctaggggagtggaggtgggaggctcttggaggagaacgggcacagattctacgtttcagtcctggttccatgcctgtgagccccgtgccttgtttttcttttcttttttttttttttttggaggcggggaaggaatctcactctctcacccaggctggagtgcagtggcacgatctcggctcactgcaacccccgcctcctgggttcaagcgattcttctgcctcagcctccttagtagctgggattacaggcacatgccaccatgcctggctaatttttgtatttttagtagagacggggttttaccatgttggccaggctggtcttgaactccagacctcatgatccacccgcctcagcctcccaaagtgctgggattacaggcgtgagccactacatccagctgccccatgcctttttagggcaccgatgtcctagcccatctcagcccagcaccaccctcctttgtgaaggaagatgatattcacctcgtacagggctgggaggggaaagggaacctgtatggaatacactgaccccatggtggatgcacagcacccgcaggtcgctccctgctctctccttaggggaactgcgttctgcaccctccgcacgggccgtcctcactcctcccccattgccagtgtttggccatcctcaggcccagccctggtgcagcactcccgcatctccaggcaggctgtcctgcagggttggggtgtctgccatgtggcccagtgttcccattggcagtttctgagttggcctctggagcagggtctccgtctgctgcacccccgcccctgggtggacatggcctgccctcctgccgggctgtgtcttccccactgaccctatgactagccagaccctcttgcggttggtgctggcaggtcattcgcccctttgcttctccgagcacaggccgtgtgcactgtggaagcttttccaaagcaccccacactgttttccagtgttgttcgtttgattaactcagggaagcctctttttcctggttaattattaaattacattgcaagtaaaattgttcttgtttctgattcattggcctcaaaatcatgaaaatatgatcgttgaaaggattttttgtttgtttgtttgcttgtttttttgagacagagtgttgctctgtcacccaggctggagtgcagtggcacaatctcagctcactgcaacctccgcctcctgggttcaagcgattctcatgcctcagccacccaaatagctgggattacaggtgtgcaccaccatgcccggctaatttttgtatttttagtagagatggggtttcacccattggtcaggctggtctcgaatgcctgacttcaactgatccacctgcctcggcctcacaaagtgctgggattacaggtgtgagctaccacgcccagccaggatgtttgattactaagagccctgaagtcccttgcactgtgacatctgtgcttgtttgctgtttgtttgtttgatgtcccctcctcccatcagccttggcttgcggcaggtgggtggctggatgtaatctggttcattgccggcatccctctgagtggtctttaaacacagcccagaaggcttttattttaaacctgttcagccatcattagcaggataaaagcttcaggtacatttgggggctgaggagtaatagaccctttaatttcaggggaagtcacggtagggcggaggtggccacgtttctgtagcatctaacaggaccaaggtcctgcaggctgacgcttgcagccaccatcgatctgacttccgttctgactggtccactgtccctactcagtgctaaggccctccctcccctgagggcaccccatcctgcagagacacagcctcacgtgcaggtctttacagcccttcctggggcagtgccaggcctgcgtgcctctgcacgggactcatcctttctgggcctcagtttccctgtctgtgaaatggggtcactgtgggccaggcgcagcggctcacgcctgtaattccagcactttgggaggctgaggcgggtggatcatttgagcccaagagttagagactagcctgaccaacatggcaaaacccgtctctaaaaaaaataataataatacaaaaattagccgggcacagtgatgcgtgcctgtagtcccaactactggggaagctgaggcaggaagatggcttgagcctgggaggtggaggttgcagtgagctgagatctcgccactgtgcactagcctgcgctctagaccctgtctcaaaaaacgtaaataaataaataaacaaagaaataataaataaaatggggcccctgtgacttctcatcaggtggctggcatctggggcagagcaggctcttggtggccgtgagccctcgagagcaggccgggcacctcatccttccatctctcagcccagatcactggtgtgaggggtgagaaccacctagtaagcgcacatggccctccgcagacttcctcacccgtgtctgcccaccctgtggcccgccccgggctcactgggtccttgtggacgtcagcgttgcagaggctcggtcctgtccatgccggctgtcctccagcagtgggccgtgtgtgggaacgactgttggaccctaacgctgacccaccccccttccttggcaggtccacaatgtgtccttcgcctttgagctgatgctggacggaggcctcaagaaacccaaggctcgtcctgaaggtaatgcccctggctcaggttcccccgggagaggtgcgcacggaggggaagaaaaacgggtcctagaagtggctggaaggctggcatgttgttccccagatgggccccacgtctctggctctggggcaagggtctgccaaccccagctcctcagtctcctcattttgggaaccaggaggacttcgctggtggagctggcagtgccggttctttaataaccacttgactttgaaggacgtggcctctgcccacagacctcaggattaagtgcgtctctagctggccactcaggctggaaatgcagcttcgtgccctgagaagaaattaaaggcttactcaactgtaatgactgttgggctggaggtcccctgatgctcagccaaaggcagtacttggtagcagggacttggcatgctctgcgtgggtcggagctggaggcaggaggccagcagagctggggcgggcggttgcttccctgtcccccccccggctcctgtgccaagttacctataggaggactctctaacctgagtgagcatcacagttccccaaacacacttcctaggtgtttggggacagccaggctcagcagaacatgggtggcactgcctgtgaaccctgctggaaagttacagggcagagctgaacattaaaggctttgacaagtcctatatgaagacatctgtttgcctccatcaaaacctttgccatgcaggaggagcccacagaactcagacactgtggtttagtgccctgggcccccactttgaccgtggccccctacctagccctgctccctctcctgagtcccccatggtgctatatgagttgggagcccatgatgcttcctacacctgttgccagcatccgctcaacggcgggctttgtagagtctccaaaatagctagaaaatggatcctgtcccttccatctacccactgcagccaccgcttcctgccagtccacgcggaaggttcctggccggtcccttcctgcctgttcatcctcctcttggggtttcacaggacaatttcacaccctcctgtctcgtgtgtatggctgtttattcttttttgttttgagacagggtctcactctgttgcccaggctggagtgcagtggtatgatcacagctcactgcaacctcttcctcttgggttcacagcatcctcccacctcagtctgtcgagtaactgggactaaggcgcataccaccatgcccggctaatgttttaacttttcttttttgtagagacaaggtctcactatgttgcccagactggtctcgaacttctgggctcaagcgattcgcccattacaggcacgagcccccatgcctggccttgtttattttttattgtccctccctccccactagaacagaagcctcaagggagcagggctttgtcccctgcatgccggtgctgagaatggtgcctggcctggaaactgctcgacagcacggatcaaagcacatgtccagcagggagtgtggcgagctgctgcctgtagataccggcccggcctgggtctctgggacccctcgttgctgctgccctgcagcccttttgttgctgtgaggcagggccatgagggagtggctagaggcccgagggatgctgctttgcctctccccagctgtgcatccttgaacaggttactttgcctttctgtgccagggcctcctcctctgttgaggggagtgatgatggcacctgcctccacgcgtcatggggtcgctggatggggggcggatgttcatcacacaggacttgtcagagccttcactgttcaactctgccctgtaactttccagcagggcccacgggcagtgccaccacgtgctgctgagcctgactgctcctgagcacctattacgctcaagtgagctgctcccatgagcactggaagagggtcctgcccacagaacacaccaggtccctgctgatggtggctgctagctcggcgttagtgtctggtgggtcgcacactgtcagggaggagaaatccttgctcatgtccactgtgggcttggctggggcttcctttagtttcctgtagcccaaagcctgggccctatctgcagcatggggtgcttcccccgtaccctcagaagagcccctggtggccctttgcctctgagctgctgagggagccctgcttctttgtcctcccgaacccacgactttttttttctgagacagagtcttactttgtcacccaggctggagtgcagtggcgcgatcccagctcactgcaatctccgcctcctaggttcaagcaactctcttgcctcagcctcacaagtagctgggattacaggcacccgccaccatgcctggctaatttttctatttttagtagagatggggtttcaccatgttggccaggctggtcttgaactcctgacctcaggtgatccacctgccttgccctcccaaagagctggggttacaggtgtgagccaccacacctggccctttgtcccgtttttgaggagtgaggcaggagcctgtccagaggccaggatatcctctgacaggccggcctcctaggagggtgtttgcccctgagcccggatgtgtttcctactcatctgccgctggacggcacgttagggaacccaccacggacgtgtggaaaccaggccagaggcagaggcactggtccagggcaaatagcaagttctgcagcctcccaggcagggtcccttgggtgtcccagggcctctgtccagcccaggcagggggcagagctggtctgcagtgctcattagcaccttcgctgggccagcactgggcaggggccaagccgcagagatttatgagatggggtccctgctgggcctctttattttgtggctgatgcaatgaatgagagacttttccttcttcattcaaaatcagctggggagcaagaatcaggaggtaacagagataagaatgacacggagaatggggtgcagtggctgcggtctccctgacaccctcctctgagctaggcagacttacccgggtacccagggctggtggggagggaggcagtggctgtggcctcccctgcaggcctgagactgccctgttggtccccacccggaggaagcagagcagtctcacaccccctgcacgtgggcgggtctgaagagccaggcctgcacctggttccctaggcccccagcaatgatgggcatcctggccccctgcccccttgtggggacctggcggagactccagtggggtccccgaccctgctcttaaggaggccccttgcctgggagaaaggcttgtggctcgctccaaattcacagagccgagtgcggagctcgatggtggggtgggtgtttggggagcacagagggactgaggttcatgggtcacagaaggtgattcctatccctgggcgcaggtgctaaggggtggctgtggttagcaggtctggcaggggtgtgagggttaagttctgtttgtccagcgaggctgtctggaagttctcagagctcagacctgggggctgctgcgtgggggcatcggtgtcaggctgctgctctggtctccctgtgagtccaccatgggagtggagtcagagggggccaggaggtgatggcccccacccctgggagctcctctgtccttgctgcccccctcgccttggccacctccaactccatggccgccattctccctcccctgcctccactgggctgttgggagctggggtggactcttcaggtcagggggagaccctgggatccctgacagagccccgggtgtgtccccaagcccgccgagccgagttccccgacagagccccgggtgtgtccccaagcccaccgagctgagttcagccctgcttttgctctgacagcacactcgtgggcaggtcatttctccatgtgagtcttggtcctctttgtaaaacgagagggaaggaaaggaggctgtgcaggctctgatgagggtgtgtgagtcgagaaactccatgcccagtgacaaggacagttgctgattcttagcatccaccccacctgctctctcagtaaccgatgtcgtttcttactcttgtgatcaggactaaagcacagggtcatcccatggctgcttttggatcacagggagtcaggactccaagggcctcgagcgttacctggtccaggcccattttacagatgaaggcactgagccccaaatcacggaagtcacttagaggtcacagagcaagtgaaatgaacaaggtgtctgattcccaggaaggttcttgtccacataaagaaagtggcccaagacttccagggccccagagggagctgtcgggtccattaagtgttactggggtttttggtcccggtaagtgtcattagccatgtcccccaaccggttcttagacatgtcctgatgcagatccaggaggggctgtgggagtgtctctgttcttgtcaccccaggtgcctgtccccgcagggtgtcagcccgcgccaggagctctcacaaaacctgtgtgtctggggaggcactgcccagagcgtcctggacatggtggtggccagtctttaaggggaagcgctgtgtgtggatgcggcagctggtgtcatgctggagacgtggcttctgagagtacctaccgcaatgacaggaggatggcacgcctctgaagtttctctgtttccttctgcagacgtggttaacttggacctcaaatccaccctgagggttctttacaacctgttcaccaagtacaagaacgtggagtgacgggggagctgtggatggtggcaggagtgtcccagcaagaaaggcggcatccgtctgtgccctgtgcctttccagggagccaggcgccatgggcttctggtccaagctgtgttgactgtcatccccaccccacccctacctcacgcctgccccaccccctgcctcttttggttgttgttcttaatctcctctccatgtagttcccagtgggcaagagcctttgaaaatgcaggattctaaacactcgtgcttgcgtttgaagcctcgcgtcactcagtcgcgtgggatgatgagtccgttgttgtctgccttggccgaaagatgaaaaaaagcctgaaccccaacccccagctggttgagagcaccctgcattctgcctcatggtgcagttagcgatcacaggccttcagaagtacaacatcagctcagcaggaacgccggctccccgaggacccaggcttgacgattcaccggggatctcctgggctgggctctccttggaagtgaggccttttattaaaaataaaagggttttgcagtttgaaaaactttaa

SEQ ID NO: 520 - DNA, 170023 bp, Homo sapiens
gcaaaggccctacactttgacgtcctccccatctccggcagctccttaaactaagaactcattttaatttctgaattctccctttttaaagaccagataaatttacctttgggacagttagatgtgcacaaatgcaccatgtgtttaaagatcaccaaagaggagagaaaaggggattccttagtccagagaacaaaaactggtgagctgtgatttaaacaaaacgaatgttgttaaaatcaggttgtactcagaagtccaaatttctagcttctcttgagaaactggatccgacaaacaaaaaatgttcattcctacctgcagcaggaggctggagctgagacgtgggtgttcctgcagctggggcctgtgctcccaggcactcatggcttctctggctggttcacttctccctggctcagacagatcaggagtggaaacatctgaatatgctcaaggaggaggtaagttttgggggaaaaactgtcagaaagtggatgagggctgggtgcagtggctcatgcctgtaaccctagcactttgggaggctgaggagggaggattgttgcttgagcccaggaatttgagactactctgcacaacatagtgaaaacccatctatatgaaaaaaaaaaaaaaaaaaaaaaaacagctgggtgtggtggcatgcatctgtggtctcatctacttgggagacttaggtgggaggatcacttgagcccaggaggttaaggctgcagtgagccgtgattgcaccactgcactccagctggggtgacagagcgagaccctgtcacaaaaaaaaagaaagaaagtggactagcagtgagcccagggtcaggggccctggctcttgccctgttggggctgtttaccaaatccactcactgctttcctcaggtttttcttctaccaaaggagaagatcttggtgtattcagcaatagattccactcttagtggatgccactcatgagctttctagggctttctacccccaaggtaaaggctagatgatttttaacaccagagattgattgttttgcctgtctgaggacattatgtacaaggagttgaacagtggctctttgattgtgattcagactggaggtgaatcccagctctgtggttgaccagccgtatgaccttgagcatgttctcatgtgggttcaaatactgggccactgtgaatatgaggcacagtcccctgtttcccagtgaagaaaagccaggtggaggagagtggccaacctgagtaaataacttttagaaatacagatgaaataggccgggcgtggtggctcacgcctgtaaaattttgcagatcttttaatatctgtcttcaaaaccagagggattcttgcatctggttctgcattcagtttgttgcatttgaagttgttcgattgacgcatatgaagaaaatgtgttttcacatagatacgtatttggaaaagagagtattttagtagccttttcagataactgtgaacattctttgatacttcaccaaaactcaactaatgaacggttttgaaaggttagttgcagtgtggaatctgaaaccccgtctatgtctttttcacactctgttccattaagatcccctggtctacctggcactgtgattggattgtttacccaggcatgcttttgtaacatcatatgctagtcatttgcaaaatactggttccctgaattaggcacatcttccaaatgtcaacatgtcttcattatgcaaaacagaagatcacatttggccaggtgcggtggcccatgcctgtaatcccagcactttgggaggcccaggtgggcggatcacctgaggtcaggagttcgagacaagcctggctaacacagtgaaaccctgtctctactgaaaatacaaaaaattagctgggcgtggtggtgggcgcctgtagtcccagctactcaggaggctgaggcaggagaatggcgtgaacccgggaggcggagcttgcagtgagccgagatcacgccactgcactccagcctgggtgacagagcgagactccatctcagaaaaatcaatcaatcaatcaataaaagatcacattcattaatatcagcacccgttggatcaggaaaatctaagtacagatgctcgttgacttacatttgataaacccgttgtaattcaaaaatattgtaaattgaaaatgcattaagtacacctaacctactggacatcgtggcttagcccagcctccctggaacatgctcagaacacttatattagcctacagttgggaaaaatctaaaacaaagcttattttataagaaagtattgaagatcttgtgcagtttgttgaataccgtacatgacatagaaattgcaaccatttcacgctgttgtaaaagtcagtacatcggaagtgggaccattagaagttagggaggtattgggaagctgccaagctcatggtgctggatccaagtttccaaaaattccagttttcacttgaagcccgcattttaccattggcagcaaacacttgaagctcactttgtccatttccaaggaaatgtctgccagatacccacgtctgaatcaccatagtttgttagtcgctcttccagggaaaaacaatgttccatgaacacagcggcaattcaggcctggacccaatcacccagggctttccttgagacatatgagcccctgtgagcagcagaagtgttctctgcttaggatgtttgaacacagggtaaaagcgctgagatgtaatgacagggagcattttgctgcttcattcatgagcgaaactggcatttgtgtttccctccccaagcacagtggcgaagaatacaatggccataggggtgtgttgcctctgccattctctgccagggtgcaggcactttcacccacagctgcttttgcatcgtgagtgcaaatgtcaacccagtgaaccaagtaactaagtaatgtctttgcattattataaatatagttttaacccaatggactccctggaggagtctcaggatctccagggggccgtggaccacgcttcgggaaccactgatctatcgttgtccaaagctaattttttcagctttcggggtcctccccaggtgacttgcaatagagtaattgtgagaatgcccataagggctaagctgggacttaagcaccctccttttattttcagatgtaaatcatattcacctccctgccgcagatcctttgtgaaatggggtagtcgagcctatcagtatcgagagaaacaaaagcgaagtgcctggcacgtggtaggaactcagaagtggcaggagggggcagtgggtgttggtggaggggcagaggcgggtgcgtggtctctgcgctccgtggggtgggtaagaacctgccaatcccagtgggttctagtaggagggatgtctttcctgcgtggctgtacacaggagaacactgtaaagagcaaggactggcattaaattctgcattaaacgtgaggcctgtttttacatttacacatacagatttcagtttgcgtagtgaaccgtgggaggctgtctcagtcgtgccttcctggggtcaaaccagttggcctgttttcaagaatgaaaaatgctttgcccgaaagtggggcgaatggtaatcacagacacacacgtctcggtgccagagttgtagctttatacatagtgccttcctgacaagtaaattactggattcctttgccaaatcattagataacttttaagagcaacaaacattcatgcaaaaggagattcagcattatcttgttagaaaaatagtcatgatttttgaaaagcaaggacattctgtgaagtttgaccaactgtgaaaattacagcctttcttccccgtacttcccccgtgcttttcaatcaatcagtttctaatggatgaagcattccctacatttgtcactagatggatgtgccggtcaattaaaatattctgacttcgcagggttgagataatagccagcctggatccatccgttactgtgaaatagaaggtgaccttcctgtattgagtcagagacccaaatacaattgctttgatcttattatcatagccagaaattaccgttcatctaaacgtaatttccctgaaatactgagcgggcagagctactgctggaaataccagaacatcataaagagactgtgatgtggccttggggatgaaaggtgacatcttgacttgacatccattccacctgactgcagaaatcaagtggaatggaatttcctgggatgttctgtatctagtaaaggctaagtaggattcatcaccaaaccttaacccagagagattaagccctgttataatgtgctgcggcagccacgccaggactggactccctggaatctgaccctttctttccattcccacactcccaggccagggtcctagcctttcctgtctgtctgaaaactgctcttccaggggtggggagcaggaaaccttgtgttggggtggaaagagcctgtgtttaggagttggagctggctttggattctcacttcctttgttcgcttattcgttcctccaacatggacattgggccaggtgcagggtgttgtacaggtggctcttctggcaactgccgtcaggtttaccctcctctttagccccagaggtcccacagcctcctgtgtctgcccatcccttacctccgatgtccccttccctgaagttgttccaaatgacctgtagttgccgctgctgggcctggcttctgcagggctggccactccccttctccagggagcccctagttctgtttggagaactttgccaggtgctggcccttccccactcttgggatggaagcctctagaacaggatggagaggggtgtatccatctgcatgtcattctctggtcagagaaaataagttccaccttttctgagcttgagtgagaaaaaaacaatcaaactagatgtttgccaaagacatcacagcagacacgaagtagcagagccatgggcacagaaaagggagcctgggtaccccctgctggcagaggtgctggggcaggagcaggcgctccaggtcgcgcgcgaagtcagtgaggacccttttgagctccccgcaactgaagaaggaattaataaaatcaactataacctaacagtagtagtaatagaaattttaaaatcctctcaaagttgctgcaaagtgtgaccccccccttactctcaagttaaaagagaatattaacagtctgtcttctctctgtggacagtggaccttatctatactccccaactccacattcctcaaagtttgttacaggcccagcgagttcctgcttacctccctagcatggctgcagggtcacaagaccaataagtttaggtggcaagacatgtttctctcaagatataagaaatgtaatgctgtctttgtttcttgcttctgtaacttgcttcccgcctcacgtagttcctgccttaagatgtttacaagtagaaaaagccctttgttcggggctcaaactttctggacctatgtccggctgagctggtgatcaccttaatttaataaactctcctgaaccttttccgtctctccagtctttgattgtcctgcaacacaacgtccggtttgtgagcatgcactgcttttgtcttctgggctaagccagaacaggcaatagggttaagcacctgaagtacattttaaggagaattaggagccattgttccaaaaagattctaaaaatggatgattgatttaaaaggttctcagggacagtgctgtgtactcaacagactcctgaccgacctgcttatgagccttgaaaacagaaaatctttattttgcaataaaggtgggaaaaatacaacagctctttaaaaatcaatgattaaaaaaattttatagttttatttatttatttttgagagagggtttcactctgtcacccaggctggagtgcagtggcacaatcacggctcactgcagcttcaacctcttggacttaagcaatcatcctgcttcagcctcccaagtaactgagactataggcgtgtgccaccgtgcccagctaattttttctattttttttttttttttctgtagagacagggtgttgctatattgcctaggctggtgtcaaactcctgggctcaagcagtcctcctgccttgaactcccaaagtgctgagattacatgtatgaggtaccacgcctggccgtttttttttttttctttttacacaaataatagcatactgtagttcctgttacatgcttttctctttcttttctttaattttttcagagacaaggtcttgctctgtcacctaggctggagtgcagtggtgctgaggcaggagaatgggttctggaggcagggtacctaaggctgatttgcactgatttcctagagctgaatcaaaaggaaaaccccacctctccacacccaagtaacgaaaggatcagaggctactcaaccctcccacctttccactgcatggcagatgaaaaatgggaagttcctctgattggtcccctcccacaaccaatcagactggtcgcaggccacttcttcatttacatcggttgtaatcaagtaacaacctagagggtatttaaaccccagacaattctgtaaccagggctctcagccactgctagagcctgctcccactttgaggagtgtacttctgtttcaatatatctgtgcttccgttgcttcattctattgtttctttgtttgtgcgttttgcccaattctttgttcaaaacgccaagactcataatcaagaccctccactggtaacagcgctatcatagctcactgcagtctcaactccctggctcaagggatcctcccacctcagtctctggaatagctgggaccacaggcgcatgccaccatgcccagctattttaaaagtattttttatagaggcagggtcttgctatgtttcccaggatggtcttgaacttctgggctcaagtgatgctcctgcctcagcctcagcctcccaaccctctgggattacaggcacaaggcaccacaccaggcccatggaatgctttcaatagtgtatatcctagcatcttacgccactccaagtgtagtgcaggaatctgacgatacattagaaatgcagagtcctggccagatgccgtgtctcatgcctgtaatcccagcactttgggaggccaaggtgggcagatcacggggtcaggagattgagaccatcctaaccaaaatagtgaaacgctgtctctaactaaaatacagaaaatcagtcgggcgtggtggcatgcgcctgtagtcccagctacttgggaggctgaggcaggggaatcacttgagcccagaaggcagaggttgcagtgagccgagatcgtgccactgcactacagcctggtgacagagcgagactacatctcggaaaagaaaaaaagaaaaagaaatgcagagttccaggccctgcccagcccaccctgtggttttgcaagattcccaggtggcctgtgtgtgcagtcaggattgaggagcaccctctaggtttgaactcagcacacttccataccttcagccctctcctctcataggtaactcagctcccacctgccacgtggcaggatctcctggacaggcagccagaaagctagtaacagcaaagctttgttacctaacatttccttctatttgtgtgcagtacctccccctgtcatgccccgtgtgagggcaaatcaccttcatcgctgaatctttcacctgggcaagtgcaggaggggagccccagatcagctgctcccatccatgtgagttctgctgcgcggatgcaaaaggcacaaagatcccagggacccataggaagcttcacaatggttaccatccacctactgtcagtggccactaccttccgttcattcaaccgtttgggggacagcgatcaagctcttagtgtgtgcgaggctgcgtttgcgggtacagcgggcggagatgacacttcaggtctagtggggaagaacaggtcagcagggggtacccaggaaagatggggagggggtgcccagctccgcctatgggaggaaggtgggctggggggagtggagtctcctccgagaagcccatcctttcccgtgctgctttgcagtttagcatggggcctgcatcaggctctgcactcccacgctggaggccagagattcatgtgaatttccagtcgtgggtcatggccagagcatcctttattctctttcccaaggtcgggctctctgttcaccctcttctgcctctgggagcctctggactcatttcttccctcctgcgctcctcagcgggaagtctccatctccttccttcctgtagattcctcttctccacgagaaagttttagaggcttttccaatcccccaaggcaagactttgaattacctttagttttaggccctgatttatgtgggtttgacaacaggctttaaaaaagtttttttttggtaaaatgcacataaaatgtaccatttgaggtctacagttccgtggcttaaatccatttacactgttgagcaaccatcaccaccacccatctccagaactctttcattccgaagctgaacctgcacccattaggcactcactcccaattcggtccttcccagcccctgcagccactgttctacttcctgtcgctattaatttgactcctctaggtgcctcatctaagcaggatcatacagtatgtgtccttttgtgactggcatatcacactagcatcatgtcctcaaagttcatctgcgttgtaggctgagtcagaatttcatgtatatacgcatgcatacaccacattttctttatcccttcatgtgtcagtggacgtttgggttgtttctacctttagagacaggttttttttgttgttgttgttgttttgtttttgagacagagtcttgctctgtcacccaggctggagcacagttgcatgatctcggctcactgcaacctccgcctcccaggttcaagcaattctcctgccttagcacccccgcccgcctccgagtagctgggattacaggcgcgcatcaccacgcccaactgatttttgtattttagtagagatggggtttcacatgttggccaggttggtctcaaactcttgacctcaagtgatccacccacctcaacctcccagcatgctgggatttcaggcgtgagccaccacgcgcggtctagagacaggattttatgattgagtgaatatacctggatgcctactatgtgcaaggaaagcatgcttctgagaaaaaaagattcattttgcatttttcttttagattttgagaaaaccataccatttagttatagaaaagtatttatcttttgcagcatactttggctgactttgataacactcagactgtattagagatagatgcttgggtctgccactctgaggacacggatccaagagtgctgccacaacctgcctgtctttcttgcttgcttataaaaatagagatgacaggctgggcatggtggcttatgcctgtaatcccagcgctttgagaggccgaggcaggcggatcacgaggtcaggaaatcgagatcatcatggctaacacgaggaaaccccatctctactaaaagtacaaaaaaaaaattagctgggtgtgggggtgggtgcctgtagtcccagctactcgggaggctgaggcaggagaatggcgtgaacccgggaggcagagcttgcagtgagccgagatcgcaccactgtgctccagcctgggcgacagaacgagactccatcttaaaaataaataagtaaataaataaataaagctccatattttaaaagctcattatagtatttaagtagcagtgatgtttgaatagtcttttcatgccttcccttttactgatttccttgcgaatttgaaattttgactgtcttaagataatttagcacacagaattgagctttacattttaatattttcctgatttaagaggataatttgcttacagctgttcagacctctgatctcaattggtaatgagctacagtaggtatgctatgtggatgagcatgggacagattttaacatacaagttgcaaacccaaacccatgaaagtttctatcacttttatgtcagactgagtttttaactgatgataatgcctgtctgagtattcattttctcaatcaaaatgtattctaatcagttttgaaatcagttttgaaatcagttctatttgctctaaataacatcaacttgttatttttttgtacggacagatacaaaggcagagttcaaatcagcaattccccattgacaaagtattaaggtaaagtggcattctgccataaaggtttatatatatatgtaaaaacctatatatatacacacatatgtatgtaatatataatatatgtgatatatgtaatatgtttattacatatatataaaataggttttaaaacctattatataaactctcttgttaatatataaaccattatttaaccctttaaaaaccctcttttatataataaacattatatatgtaaaaacctatatatacacatatatatgctcatatatgcatacacatgtgtgcatatgaatctttttttttttttttttgagacggagtttttctctgtcactgaggctggagtgcggcggcgtgatctcagctcactgcaacctctgcctcctgggttcaagcaattctctgcctcagcctctcgagtagctgggattacaggtgcccacctccacgcccagctaattttttgtatttttagtagagacagggtttcaccatcttggccaggctgatcttgaacttctgacctcgtgatccaccctcctcggcctcccaatgtgctggaattacaggcatgagccactgcgcccgtccccatatgaatctttaaaattgcaaatgtaattcccattagaatgtaagctccgcagaggaggtcttgttcattttgttcacgagtgcaccccacggcctggaatcacacataaactggcactcagtatttgtggaatgaatgaatccatgagtgtgcaaaggagaaagcacaagttgcttttctgcttaaccccatgtgatgaatggcaccacgtcccactaagatcactctgccctttcccctgccagggtgtctcataatgttccctggggcggctgcactgtcctataatttgtgtaatcaaacaggcacatttaggtgatccccattcccctatatgacaagcagtcctgcagtgtgctcatacctttgtataattgtgcagaaactttcatggaataaatgatgagaagtggagttgttactgacgcacttttggaagtactgtgctgatgcattcctaatgaagctcccttagagttcagaacaacagaatctgaatcactgttgttttcaaacatcggtttttggtggtaccatcagcatcaccactattaggactttcaggtaaaatgtgcagtaaatgaattgaattttggttgctctctgctcccgaatctgcatagtatctgattttgtatggcctgcgagtgaaggatgagtttacgttttaaatgtttgggaccaaaaaaatcaaaaattttacgacatatgaaaattatgtgaaattcacatttctgtgttcttaaaaaaaagttttattggaattaggcaccatgcctattttttttttttttttttttgagatggagtctcgctctgtcgcccaggctagagtgcagtggcgcaatctcagctcactgtcatctctgcctcctgggttcacgtcattctcctgcctcagagacagggtttcactgtgttagccaggatggtctcgatctcctgacctcgtgatcctcccgcctcggcctcccaaagtgctgcgattacaggcgtgagccactgcgcccggccatgcctgactaattttttaaaaatatttttcatagagatggactcttgctgtgttgcccaggttgttctcgaactccagggctcaagtgatcctcctgcctcagcctcccaaagccctgggatgaaggtgggagctgcacgcacctggcctgcttacacatcatctgtggctgctttcaagctacaatagcaaaattgggtccttgtagccaggcacggcggctcacgcctataatcccagcactttgggaggctgaggcaggtggatcacttgaggtcaggcgtttgagaccagcctggccaacatgatgaaaccctgtctctactttatacaaaagttagccaggcgtggtggtgcatgcctgtaatcccagctgctcgggaggctgaggcaagaacattgtaagcctgctggtgcttgaacctgggaggcagaggttgcagtgagccaagatcacaccactgccctccagcctgggtgacagagtgagatgctgtctcagtaaataaataaataaataaaatttaaaaaattgagtccttgcatcagagtctgtctggccccttacacacccctgccgtagaccactgtgtcttccctggccacagcaatgttctcatgatgtgctatggccgccacatccttagctccagcatcgtagagcaagttccctcccacaaagccctacacttcagttctcccctacccccgtcatcattctctccttcatccaaaacaccactctcatcccctcactgctctcaaattgggtgggaggagaaaataaaaacctttcattttgcaagcaggtgatacctggatggcaaatgaatggcaaaagaaattcagactaaggtgtgaatgtctaatagacttggcctttgttctcccacccacctaagaggtcctggcatgtttcaaggagcttgctcatcccccattttctcatagctggtcagaggggagtctttttttaaagggggcataatctttgggggactttcccagttttcccccatggaagactaggaaccaataacttggtaccatgttatttattccttcttcatctataaaatatttaagggaacaaaacgcatatgtggtttactctgcctggtatgcaaaaagagaactcggaggaattgctaataaatgaaaatccaacttcccttgtctcagagtttgctgatgcttccaaaatcatttgagtgaaagacggttgatcagtgtagttggtgattcatgttctgctcacacgtggcatgggcagaagtgtttccatcacagttttaaaattctaggcaagtctggtcatctcctcctgctcttagtatttactgtgaacatcgcaggttactctcttgccagatcactaaattagcagactgattaaataacaccatttcaaaatgctagtttagatattatggttacagcgtgcttgaaaaccctaccccaaagtgcagtaagattgcctcaaaagtataacctgggggaaataaggcattttctccatcgcacatcaattaaatatttccatcacttctctacacacttctaactcgcctaaaattgcttggaggtctgaaaatgaacaacacaagaagacatttcacagtcttaagtattccctggaatgagttcccttttctctcccaaagagctacaggcggtttttatttatttatttattttgagaaatatcagcttctttttagttctattaaagagaagtgaaagaaagctgacaagctttatttatttaactttttttttttttaacttttttgagacagtctcgctctgtcacccaggctggagtgcagttgcgcgatgtcagcttactgcaacctccacctcccgggttcaggcgattctcgtgcctcagcctcccaagtagctaagactacaggcacgcaccaccacgcccggttaatttttttgtagttttagtagataaaggtttcaccacgttggccaggctgatctcaaactcttgacttcaggtgatccgtctgcctcggcctcccaaagtgctgggattacaggcgtgagtcaccgtgcctgaccgcttgcagcttttaagaccctctttaagcacttagagtgctgccatgttatccagaaggaaactcacacatgtaaagaatccaaattatcccatccaggggtatcacgtattgactttcttttccccaagaatttattgtggtctaatttatatagagggaaatgcacacgtttcagtggaacgtctgttgacttttcacgtttgtgtacactgtgtgactaccaccagatcaggctgcacatcacccagccagcctgctggtgcccatatgcaggggagatcctcagtgcccctcaccacgccggcgaagccactatcaacacagaacagaggtcgcctgctcttgaacttcaaataagtggattcacgcagtctgtgctcttttgcatctgtctggcctctttcattcaacataatgttttggagatacactacattgttctttttttttctggatggagtctcactctgtctcccaggctggagtgcagtggtgcgatctcggctcactgcaacctccacctcctgggttcaagcgattctcctgcctcagcctcctgagtagctgggattacaggtgcccgccaccatgctcagctaatttttgtatttttggtagagacagggtttcgccatgttggccaggctgctctcgaactcctgacctcaagtgatctgcccacctcggcctcccaacgtgctgggattacaggtgtaagccaccatgcctggctcggtgtaacttctattgaaaaagatttttctcagcactctgggaggctaatgtgggtggatagcttgaggccagcagtttaagaccaacctgggcaacatagcaagacctccatctctgtttgaaaaagaaaagaagagaaaaagatccacatgtaagtggacctgcacagttccagcatgtattgttcaagggtcctgtgtttgggtactatacacagaggaacaatgtttccgtttgttcaaacacactggactcaggtccctctttctgcaggcccagattctccaaggcaagagtgtgggtaagggaggttgactgagatcacacagtgcagcccccagcatggggcacagagtgcatgcagcaccagctcaggaaatgtttcctccttgtccttaattaagattatatggaactggcctcttcagaagccacagttcaaaagcaaaccaaatggttttctttaataggggcagctgcatgtaatctgattttcataatcattctccaagtgtacaatgtatgcatagccctggcacgaggcatatgtggggagcatattaagaagcaaagacggcattgatggagaaggagctaagttcatatttctgcatctcattaaattctctctttttattagaaagtggcactttccaatcttgaagttaatatttatgtttgctgctctgcaaagcaatttggaaagtagttttagtgagattaccccagagagaaagctagttatgtaaactccacaggagccaggccaggaaggaggaaagtttttccggtttgatcattgtccttccttcctctcaccttgaaaagaaatacaacttagtccacagccatcaagccagttcttgattgtcatctgtagcacatacaagacaaaaaaatcattacaacagacacaacaattttttttttttttgagacggaatctcactctgttgcacaggctggagtgaagtggtgcaatctcagctcactgcaacctccgcaccctgggttcaagcaactctcctccctcagcattctgagtagctgggattgtaggtgcccgccaccatgcctggctaatttttgtatttttagtagagatggggtttcaccatgttggccaggctggtctgaaactcctggcctcaaatgattggcctgccttggcctcccaaactgctgggattacaggcgcgagccactgcgcctggcccagacacagcaattaaaaaaaaaaaaaagttctaacctgcatttaataatgatacaggagatagaaagaaattatttagacagatagtgagggtgaaagagtccttgacaagatctctcttctaataaaaagcagcccccaaaattattttttttctaacaaagagcagcctgaaaaatcaagctgcaaacatagataaacatgctaaaaacttacatgggtgaatgcagacagctgtgccaatagaaaagggctacctggggccaggcgtacccaacatgaagactccatctttccttttctgttgttaccacgtatacaataaagaaacgaacaacatgacactggccagacagagaatccatctacataatacataggattggggctgggcgcggtgactcatgcctgtaatcccagcactttgggaggctggggcgggcagatcacctgaggtcaggagtttgagaccagcctggccaacatggtgaaaccccatctctactaaaaatacagaaattagctgtgggtgatgatgcacacctgtagtcccagctacttgggaggttgaagcaggataatcatttgaacccaggagacggaggtttcagtgagccaagattgtgccactgcactctagtctgggcaacaagagcaaaactctgtctcacaaaaacaaacaaacaaaaaaagattagggtgcagacagccaacttttaacaccttatacaaatgatacacctagctctaaccagtttttcacgccttatacaaatggcacacctggcccaaccaatcgtttgtgccctatgcaaatcagacaccaccttctcaaactaatctgtaaaatcccctgacatttcaccatggaaccaacaacgcatttttttgggatttctctctgggcagagagctcttctctgtctttttctttttctttctttctttctttttttttttttttgagatggagtctcgctctgtcgcccaggctggagtgcagtggcgtgatctcggctcactgcaagctccacctcccaggtttacgcaattctcctgcctcagcctcccgagtagctgggactacaggcacctgccaccaggcccagctaattttttgtatttttagtagagacggggtttcaccgtgttagccaggatggtctcgatctcctgacttcgtgatccgcccgcctcagcctcccaaagtgctgggattacaggcatgagccactgtgcctggcctagctcttctctttcacctattaacttccactctaaacctcactctctgtgtgtccatgtcttagttttctgtggctgtgagacaatgaatctcgggtatcaccccagacaaatgaggccacttcaataacacatcatcctatccaagtgtaaacatgaaattcgcttatgtttcatatacaccttgtacacagagtctgaaggtaattttatacaatattttaaataattttgtgcgtgaaacaaagtttatgtacaagagatattacagctgaagggggctggaagggtcttttttcccctggggctgctgaataaactgtgtgttatgtgcctggtgcttcaactgtaacctgtcatgtgaggtcaggtgtggaattttccacttttggcatcacgtcagtgctcagaaatgttcagattttgaaccatttcattagggatgttcgacctgtggctgtttttacttccccattttattttattttattttttttgagatggagtttcactcttgttgcccaggctggagtacaatggcatgatcttagctcactgcaacctctgcctcctgggttcaagtgattcttctgcctcagcctcccgagtagctgggattacaggtgtgcactgccatgtccagctaattttgtatttttagtagagatggggtttcgccctgttggccaggctggtctcgaactcctgacctctggtgatctgcctgcctcagcctcccaaagtgctgggattacaagtgtgagccaccgtgcctggccaccttccccatttgagatgtgagaggtaatccaccctaaccataaattagtttttcatagtgttaaataagaaataaatcatcttagtctctagacaaagaggtgcaaggaaaattgagtgaatgaatgcagtgctttgggtctgagaatacaaaaggtgaacgatgataaactttaccaagaaggccctatttacatgggatttcttagtagcgagtaccacgcttgcatttaacataggattccatctgtatacaaattaggtctataaaatgccaggaaccctccagtaacgcaaagcccaagacagttcctcttacaattaagcaccacttggttgtcactagttctgcttgaaatgtggggccactgttctttcacactgtaatggcatattcaaactgtctctgccatgttcaaattagcaataaccaaatgaaaattgtaaattctgtgtgttcactggcaagccggaaccactgacgaaagcttcaaaaatccattatttcctgggcactcaccagaccccccacagatgcatctctgtgtcttcagcctctggacctcggcttttgcccattcacatcccccatgaggatggctcttgtccattttctctcccagttggtgtttcttctccccttgctctctcctggttagaggctcttcactgggggtccgtggggtgccaagggcagtaggggtgtcaggggggccttccaaagcaggctattgtttgagaatgatgttgcatgtcacgtgtcacacatgtgacattgtgtgtgcttctccagactagagggtctgtcccatgcaccagattctcaaagaggccagagacccctgccctagatgacagtctcaccccaggatacagagagtacccggatctctgttcagccctgctatgtcacaatcccactgagatgtcaataaccacatctcggccaggcacagtggctcacacctatactcccagcattttgggaggctgaggcgggtggatcacctgaggtcaggagtttgagaccagcctggccaacatggtgaaaccctgtctctactaaaattacaaaaattagctgggtttggtggtgggcatctgtaatcccagctacttgggaggctgaggcaggagaatcacctgaacccaggaggcggaggttgcagtgagctgaggtcttgccattgcactccagcctgggcgacaagaatgaaactccatctcaaacaaacaaacaaaaaactaaccacatgctcgatgtttctgtgtcttccctgctggttagtgacatccaaggcaggccacatgagtaagaaccctctgagatcttccacccttcacttccctaacctggaatccagtcattctccaggttttggggctcccaactccaaatgttcattcctctttgtcccccacttccatgtgacactgcctgggtgtgtagcctcagcaccccttttgtcgaattggtctctggctctggggtttcctcgcttggtcctccacactgggtcagttctctcaatggccacctccttccttgcacaagatcaagtgcagactcctgacctgggtgctggagggcagtcctttccatcgcccccgttctcctcacccagattctcaggccacatgggcgggcttgccatggttatggttgactcgtgcgctgcccccatcttggtccatttgcattgctataaaggaacgcctggagctggttaattttttatttttattatttatttatttagagacaaagtctcgctcttgtcccccaggctggagtgcaatggcatgatcttggctcactgcaacctccacctccaggttcaagcgattctcctgcctcagcctccccagtagctgggattataggcgcctgccaccatacctggctaatttttgtatttttagtagagacagggttccaccatgttggccaggctggtctcgaacttgtgacctcaggtgatctgcccgcctcggcctcccaaagtgctgggattacaggcgtgagccaccacgcctggcctatttttatttttttatttttgagatggagtctttctctgttgcccaggctggagtgcaatggcatgatcttggctaactgcaacctccgcctgccgggttcaggtgattctcctgcctcagcctcccgagtagctgggattacaggcatgcatcatgacacccagataatttttgtatttttagtagagacagggtttcaccatgttggccagtctagcctcaaactgctgacatcaggtggactgctggcctcggcctctcaaagtgctgggattgcaggcatgagccaccgtgcccggctgaagctggtaattaataaagaaaagaggttttgtcgctcacggctctgcaggctgcacaagcagcatggcacagcatctgcacgggtgagggccgcaggctgcttctcctggcaaaaggagcaatggagccacatgcacagagattacagggcaagagaggaagcaagaaagtgcgggggacggccagctctcaagggagctaacagagtgcaaactcactcattactatgaggatggcacaaaaccatgagggatcctccccaggacccacacaccccccatcaggcccgactcccaacacgggattgaatttcaatatggggtttagatatttggagtcaaatatccaatacatagcactcccaaaagatgctgaaatcctaatccccagtactgtgactgggacattatttggaggtagggttgtatggaaaaatcaaactgcctttcctcttctctcacaccacaagtgtcaacactcctgtgactcctgtgatgaacgggctgaggatttctccccgccagcaagtcggcactcagttctgcagcggcgccagctgggtgtcccccagtccagttcaattccagcatggtccatctgcagacagcacaagatcccacagggtgagggctcagtcccacaagacagtcaccacttttttttttttttttttgaggcagggtctggctctgttgcccaggctggagtacagtggcatgatcatggctcactgcaacctcgacctcctgggctcaagtgatcctcctagctcagcctcctgagtagctgggaccccaggcatatgccattacacccagctaattttttattttgtacagagggggtcttgccatattgcccaggctggtctcgaattcttagcctcaagtgattctctggcctcagtctcccatagtgttgggctctcaggcatgagccattgcatccagccacctgccaccacttctgatgccagtcacaagccccagctagttctgcctgtgcttctgactggctataaattgagattcttacccccctcaggtttgattagctggagtggctcacaaaactcagggcaacactgacattttctggatgattacaaagggtgttacaaaggcttctgatgaacaccagaggaagagactggtagggcaaggatggaggaggggcattaagcttccttgccctccccaggtgcaccaccctcaggaacctccatgtgtttagctatttggaagcttctccaactctgtcctttcttttttttttttgagactgagtctcactctgtcgaccaggctggagtgcagtggcgtgatctcggctcactgcaacctccacctcctgggttcaagcgattctcctgcctcagcctcccaagtagctgggattacagacatgcaccaccatacctggctaatttttgtatttttagtagtgacggggtttcaccatgttggccaggctgactcctccaactcctgacctcaagcgatccacccaccttggcctcccaaactgctgggattatagacgtgagccaccacgcctggccccccttttgggtttttatggagccttcattggctaagcacaattgaagctggacaaccatgtcgaagtgtgattggacaaaaacagtatgactcaacaccatcagtcagagtggtgaagccccgcaaggcctgtctgtatagcatttcttcctcctgggcgggaggctggactcctcctgaaatgggggtcccgtgaccctcagtcagacaaggcaggtcagagaatttctccacggccagctccaagatggaaaggtgggggaagattcaagtatattttcattttctatggcctgacttggggagaaaaaggagcaggtgaaaggagggaaggagaaagaaggtcagaaagagagagaaactacacctgaagcctgcttccaaagatccaacatgataacacaggactatcgttcccctttattgctctgaagctgtttccacactgcttcaggaaccaaggaaaaaagaacaaatattgtaacaaaagatctgcttattgctatagtcactgaggaaataacaagggtgatgggaattatgagccaggcatggtggaggaaaaccaatgcataaatatcatcatctcacagggtctttgcagatgatgaggtgaagatgaatcaccaggatgggctctaatccaacatgactgtgtccctgtaaagtctagactcacacacacacacacacacacacacacacacacacacacacacacacacacacacacagggcctagtagagacggaggcagagacggggcaatgcttctacaggccgaggaacatggaagatttgctggcaaaccccaggagcctggagagatgcagggaacagatttgcccgtgcagcctccaaatggaaatgaacctagcctacaccttgatttggatttctggcctcctgctgaaatcctaatccccagtacacaggggtattacaaggacacggtcatcttggattacagcccactctggtgacttcatcttcacttgatcatctgcaaagacccttgtgagatgatgatatttatcaattggttttcctccaccgtgcctgcctcataattcccgtagaccttgttatttctctccaaactgtgagagaagacgtttctgttgttctgagccctccagctcatggaactttgtgctggcagccccaagacaccccagtgtcctctccctgtctcttctgcctggtgggtcttctcctcctttactgaaaggaaaagggcatttgatccttgttccaggtcaaatgtcccttccctgcaagcctcctctgcccacagcacttctcccccaccccatccacatggtccctgtccctcctccatgctggccacgctacacggccactgtgtcctgtgcccacgttctccttgaccacaaactcctggaggacaaagctctgtgcccttggtcttcacgcccctggctgaggactgggcctggcaccaacttgaccaacagaaacatgtactgcactggggggactggggggcagccagcacaaagggagacagaaaaaccatctcaacccacacacccagagctgaacccacttctccccaggtgccgtcctctgctgagtgatccaccatggcctggcaggacacccagccttcactcctcctacttctttttttttattttttattttttttttatttttggagacagagtctcgctctgtcacccaggctggagtgcagtagcatgatctctgcccactgcaacttccacctcccgagttcaagcgatccttgtgcctcagcctcccaagtagcagggattacaggcatccaccaccatgccccgataatttttgtatttttagtagagatggggtttcaccatgttggccaggctggtcttgaactcttgacctcaggtgatctgcctgctttggcctcccaaagtgttgggattacaggtgcgagccactgcacctggcctactcctcctacttcttcaaggctggggcttctggctgtgagcatctcagaaatctgtttgcttttctcctaagtcaccgtccgcctgcctgtgccttctctgtctccagcacctgctgagcagccatcagccagaggcaacatctgtgacatcacagctcaaagccctgcctgggtatctaggctgggcatggtggctcacacctataatcccagcactttgggaggccgaggcaggcggatcacctgaggtcaggggttcgagaccagcctggccaacatggcaaaaccgcatctctactaaaaatacaaaaattacccggtcgtggtggcgtgcacctgtaatcccagctactcaggaggctgagacaggagaatcgctttaactcaggaggtggaggttgcagtgagccgagattgtgccactgcactccagcctgggcaacaaagcaagactacgtctaaaaaaataaaataaaataaaacaaaacaaaataaaataaaataaaataaaataaaataaaataaaataaaataaaataaaataaaataaaataaaaatagccctgtctggcagtcctcgggatgaagccgtttcctctgcttccaacacatgcgaggcctgtctcccctcctctcccctccctggcaccccacactgtccccagggcctgctcttctgctcacctcatggtaccggcctgcaagccatttcctggggcctccccgtcgcctcttccagaaacaactcctggaactccccttggaggtcaggccaatgacctgtgccccgcattgccctccatcctctaagcttcccgtgggtagggacaattcccagttctgaagggctccccctgccccgggcctggctcttggcagaagcttaacaacagaccggccacgttcgtgtgacctgattctctccggctttcaggacgtcctgaggctgcacccacgtggcaatggtgtctgtcgcgctgtcgcctggatccggcaccactagcggagccgagcagagcccagggctccaacgcgtagggaaaaggctgcgccgctcccggggtggccccacgccccttctctgagcttgagcggcggcgcgggacggggacggctctggccgggaccagcaggcctcgggcatccgggacgccggggccgcgctccaggccaggggcgggggcgggaccggggcgggggccggcggcggggccgcgccctcggcctctccccggggcgaccgggcggctccacacgcgctgcgcccgccgccggccccacgcgcggcccatgtcctccgcgccgcgctcgcccaccccgcggccccgcaggatgaagaaggacgagtcgttcctgggcaagctgggcggcaccctggccaggaagcggagggcgcgcgagggtgagtgcgcgcccgcgcccgccgacccccggggacctgcccggcggtgcccgccctcggccctagagccccacgaggccgcccccgccctcccccacgcaccccgcccggcccacgcggctgcgcgaccttcgggacaggccaggcctttgacccaggacccgtaaacaacggccgggacctggcgcgtggggccgcggtggcctccggagtctgccaaacgcgcgtgcgggcgcctgcgcggcggggacctcgggccaccgtgcggggcccgcgcctgctctgcctgccgggtgttcagctcttccctgggccagcggcatagccagccgcgcggggtgaccgttcattccatgagcagtgacgctcacgtgtgcagggcactctgggcagacacggcctgggggacccactactgggtgttgcgcgggcgccctgcagggtgcggggctcagggcgtgcagggctgaggcctgggaggcctgcgagcaagaattgcagagatcccattaaaaatttttttttttaaattttttactgcgtgtgctcacgaaacactaccaacctcgtacgttttaaagattgttagagttgcaagggatagtctggtgtctttaagtgtaccgcttgcccagggcctcctgggagatacattctggaattttctgcttgggtggggaggttctgccccgggaccatgccctatagtgagatttcggattggtgagaggtgaggggagctgctgtggaaaggcagatggagaaaggccggcctcaggtgggtccccgggaaggagccctcccatagcgggtatgcagtacggtttccttaaaccacctgggcctgacatatcccctgggaactcttcctgtgcctccagggattagtgtaccccgggatgcaggtcccccattcatttcttccctgggactcttgtattcctagggatgtgtgtgccccgggaagacatatgacagatttgcctctaggcatgtgtgtgcccccatgcacctgctccccaggatttttgtacagtgcagggaacgcttggttccccagacattttctcccagggatgcctgtgcccccagggatgcgtgtcttcccacccgtgatcctgttccaagagggcagggtcttgtccccttcagtaggtctcctggcggataggtcactcttctctcaagccttacactggaggacccactgtagcttgtattggtcggtgttggtcacgtctcctaaatgacatgattagtggctgtcacccttctatcatccccactgttcttccatgcagtcatcagcaccctcaccagaaatcatttcggttcctctttatggcttgcaacgattatagacgcaagtgacgctcccctcccaattcagcccacagcctgtggagcgcccgccatgggccaggtgctgcttagaccccaggaagaaaagagcgggggcggggtgcttgctttcgtggaacggggaatgaatacatagacaactggcgctgtgatgacgtgccccggagcacatagaacagggcgatcagagccaggggaggcctctgaggaggggacacttgagtggaggccagaaggaaccagaggaaaaagtctttcatagaatggcaaggaaccggaatgttctgggctattgcagctttttctaggtgccgtttacgctctcggaataggaagaacacacacccaaagtaatggactgggcccaaattccaaagtacgcagtgcttctcctccttgcctgtatgaattgatgtgtgtctagaaaattcaggcccagcctggtttaattcaaatgcaccaagaattccggtagcaggaagcatcctgtgctgaatagaacgggcgtggaggcaggaggaggagcaggacgccgggcactgctgatgctgctttcgctgggggtgagctgggcgccctgcctcggttctcagggttggggtgcctggcaaacagagggccacaaaccctccttggatctaggcacaggaattgagggacaggctggattgggaagggtttagcggcttctgtgtggtctcctgggaagtggaagagtcaggaagactggataatgagggcttgaataattgagagtcgctggtatttccgcaagcccatttgccttggcaacatgcgcttctgccactccagggtggagcagcccctggccctgactttgggccgtcagagctatgctcggttgcctaccagggagtgacagggcgcttgggaggtttccacgaccctgcctgctgcaccgtcggcttcatttcctcctttgttagaaagttgagggtggatttgggagaacggatgtggctccgacatgttcctgagttgaggactctaagggaggagggggaagctgggggaaggggcgggctcatcggtgaggttccagattcaggcaggggtgtgacaaggcacggagggacttttgggagggatggttgggatgagtgacgtggcctgttccagaggagaggggttaggaaatgtggggccctggggtttggaggaagcagtgcaggaagtgtctgagaatgagcttcacggtgggcgtgattaaggctgatgtgctacgggaggcgtgtcacgtggtggcctgggtcagaaaagggaactgtgaccaactgtgggcattcagaaaatggaaaggaacgccggaaacccccagggctccccacagaagctctggggacgtgaaaggacagcgtgtttcaaacttgggttcagctttactggggcttggaggagcccgtgtgcagagaagaccaacaacacacagggttccccactgtgaccatgtgatgagaggccctgtaggtccagtgggccaggatggaggtcggggacagcccagctgctgctggaagtcctcagaggcggatggccggccctggccagtgtggaagaggtcgggtggagtgctccacacatttgccacaagaggcctgttctgtgctgcaccaggcactggacctcaggcgccactgcccagtggccagggtcaggtttctcagagacagctgaaggcagcggggcgagagcagccagtctggaggttctgtccctcttttctgagcaacacattcaggaagtttctatcccctgattaccttaaaaaatatgtatgtgtgggccaggtgaggtggctcacgcctgtaatcccagcactctgggaggccgaggtgggtggatcacctgaggtcgggaattcgagaccagcctggtcaacatggtgaaaccccatctccagtaaaaacgcaaaaattagccgggcatggtggcgtgtgcctgtaatcccagctacttgggaagctgaggcaggagaatcgcttgaacctgggaggtggaggttgcagtgagctgagattgcctcactgcgctgcaggctggtcaacagagtgagactccatatcaaatagaaaaaaaaaccatatatatatatatatatatatatattcatgtgtgtgtatatatattcacatatatatattgacgtatatttttaaagcagttttaggtttacagcgaaatctagcaaagaatacaaagtgtccccacctatcccttctcacctccatcagtgccccccggctgtgtggtagagtcgtgagccaacgctgagacatcattatctccgcaagctcatagtttacattaggggttgctcttgccgttggacattctgtggctctggatggatgtagagtgacatggacccaccattacagtcacctctggagcagcgtcactgaccccagaatcctctttctgctgcctatgcatccctccgtttccccaaatccctggcaaccacggatcatttttttgttttgtttttttggtttttgtttttgttttttttactgtatctgtgtttttgccttttccagactatcatctagttgtgatcataaagtgtacagtagcgttttcagattggcttcttccactcaatgatatacattgaaggcccttccatgtcttctcagggcttggtagctcattccttttttgactgaataatattccgttgtctggatgtgccagtttgttgatccattcacctgctgaaggacatcttggttgcttccaagttttggcagttatgaataaagctgctgtgtacatctacgtgtaggtttttgtgtggagataaggttttaattcatttgagctcaattgctggatcgtatggtaagagtgtgtctcgttttggaagaaactgccaaactctcttccaaagtggctgtgccacatttattcaccggtggcgaacgagagtcctggctgctctgcatcctcaccagtatttggtggtgtcagtgttctggattttggaattctgttaggtgtattgtggtgtcttgttgctgtttcaattcgcatttccctgatgaggtatgaagtggagcatctcttcagatgcttatttgccatctgtgtatcttcttcagtgaagtgtctattaaggtcattggctcatttgtattttatttatttttatttttattttatttttgagatagggtctcactgtagcccaggctggagtgcagtggcacgatcctggctcactgcagcctcaatctcctggggctcaagtgatcctcatgcctcagcttctggagtagttgggactacaggcacataccaccatgcccagctaatttttctattttttgtagagatggggtctcgctatgttacccaggctgctctcaaactcctggactcaggagatccacctgccttggcctcccaaagtgctaggattacatgcgtgagccacagtgcccggccttggcctatttttaaatctgcttgtttgtttccttactgttgagttggaagtgttcttcatatattttggatacaagtcatgtgttttgcaaatattttctcccagccagcggcttgtcttccctgtctcttgatcctgatatctcctaagcatttgatgtagagttaatgattaatgagcaagatattgagacctcatcaactagatctaaagaaatcactaggccagacacataatcccagcactttgggaggctgaggcaggtggatcacctaaggccaggagtttgagaccagcctggccaacgtggggaaacccggtctctactaaaaatagaaaaattagccaggcgtggtggctcacgcctgtaatcccagcactttgggaggctgaagcggcagatcacctgaggtcaggagtttgagaccagcctggccaacgtggtgaaaccccatctctactaaaaatacaaaaattagccgggcgtggtggcacacacctgtaatcccagctactcaggaggctgaggcaggagaatcactcgaacccgggaagcagaggttgcagtgagctgagatcgcgccactgcactccagcctgggagacaaagcgagactctgcctcaaaaaaaaaaaagaaaagaaaagaaatcactaggtagctgcgacattgaactgaaggttgaaagtattaagtttctttgtggactttaaataaccttcaggagagaaatctcaaagctctaaaccagcaaccgagaatttccttcagggcatccatcttttacacggagccatcagttgtgtagatgatgggttgccccaaaacactaagacgcaccagtgaagggaggggagctgtggcaggggggcctgcactgcccccgcctttccccccagcaacgcctgggctgggagctgggggtgggtgagaccctggctcaggccccactcaggacagtttgagggacaggcagatggggggactgagccatgggggtctcaccacccagacttggggttttgggcctccctggaggaagtggtcctggctgaatgtctaggatggatgtaaattagcccagggagggggagggggctcctgaggagacccccaggcaggctcccagtggctgagcaacggtgcagcctgtgggctgtggccagccctggtcgggggctggagaggtgagcagccctggcgtcccacaaacacaggagcttggaacccttgctggggcttggcaggggtggccgatttcagtggtgctttggggagtggggaatggacggaatgggggaacggcggggaggcaggctggcaggaatgtggcacggggcacaggcagtgccccgaggaggtggcgtgggtgggcgcaggcgtggctgtgatttccacgctgttttctagcgggctgcagcccctctgatgctgaaatgaaaaaggacccagatccttgtttgtgggaggggtgggaaaggatttgcaaggagtgtggtctcttttggacgatttttcagacttcttctcgtttccaggccctctgtgctcacgtgacccctctgatagcgtcagggcccgtagaaaagtggctgtggcatgttgggaaggccagcgggcctcctagccaacgaaaagggggagtggctggtccgaagttgggggatatagacaggtgagggaccagggccatagtcactgtggtttctatggggaagaggggatggtggaggtcctatttggagctgttgtgttgtgaggctctttacagaccctgccaacaaagagaaagacaattccacactgttatctctaaacccaaacctccttcgagcagaggccgtctccgtttggggatggacagctgttggtccaagaaggaaaggcacagtgaggtcactgcgacgctgcccagcaccttcatgggaaacgctcctcagggtggtgagtggaactccctggagaccattttccagtgagggcctatctctttcctcttgggctgagaggaagtgggtggctcagctacatttcctttgattattattctgactataatcttcaaaccctacatttctcattgtgtgttccgcccatgcgttctgttgtccggggcagcaaagtcgacctgcaccacgtgggtgtttttgttttcttttgttttgttttgttttcttgaaggcctactaagagctgtcggaaactctgcttctgtagaaaaggtaaaggcactgcttggccacaagtgatgactcttccctgcctttcggggcttggggaggaagggcaggttctcggtggttctcctagcaccttggttacaaacctcccagcagagtcagatcaccttggcaaccccacactcatcaaagggactctgccttgattccctccccaccgctgtggaattaatatcgattgcacatcctgaaattgcttaccctcgcgctccctgtccagtcgtcagaataattaaggggtgtttattggatgtaagtgggttcatccctgctgcgagtatggattttaagtgctccgttggattgattcctccctgctgtggttggcacagggcaggtacctttaccgagctgttttcttcttttcgaacatgcggttccatcacataaaagacataccctatgaaaatgtctctgccttagctgtacatgttacactttaggtttcaggtgaaaaattggtttatctcctaatatgtctgctatttgttacatcacatagaggctgcaaaacagattaataagctttggaggatattataagcatacgttggcccaatggtattaatttgcttatccatactaattgctgtcttggtaaaagaaggcggacacaatgcaatcaatcctagaagtgttctgtggctttgcaactttgagatacctcaggctgacatattcaaatgagagccttctctctggttacaagaaaaaaatggaatgagcagcagttttggcctcgtccagtctctagggctcccagcatctgggtagtaacatgatcagccctgggaaaccagcggagtcttttacctcctctgatgttctgactaagagtgtctgggccgtggggactgaacgcaccctttgaggctatgtgtgttaaagtttgggggcccatttcttcatttctaatatggggcagtgtgggcagatcccagctctgcgtttctgagctgctgagtttgccctggttctgagaatgcccgtcgcggtggtgcagtccgcctccttgcactggatctgttgcttcttctctctaagcctctgttcctgatggtcccttgtggagcaaagcagcacttgtggtgtaaggaaggaaagcctcatcagcaattgagtgagcgctcaatcagaattcgttatggatgaatgtggatgactggaggcattgacgcagacaccagagtccagagctggtacgtggtacagcagaagtggcaagtcagctcagtttaggacaagtacctaaccctgtgttgagaaggattctgtggctgagtctgggcttagggaaaaagaatgctgggaccagtcagccacactaccagtgtgtatggagggttagttgctgagtggctgtcacccccagaacaggagccttttccagctctagtgctgtgtcatttcagcagcactggctgctttattcccattgagtgccgtgcaacagctagttggctgttggtaacaaaagttgtgtgaatcgtttaagatattgcagtgagaatgttggtatcttaactcttcccctagctgtctgtggctaggaagcatctccagtgctattgtttttttcttgagacagagtcctgctctgttgcctaggctggactgcagtggcatgatctcggctcactgcagcctctgcctcctgggttcaagcgagcacatccagctaattttttatatttttagtaaagacaggatttcatcatgttggccaggctgatctcaaactcctgacctcaactgatccgcccacctcggcctcccaaagtgctgggattacaggagtgagccaccactcccggcccccaatacttttttgaggtatacttggctgagtaactgtttagcgtgtgcagagaagcaggtgtttctgagctggaattccttgtacccagaaatgtgagggcaactcacatgggcaccaggaggcatttttgccttcctcaccagcctacggcatcagagaacatttggcagtctctgagtgggagttctttacgcttgcctgatagtagttggaggcctgctcctttaagctttgccacttgaagtgatgagcttggttttggcctttgaacctttacctgccagccacccacaatcagtcggtaatgttggtttccccaagcaacgccatcttaggaatttctttgcttgttctcttacaaagtcatgcattattatacgtgttttcatttgaaaaattacagttccacaggatctagacttgaatgttaagctattaaaaagttaaagagggagtgaaaatgttagcactcctagggcctgcgtacgttgcttgctcaaatccagacgctcctggaagcagctgtctcagcggagccctgtctgcccttgttgttttctgcttctcaagttactccagactccagggaactagaactgaccaggccccactttaaacatgtggatggagtgcccctgacaaggctggagaaagggggaggtccggggcggggcctcatgcgcatatggtattcagagtttatttttgctataaatggaatttgaagaatatatatatatatatgaacatacaaataaaaatatataaagaatatatgtataaagaatataaagaataattttggaattcattgcattgtgtctgcattcttttactgcaacagcaattataattataattatattataaagaatatatattctttatacatatatatttgagatgggtgtctttatacatatatatgtttgagatgggtgtctttatacatatatatgtttgagatgggtgtctttatacatatatatgtttgagatgggggtctttatacatatatatttgagatgggggtctttatacatatatatatgtttgagatgggggtcttgctgtgttgcccaggctggagtgcagtggctgttcacaggccagatcatcagacactgtagccttgaactcctggcctcaagggatcctcctgccttagcctcctgagtagctgaaacaataggtgcacaccaccatgcccagctcttgagaagcatctggcccatagcttaatttgaagtgtcttcatccctgtcttttttctttttgttttaaaattaatagaattgacccttgaacagcacagggggaaagaggcactgacccccatgcagtcagaaatccacgtgtaacttttttttttttttttttttttgagacggagtttcgctcttgtcactaggctggagtgcagtggtgcaatcttggctcactgcaacccctgcctcccaggttcaagtgattctcctgcctcagcttcccgagtagctgggattacaggcgtgcaccaccacacccagctaatttttgtattattagtagagacagagtttcaccatgttggccaggctggtctcaaactcctggcctcagttgatccgctcacctcagccttccaaagtactggtattacaggcatgaacaactgcacccggccaccatgtgtaacttttgactcccacaaaacttaactagtgatagcctgctgttgactggaagcctcactgataacataaacaattaacaatattttgtatgttctatgcattatgtgctgtattcttactacaaagtgagcctgaggaaagaaaatgttattaggaaaatcataaggaagagaatatgcatttatagtactgtgctgtgtttattgatgctgcacgtttacaacatgcgtttacaagatgaatgctctgaagtggccggcaactgcagctgcagacctcaccctaccatacaacatctcaagctattcagcttcttggaatgtcacgcttttcttcttttctttttccttttttttttttttttttttgagacggagtctcgctctgttgcccaggctggagtgcaatggtgcgatctcggctcactgcagcctccgcctcctgggttcaagcgattctcctgcctcagcctcccaagtagctgggattacaggcatgtgccaccgtgcccggctgatttttttgtatttttagtagaaatggggtttcaccgtggtggccaggatggtctcgatctcctgaccttgtgatccgcctgcctcagcctcccaaagtgctgggattacgggtgtgagccaccgcgcccgtccgtcaaggcttcttgggagcacttacagcaacacaagtggtgctttgtatgagtcccatagtgttattcagggtttacggtattgcactaaacatgatgaaaaatacgtgggaacccaaacagatcacttttttttttttttactatgatatggaatttactggagcggtgaactgctcaagtggagataattaacatcaaataatgttctaagcaatgcaatagcaacaggaggcggctactattacagtggtgcagtatggactgcagttaattttatgcagttattattgaatactgcatcttggctgggtgcagtggctcacgcctgtaatcccagcactttgggaggccgaggcgggcggatcacttaaggtcaggagttcgacaccagcctggccaaatggtgaaaccttgtctctactaaaaagataaaaattaaccaggcgtggtggtgggcacctgtaatcccagctactcaggaagctgaggcaggagaatcacttgaacccaggaggcagacattgcagtgagccaaaatcatgccactgcactccagcctgggtgacagaatgagactgtctcaaaaaaataaaataaatacaataaaataaataaatacataagtactgcatctttacatttgtttacatttctctcaactgtgaacacagtctgtgtgtgtgtgtaagttttgatacattttaactttttatagtagatttgtatgtattttatggtggtaaatgataaaacagatgagtatctacatatattttatgcatttgtcgcatatctaactttttcttaatttttaaaaatatttctgggctacgtggtttgcagttttttcaaattgtcacaaatctccaaaaaattttccaatatgtttattggaaaaaatctgcatgtaagtggactcatataattcaaacctgtgtttttcaagagtcaactgtaatgtctttcaaagtaaaatctaaatgagtttatacttgatatatataagtttaatagaaggagtgcgttggctcatgcctgtaatcccatttctctgcgaggctgagatgggcggatcacttgagctcaggagttcaagaccagcctgggcaacatagagagaacccctttttattaaaaattaaaaaaaaaatcaatcaggcgtggtggtgcacgtctgtggtcccagctacttgggaggctcaggtgggaggctcaggtgggaggctggcttgagcccaggagatcagggctgcagtgaaccatgattgcgccactgcactgcagctgtgtgacagagtgaggccctgcatcaaaataataatcataataaagataatctgagaagtgagggtaaaagttaaaggaagattaaaaacaaaaaaaaaatgcttataatcccagtactttgggaggccaaggcaggaggatcgcttgagcccaggagtttgagactagcctgggcaatatagtgagacctcgtctctgcaaaagaaaacaaaacaacaacaaaaaaagaaaaaacagctgagcatggtggcacatgcctgtagtcccagcctggccaacatggtgaaaccttgtctctaccaaaaatacaaaaattagccaggcatggtggcttttgcttgtagtcccagctactcgggaggctgaggtgggaggatcgcttgagcctgggaggtggaggttgcggtgagctgagatcgtgccactttgctccagcctggatgacagactgagaccctgtctcaaaaaaacaaaaacaaaaacaaatcagaatggagcttataataatcacaccgtagctaagacttgggcactgctgatgtcccaggtgctgtgctagatgcttcctgcattattaccttgtttactcctcacaccaagctgggaagtcggtgttatgtggttattcccattttgcagatgggcaaacacaggcttagagaggatcgaggtcatcctgccagcaggtgagatttaactccaggcagtgtggctcttcattgccgctgaccctgcttaaactggaagaatgattcagatgggagtcatcttcccagctggctcctagtaagctgatgtcattcctggcatttaagctgcacccagccccagtgttaggaagacgcgctagaggagacacattagatcctttttgtgctgaatgaacttgttggtgtttataagaagaagacagaaccctagtggcttcatgctactccaggaccaagtccagattctcgccagccacccagcgcctgtccagcccagcccagcccagctccagctccagctcccaggtcttctcccttggcctggccatggggtcttcgtttgctttctgtgggtcccatgatcttccttggctgaaagccctcacgtcccctgttctctctgatctgacaactctctgccctgttgacttaaatgttgcacctccagcagggtgggggcccctctttgcccattggcaccatcatgtccctgcattcctgtttcaggttgttggcacagttcctgtcttcctggggtgtggtgcattcccatttcactgggagataatgatgaccatttacagtgatctttgtgtatttgcccagcaagcaagaggcagtctagtgtagtggttagggtgactgctcttgaggccagactgcatgggcttgaactgatctttctgggccctggagctgtgaccctggggaaggtacttccccacgctgtgcctcagtttcttcttctgtaaagcctacttaactcatagggtcattagagaattgagtgagttattaaatgaaatgatgtacttaaaactggacctggggccgggcgtggtggctcacacctgtaatcccagcactttggaaggctgaggtgggcggatcacttgaagtcaggagttcaagaccagcttggccaacatggcaaaaccccatctctactaaaaaatacaaaaattagctgggcgtgatggtgtacgcctgtaatcccagctactcgggaggctgaggcaggagaatagcttgaacccaggaggtggacgttgcagtgagctgagatcacgccactgcactccagcctgggcgacagagtgagactccatctcaaaaaccaaaaaccaaaaaacaaaaaagctggacctggtcaagccatcgagtgggagaaaatgtttgcaaaacacatgtttgataaaagactggggtccaggagatggagagaacttccgcaactcaagaataaaaacacagtcaacgcagtaaaagaatagatagataaagggtttgaacagacacgtcaccaaagaagattgacagatagccaatatgcatctggaaaagtgctccccgtcaccagccacctgggaaatgcacatgagaagaacagggaatgccccgcagacccatgggaaaggctggaagatgtggtgagaataggacagctgctactcactcaggctggagggatgtgcagtggtgtggcccctcaggaaatcagcttggtagtttcttttaaaatcaagtaaccatccttcctatgacccagcaattccagtaaatcttagatagatttgctcaacagaagtaggaatctgtggctgagcacggtggctcattcctgtaatcccagcactctgggaggctgaggcggacagatcacctgagctcaggagttcaagaccagtctggccaacatgacgaaacctaaaaatataaaaattagctgggcgtggtggtgcatgcctgtaatcccagctacttgggaggctgaggcaggagaatcacttgaacccgggaggtggaggttgcagtggcagtcaatatcgtgccactgcactccagcctaagcaacagagtgatactctgtcaaaaagaaagaaaaaaaaaaagtaggaatctgtaagaagactcttgtacaggaatgttcatagcagcttcattcataagagctggtacttggaaacagcttggggaccatcagtaggtgaatggatacacggacagcagtaattgacaggacggaatgatcctgggcagtgtcaaggaacaaggtgccggtacaggaaatcacccgagactctcaaaaccactatgctgagcaaaccaagacagaccaaaagagtacacactgtgtgatttcatttcatttcatttttttcaaagatgagatctcactctgatgcccaggctgaagtgcagtggtgcagtcatagctcactgcagcctcgaactcctggcctccagtgatccttctgcctcagcctcccaaggagcgaggaccacaggtgtgtaccactacaccccgctaatttcacttttacaatgttctacagcagacagagctaatctgtggtggttgcctctggggctgtgggcaggagttgcttggggaggagcaggagggattttctgttgttatgaaaatattctttacagtgagagtggtttgagatacgcaggtgcagcatttgtcaaaactctgcatgtgtactttaaatttgtgcatttcatggcatgtaccttttaactccaaggaaataaaagaactataaataaatactgaactctaattagtgatgtgtgtgattagagggaaaagtactgatgtctgcaacttactttgaaatgtgttaaaaaaagatgatatggtagactgaatagtagtaccaaaaatgtctatattccaatacctggaaactgagaatatgttctcttatgtggtcaaagggaatttgcaggtgtgattaagttaagaaccttgagatggaattagcctgggttatttgggtgggcccagcgtgattaccagggtccttatgagaaggaggcaggagggtcagagtcagagagaagtgaccatggaggtggaagttgcaatgatgtggggccaggagccaaggaatgtgagcagcctctgaaagctgcaaaagccaggaaattgatttcctcctggagcttctagagggaatgcagccctgctgacaccttgattttagccagtgagacccattttggagtcctggcatccggaaccacaagatagaaatttgtgtcgtatggaggccgggcgcggtggctcacgcctgtaatcccagcactttgggaggccgaggtggacggatcatgaggtcaggagatcgagaccacggtgaaaccccgtctctactaaaaatacaaaaaattagccgggcgtggtggcaggcgcctgtagtcccagctactcgagaggctgaggcaggagaatggtgtgaacccggaaggcagagcttgcagtgagccgagatcacgccactgcactccagcctgggcgacagagcaagactctgtctcaaaaaataaaaaaaaaaagaaagaaatttgtgtcgtatgaagtcccacagtttgtgggaattatttccagctgcaattggaaatgaatgctgatggattgctggatagatagagggatggacggatgtggaataaaacaagtatagacaaaggtgggtggtggactgtaggctgtgggtatacaagtgttcacttcaaactttacttggctgggagtgggggcccatgcctgtaatctcagcactttgggaggccgaggcgggtggatcacttgaggtcaggagttcgagaccagtcttgccaacatggtgaaactccatctctacaaaaatacaaaaaattagctgagcacagtgacatatgcctgtggtctcagccacttgggaggctgaggcaggagaatcgcttgaacccgggaggtggaggttgcagtgaactgaaattgtgccactgcactccggccagggtgacagagcaagactccctctcaaaaaataaaataaaataaagttctttagatgtttctatgtgtttgaaacttttaataatgaaatactggggggaaatgactgggcctgatacataataaaagccctacaggccaggcacagtggttcacgcctgtaatctcagcactttaggaggctaaggcaggaggattgcttgagcccaggagtttgagaccagcctaggctacatagtgagaccccctctctaccaaaaaatagaaaaaaatagccaggcgtggtggcccatgcctgtggtcccagctaccccggaggctgagggggagaatggcttgagcatggaaggctgaggctgcagtgagtcgagattgcaccactacattccagcctgggtgacagagcgagaccctgcctcaaaaataaataaataaataaatacatacatacattcatacataccctacataggtgtcagcctttgttctcattggcatctcatctccattcttattgccaccacggccactcccccactttatccatcaggtggagaagaggcctgggaagagaagagaccaggggctgggttggtggtgagcagacgaaataataaacatacaatgaggccatatgacatattgggagaattgctttcacttaagaaaatctaggctgggcgcggtggctcatgcctgtaatcccagcacttttggaggccgaggcaggtggattgcctgaggtcaggagtttgagaccagcctggccaacaagtgaaaccctgtctctactaaaaatacaaaaattagccaggcctggtggtgggtgcctgtaatcccagctgctcaggaggctgaggtgggagaatcgcttgaacccgggtggcggaggttgcggtgagccgagattgtgccacttcactccagcctgggtgacagagcgagactccgaagtgaaggggctggggctttggaactgtagaggctcatctccccagtaagctgtcacttgtgatgtggttacagctgtaggcatttgcagagatgggacgagaagacacgccaccctgggaactggcccgtgtcttcacacgtcctgcactgctgctgctgagaacgtctgcactttgttaggggaagagagtgttttagttaaatttatctggaaaacatattattagtataatgagattttaatgatttgaaattttgttggagcagcgcagggagaatttcaatcttaactgtgtgtgcagctgggcattgtttctattttattttgtttctttgcttgggcctcattgcaaggacatgtttctacaattattatttagtttttctttcctagagccctgctttgttacagctcttaattttcttgtgtagaagatctgctggagaaaaaagaatatcctttttgtaaatacttagctggcttgatcagaaccagagaatgagcgttgttaccgaaggagacttgtgtttgtttaaggtttactggcgcactctgtggttgccgtggagtggacccaacccagatgtccgttaactgatgagtggataagcaaactatgctccatccatacgatagaatactattcagcaacgaaaaggaatgacatatggatccatgctacaacatgggtgaatctggaaaacaggctcagtgagggaagccatttgcaaaaggataaatactgtgtgattccatttatttgaatatctagaataggcaaattgatagagacagaaagtaagattagtggttcccaaagcctggggaaggtacagtgacccctcatgggtacagggattattttgggggtgacgaaaatgttcttacattgacaatggtgatggttacacagctctgtgaatttactaaaaatcattgaattgtacacttatttatttatttatttatttattttgagacggagtcttgctctgtcgcccatgctggagtgcagtggtgcgatctcagctcactgcaagctccgcctcccgggatcacgccattctcctccttggccacccgagtagctgggactacaggtgcccgccaccacgcctggctaattttttgtatttttcgtagagacagggtttcaccatgttggccaggatggtctcaatctcctgaccccgtgatccgtctgcctcagcctcccaaagtgctgggattacaggcgtaagccactgcgcccagccgaattgtacactttaaaacggcaaattgtatggaatgtgaattctgtctcaataaagctggtaaaaaaaatagcgtggtactgagaggcagcgctcagagcttgtgagatgtttttctccagttggtattcgttgcatgtttccaaggtgagatctttcaccttggggtgagggcgggtggatccgggacagacatggaattttcagtcttcctcctcctcctcatcttcctgttcattgcccctgcagtggtggcagctgtcccatatcaaggtctcacactggccaggggctgggcttggtgctgtacgcagattgtcttattaggactatgaggcttttgagataggtatgataatatgtcctcattgagcaagtgacaataggaaacccccagaaattgtgtgcactgttttgcctgatctcacacactttggacagagactttgatcacattcttaggggcccacaaatggtcaaaaacctctgaactgagacagcagcattttttgtggtttttttttttttttttgagatggagtctcgctctgttgtcaaggctggagtgcaatggcccgatctcggctcactgtaagctctgcctcctgggttcacgccattcttctgcctcagcctcccgagtagctgggactacaggcacccgccacagtgcctggctaattttttgtgtttttagtagagacagggtttcaccgtgttagccaggatggtctcgatctcctgacctcgtgatccgcccgcctaggcctcccaaagtgctgggattacaggcgtgagccaccacgcccggcctgttttgtatttttgagatggaatctcgctctgtcgcccaggctggagtgcagtggcatgatcttggctcactgcaacctctgcctcccgggttcaagtgattttcatgcctcagcctctagagtagcttggactacaggcatgcaccaccacacccagctgatttttgtatttttagtagagacggggttttaccatgttggccaggtgggtctcaaactcctgacctcaagtgatccacctgccttggcctcccaatgtgctgggattacaggcatgagccactgtgcttggcttgggagagcaacttttaaactctctttttattttggatccatggtaagaaatatatttccataaaaaccccagttcaagcatacatttacctatatccatgaataaaagtttcatgaaatgatatcttcctataagcacactgacgtttgctactctactgttctttcatttcattaaagaaacgtgctgtccaggcaatctcagtactttgggaggccgaggcaggaggattgcttgagcccggtggtttgagaccagcctggtcaacatagcaagaccccatctctacaaaaaataaaattagtctggcgttgtgttgtgtgcctgtggtcccagccacaggtgcccctgcaggggcagggggctttcaggtgggaggatcgcttgagcccaggagtttgaggctgcagtgagttatgattgcaccactgcactccagcctgggtgacaaagagagagtctctgtctaaataaataaataaatacatacatacataaaatatgctagtcacagtttcctaaatggattttatgactcattgagtcaaaatgatagttttaaaatgttgctaagagagatgtaaggaggaaaatgtgttggtgagtgttgaggagcccaacttcttttgagaaatcattgttggatctggtgtctcatgtgttaccctggggtttcaactcctgtttgctcattcagttattcattgatcaccctgtcttccaggcatgcagtcattcattcaaggtgattattgagctccccttgagagcaggtatggggctgggggttggagatccagtgagtggtcctgcttgagagactggccctgcccacatggcactagtgggctgggactctcccatcactcttgtctccatcttgttgtgcactgttgatgctccattgaatgatcttggcatctttgctgaaaatcagttgatcatcaatgtatggatttatttctgagctttcaattctattatgttgatcaacaggtctgtctttatgttagtactacactgtctctatcactgtagctttgcagtacgttttgaaattggcaaatatgacacttcccactttgttcttcaaccttgtgttggctatttgggatccctcgagattccgtatgagttttagggcgtgattttctatttctgcaacgagccaccattggaattttgggaggaattgtactgaatttgagaattgctttgggtagtatctttaacaacacgaagtctgccagtccatgaacataggatgtctttccacttccttaagtcttctttaatttcccttcgcaatgttttgtggttttcagggtacgagtctcttgcctctccaggcagatttatccctgggtggcttatgctttcggatgctgttgtcagtgggattgttgtccttgccagtggtcgctgagcccagctgcagccttgtcttgcactgcagggtgtctgtgtcacctacttgcctagttctggccacttttcttgcaggaagtcagaagtgtactgatctggagtaggacccttagcacaacagagctgctccttggtgctaggagatgcgtcctgaggctggccatccatgtcagaggacctggcgcctcaccctcatcatgggatatcactgaccaccagtgggggatgcatctctgctgggcttggcctgcaaggtaggagctgactgcaggagtgggaaagagcccatggcccctgagggggcctacagttggctctcctgtggttacttggcatgtttgatagacgcctgggtctggcacagagaacactgcccgctgacaatcattgagcctcggcaggctggccccgatgacatgttatctccccacacagtccctggacacacttgattaaaggtgcttattactttcatagtgttggctggagtgatgtgataactccacaaaaggttctggcagaatcccagaccttggggtgttcccaccagtgtctctgtgttcaaagttcagcacagtgtggggtggcaggagatgggaacttggagactgaggccagagtctgctgacttgagcctctgctgaggtccttatcagtgccgggagagcagcagcctaatctcaagatggtttagaggatttagcgggggcgtgcatgcagagttgagaactggctcctgggtcggtgtgcggggggtggggatggcccgggggccgtagctacagtttgtcttccttcccccaccggcagaggtgaagagaggtgttttgtcctggagccaccaggcctatccatggaggagcagagcttcacatggagcctgtgccccgtcttagtctatttcgtgttgctataaaggaacactaaggctggctaatgcataaagaaaagaggtttacttggctcctgtttctgcaggctgtacgtggcactggcatctggttctggggaggcctcaggggcttctcctcatagtggaaggtgaagagggagcaagaaagggagaggaaggaggtgccatgctcttttctaagaaaacagaaacacagctgcattattttaagcaaaacacatattggcttaggtcgctgtattcatctcccagggctgtggcaccaaggcaccagacactgggtggctctttgggaggccaaggcaggcagatcacttgaggtcaggagttggaggccaggctggtcaacatggcgaaaccccatctctactgaaaataccaaaattagccgggcatggtggcatgaacctgtaatcccagctatttgggaggctgaggcaggagaatcacttgaacccaggaggcggagtttgcagtgagctgaaattgtactattgcactccagcttgggcaactgagccagactccatctaaaaaaaataaaaaataaaaaacccagcagaagtggattctctcacagttatggaagccacaagcttctaggggttagaattccaacatatctttttttggggaaagaggggcataattccccatagaagagcctgtaatctcagggagccttgacccaggtatttgacgttggtgtaatctacttgtgtatgtgtattggtggacaaaggggatggcctcacatcccttcagcatcttgggggtgggcggtgcctcccctccggctcccctgagtcagccccggggaagaccaattgtggggctggatggtgtgggaacccccagctccgtcctgtctccagccatcagtgaggtgtgcttggccattccccacaggaccagtgggcgggatggggcagctttgcagttggagaggatgggggttcaggcaggcagaacagatgcgcggacacagaagagctgtgcagaatgtggagttgagcttcctggaaggcccataggagaggcgagactgaaatcttcttgatactttttcactggggcctgaaagcctggtgcagaatgaaactgaaagcacttgtctcgttgagcaaatcattcaactttgttatttctgtaattgaaataattcctggcattaattatgtggagagcactcatgaccatgtggacatatcttttgggggcacatgaactgagggtaataatttcgctcgaattttttttttgagatggagtcctgctgtgtcgcccaggctggagtgcagtggcgtgatctcggctcactgcaacctccacctcctgggttccagcaattttcctgctctagcttccccagtagctgggattacaggtgcccaccaccatgcccggataatttttatattttttaattttatttttatttatttattttttgagacggagtcttgctctgtcactcaggctggagtgcagtggcacaatctcagctcactgtaacctccgcctccaggcttcaagcgattctcctgcctcagcctcccaagtagctgggatgacaggagtccgccaccatgcctggctaatctttgtatttttagtagagacagggtttcaccatgttggtcaggctggtctcaaactcctgacctcatgatccgcctgcctcggcctctcaaagtgctgggattacaggcatgagccactgtgcctggcctaatttttgtactttaggtgggatttcatcatgttggccaggctagtctcgagctactgatctcaggtgatctgtccactttggcctcctaaaatgctgggattacaggtgtgaaccactgcgcctggcctatttcactccattttgccgaggagggaacagaagtgtggagtcctcccagccacatggcctcggatccgggctgcaggtccaggctttccggctccagggctggtgccctctgtcctgtgccacttcccctgcaaaatgagatgaaaatgagtctcattttacgatgaggaaactgaggccctgagagagggtgagaaaccaggtctctggctgaatgcacctctcactgaagacatctccgggtggaaatgttctgagagctgctgtgtgtgctggtgtcagaatgaacaatacccatagtgcttggcgtagacaatcagcaaagctagggacccgttttctcctcccagccccctttctcacttcaggccctagacaagaatcggaggtccgtttctcaagtttagctcctgtctgattaaatttgaggttcgtttctcaagtttagctcttgtctgattaaatttggatttgctccactctttttcacgggcataaaaatatctgcggagtgaaaatgtgtgcagaggatgcactgcgtgcaggctgcggctcgaggtcaatcagattcctccagcgataaaaggcctgctgaggaagcggccccactcccagcacagccccattgattggcttttattttcctctgttgctggagtgatccaatttgaagccctgtttctgagcatgttgcaaggaaccctaggggctgccatagccctggagatactggctggaaatcaaattcaaattggtgctttcttcctattaaagcaggagacctctgcccgggaacgggccatttgggggctcagccatctggcacatggagtgagtaggttttattgccaaagccgtcccggccttggcctcagcctctgtgtggctctggtggggagtgtgtctcgatgttgtactgtgaataagccccatgcctacttgagtttggggtttctgttttacctacacttccatattgtgggcatgtggctgcggaaatgtgcctgcacctggactcgctgtcactcactggcttctcgtggtacagcctagggagggttgccccagccgtatttagttcttcctgcctcagatgaacgggcctcctctcccagctcctaatcaggagggcagagtctcgttggcggctctcctgtcctgctgccactgcctttacacttcttcagatatgcggccgtcttaaggtgtaaatgccttcctctgtttcccagtggttatctaaagcaaggattggcaaacagaatccacaccatagatttgaggtatgtttgttgtcctctttccttcttaaactgttagtaaacaagacattcctacaggtgacccctttcggcctttttttttttttaagactgagtttcgctcttgttgcccaggctggagtgcaatggcgccatctcagctcactgcaacctccgcctcccgggttcaagtgattctcctgcctcagcttcccaagtagctgggattacaggtgcctgccaccatgctaattttgtatttttagtagagatggggtttctccatgttggtcaggctggtctcgaactcctgaccccaggtgatcctcccacctcagcctcctaaagtgctgggactacaggtgtgagccactgcgcctggccagtcctgcactcttcaagtttctatgtgttgcagactggtggggtagcaatatcagttagagagacaggactggggtcacttgtcccctgttagctcagtgaccttgagctcagcttagacacattgtctctgaacactgtgctgatggcaacacctctctcacctgtcttgcagtcttatttgaggaattaaatgcaataacctgggagaaagtgcaggtatgaagtcagggcacacagcccgtcaccaggagcttgaaggaggagaagagtgggtggggatgtgagcacagaagctgaggcgggggctgagccgggtgtgtatttctgcctgtgccacagggacacccctttcaggcactgggcgcctagctcctgttgtctcatctcctaagagagtctcgggaggcctgagactccctcactgctgcgggcttcaagagcagcatctgtgctgagtaacagccatgggggcagaagcagagatctcccgtgacagagtagttaggcagccgtaaaaatcctaccaccagctcgtggaaaaggtctcatttgacaggtgccatgccgtcaaagacttgtgctctgcagctgcaaattcccaactgaaaaatatcaacaattcttacgaagagagaaggggagccctgcaaagctgttgtgtcaccccgtctgtttgtaggcgctggggggattgatgatgaggtggggactgttcggctggccacactgccattgtagatagcctgtgactctgtggctggcgcctggctggcctcagtgaagcccttcagtcccagctctgaccatgtctctgtggagagacaagcaggtgatagtgttgggtgggcaaggctgtgctggtggcctgcttagcaacagcaggaaaaggaaggagataaccaccccaacctttcttgctggaaggagcccttcctgttgtcggcgctgtgtgtaaccaatgaggcgaatgccgggaagcgcttggtttgtgtcaatgaggggagaggattgtgcagaagtgcaggaagggaccatgggaggaaattgagtgaaggtctctgttaggggtttgtgttcccctaaaaggtatgtccaggtcctagtctccagcccttgggactgtcaccttatttggaaatagggtctttgcagatgtgcttaagacgaggcctgtctgaagtagggtgggcccctaattcaatgtgactggggcctttatggggagaggaggcaggacacagacagacacgggacacagaggctggacagagattggagagatgctgccacaagccaagatgcaccgaggactgatggccaccaccagaaactgggaagaggccaggacggatcctcgcctggagccctcagtgagagcacggctctgccgacaccttgatctcagacttctggcctccagaactgggagagaatcgacgtctgttgttttaagctgccagtttgaggtactttgttaaggtggccacaggatgcgaatacagtcaccatctggcctttgatcttctaattgcctcggcggttctcctgccagtaagggttgtgagtgaaacttgaaggtcacagttggaaatcaagttaaaagaattaagctggaagtgcaacatgagagtccgtcaccctgagaggcggtgtgaatgccaaacacaggcaggcagggctggacctgcataaattgtggttcgacagcaccgggagaaagaaggcccgggcctgctctcctcacctgattctgggaatgccgaacctacctgtgttcctgatatcaccccagtgctaacttcccaccccttgaaaatgtcaaaacattgtgttatgaatgttcttcattgagcaactgcgatctctttctgtaaagatccagagaatatttcagcctctgtgagccatcctgcctctgtaggaatgaatcaactctgccttggaagcatgaaagcccctatagacagttcataagcatagccgtggctgcgtccccctgaagctacaaaagtaggtggggggctgggtgtggtggctcatgcctgtaatcccagcactttgggaggctgaggcaggcggattgcttgagcccaggagttcaagaccagcctgagcaacatagcaagaccctgtctctacaacaaatacaaaaattagttgggtgtgttggtgctcacctgtagtctcagctacttgggaggctgaggtgggaagatcccttgagctcaggaggttgaggccacagtgaactgtgattgtgccactgcaccccagcctgggagacagagcaaagccctatctcaaaaaacaaaacaaaacaaaacaaaacacccaaaaagacaggtggtgggccagatttgctcactggctgcagtttgccaatctatggtttaaaccaacaatttaaataacacacacacatctttgtatgatgttacacatcttttttttttttttttttgagatggagtcttgctctgtctcccaggctggagtgcattagtgtgatctcggctcactgcaacctctgcctcctgggttcaagcaattccccttcctcagcctcccgagtagctgggattagaggcatacaccacctcgcccagctaatttttgtatttttagtagagacagggtttcaccatgttggccaggatggtctcgaactcctgccctcatgatccgccctccttggcttcccaaagtgctgggattacaggcatgagccaccgcgcccagcctgatgttacattttctagaagttctcagtgatgggcatttaaaggattcggctgctgctccctgtggctttcacagcgctgccctgaatgggtgttagggcaccgtacaggtagcggggatgcctgggaaagcccagactcacagcaacacaacaacagttaacagactccagtgaccaaatgtgtgggtttttcctgcaccaactggcggataccagctggatgtcccctagttcaattcaattcagttctgactccacctacctggagatggcatcagatcccacagggtgagggctcagtctcccaagactctgaacagtggctgtaagtcagggttcccacagccccatctttgggttcaattaatttgctagggtgactcacagaactcggggaaacatttacttatatttcctggtttattataaaggatattacaaaggatacagatgaggagatacatagggtgaggtgtagggaaaggggtgcagagcttccatgccctctctgggcgtgccactttgccaaaaccaagcatccagtctctggaagctccctgaatcctgccttcctgggccttttatggagcctcattggatatgcacgattgacagccatgtagaaataggattggacagcaagggtgtgatctaacactaacagatggactggggaggccctgcaagacctatctgtgcagccttccttcctccaaggtgtgggggcccctctctggagtgagggtctcattacttacaatctgatgagagtcctgccttgggcaggtgaaaggagggcagaaggttagagagattctgttttctgaggctaaagtgccccaacatcttttattattattattatttttgagacagggctggagtacagtgatgcaatcttggctcactgcaacctcacctctcgggctcaagtgatcctcccacctcagcctccctagtagcaggcactacagccgcgcactacaacgcttggctaacttttaaattcttttgtaaacacaaggtcttgctatgttgcccaggctggtctcgaactcctgggctcaagcaatcctcccgccttggcctcccaaagtgctcagattacagcatgagctcctcagctagaagagttaaactcatagagagaggaagtggaatggcagttgccaggggcaggggttgggggctgggcagggaggggacagggagttagtgtttctgccttgcaagaagaaaagagtttggcggataacagcgatggtggcacagcagtgaatgtccttagtgccactgaaccgtacacttaaaaatggttaaagtagccgggtgcggtggctcacacctgtaatcccagcactttgggaagtcgaggtgggcaggtcacctgaggtcaggagtcttgagaccagcctggccaacatggtgaaactccctctctactaaaactacaaaaattagccgggtgtggtggtgggcgcctgtaatcccagctgctcgggaggctgaggcaggagaatcacttgaacccaggaggcagaggttgccgtgagccgagattgcgccattgcactccagcctgggcgacaagagtgaaactccatctcaaaaaaaaaaaaaaaaaaaaaaggttaaagtgagaaattttatgtattttatgttaaatgtaccttactacaattgaaagaatgaaaaaaaaatactgggaaatacattacacatacaaaagagtgtacatatgtatagtttactgactaatattaaggaagtacccacgttcctgctatccagcttaagaaataacattacctgttccccgagccatatgccccgtacctcctgtgcgcctccctccccaccagaggtgaccagtgccgccttgaacgttgcatttagcatgttgtattagttagagttctctggagaaacagaaccaatgggagatatgtagctctctctgtctctttttttttttgagacagagtctcactctgtcgccaggctggaatggtgtgatctcggctcagtgcaacctctgactccctggttcaagcagttctcctgcctcagcctccccagtagctgagattacaggcactggccaccacacccggctaatttttgtatttttagtagacacggggtttcaccatgttggccaggatgatctcgatctcctgacctcgtgatccgcccgcctcggcctcccaaagtgctgggattacaggcgtgagccaccgcgcccagcctgtctctctgtctgtctctatccatctctctctctctctctctctctatatatatatatatttgaagagattgattataagttattggctcatgtggttacgagactgagaaatcccaggatcttcaagctggagacccaggagggccaatggcgtcagcccaagtgcgggaggagacccacgtcccagctgagtgaatccccttaccctgcctttcggtctattcaggtgtcaaatggattggccgaggcctatccgcactggggagggccatctgttgtacccagtctaccgattcgaatgctaacctcatctagaaacaccttcacaggcacgcccagaataatggttagccaagcaccaggccgctccccacccagtccaggcagctagtcagcaggccctgccccacttgcttgtctttccttgcgttttgcacacgcatgcatctctgtccctcactttctttagttttgcccgactttgaccccaatatgacgggagccccaccgtgcgtgctgtcctatgactcgagtttacgcagtagcctagctttggggcacagccccatttacttggggcaccgctgcctctgctgtgtggccgtgtgggatcccacaccaggagcaccgtccctttgtcacctgggaggggtgattctgtgcctgagttgcatgtggatttcctcctgctgagttttaattaagaggcagggagcaggtgggtgaagggcacacacacggatgcagcgttgcccgggttcgaattctgcctgcgccatttcctgcctgctgaaccagatcggacaaattactctacctctctgtgccacagattttttgttgttgttgttgttttgttttcattttgtctcgttttgtttttgtttttgagacaggttctccctctgtcacccaggctggtgtacagtggtgcaatcacggctcactatagcctcgaccctgtgggcttaagcaatcctcccacctcagcctcctgagtagctgggacgacaggcgtgcacagccacacctggctaattttttaattatttgttgagatggggtttcactatgttgcccagggtggcctcgaacccctgggctcaagtgatcctcctgcctcagcttcccaaagtgctgggattaagtgtgagccacctcatctggcctttgtgccccagttttctcaatcaggtaatgatgatagctctcaggtggtgagggtgactgtataaaatgtctggaaatggcacctgctctgtgcccaggggttagaggcttgggaccgagctgggggctgagctgggggtggagctgggggctgagctgggggtggagctgggggctgagctgggggtggagctgggggctgagctgggggtggagctgggggctgagctgggggcgtttttgttccaaggctttcttgctgataagtttctctttctctctctctcttttttttttgtcctgcgtgtctcaacctgacaaaaatgctcagtttagaagcgtgtcgttccatttgtgggaaaattaaacacatttaagagtaaattaaattaggggacttgtgatcattagctaagtaaattattttttaaaaatgtgatgtaccaagcatagcacatgtggcacgctcaataaatatttgttagaatgaatgataattttatgagccagtcgagtcatatataatgggattatttggttctagaactaatgaagtgactgtagagcaataaagcttctaaaaagaatctccgtgctcgcaaaaaatccaaaagtgggggaagaggctcatgctggatttcacccaagagcgaggcccgaggagagctgggacgctgtgtcctgagagctgtccaaggggggcccttgtgacttggcaggggtggttttggagcctgagtttatccgcactctgggtggactgggtctcgggggaggcctgccttaggtcagctcaggagaccagtggatatagcaggaggcccacttgcagttcacggtttgtcttgccagatgtgcagggggcccggtgtctcagcacttggcacctgtgggactgagagaggagtcagtctagcaccagacacccgcttggtgggggaggggagtggaagaggagggagaggagagagagggggctggagccccagtcccacagcttaggtcctgggaagccctgtgggttcatgcttgccttgaggggaggttggacggctcaagcagggaccaggagcctcccagtgtggcatgagctttgctggaagcctgggctctttgagaggggtggggctgagagccgctagacctggcttcatcctcctgcctgctttcctgtctggggtgtaccctgggaagggacataacttccctgaacctcggttgcctcccctgtccagtggaggaaaggaaggcacctgcctaactgggctcttgaaaataataaattgagataatacaaaatctgcattaatttcctaggcctgacataaaagagtaccccacactggctggcttacagagcagaagtttattctctcccagctctgaagaccagaagtccaagatcaaggtgtcagcagggccttgctccatctaaagtctccagggagggatccttcctgactctcttggcttctggggacggtgggcagtcctggcatatcttgatttgtggccatgtcactccagtcagcctccattgtcacaggtgtcccccttcatgcccctctgtgtcttcctatggtcttctctctgcatgtcagcatccaaatttctctctcccatgtggacaccagctgggcccaccgcagtccagtatgacctcatccgaacttgattacatctgcaaagaccctgtttccaaataaggcacattctccagttgtccaattccaggtggacgtggatttttttttttttttttttttttgagatggagtctcactctgtagcccaggctggagtgcaatggcacgatcttggctccctgcaacctcctcctcccgagttcaagcgactctcctgcctcagcctcctgagtagctgggattacaggcacctgccaccacacctggctaatttttgtatttttagtaaaaatggggtttcactctgttgcgcagggtggtcttgaacccctgagctcaggcaatccacctgcctcagcctcccaaagtgctgggattacaggcatgagcctctgcgcccatcggacgtggattttggatgagacaccattcaacccacagtacctggtgctcagttagtgactaaaacccactagttatggtcactcagtcacccttcttgttattactttcatagatgagggtgtgatgggggggggaaacagaagcagagttgattgtatcttcttagttctgcacaccctgtggcttttttttttttttttttttttctgagagggagtcttgctgtgttgcccaggctggagtgcagtggcacgatctcaggtcactacaacctctgcttctcacatttaagcgattcttctgcctcagcctcctgaatagcgggcattacagacatccgccaccacacccagctaatttttgtatgtttagtagagacggggtttcacaatgttggccaggctggtcacgaactcctggcatcaagtgatccacccacctcagcctcccaaagtgctgggattacagacatgagcctctgtgcccagccccgtggctagttattagactgttctaggtcttgatgggaaaggggaggaggacttgttcttctctttggattaataaaacaccgtgaggcttgtgtttgcacagtgcccacagcttgcacactgacaagcccttttaggttgacttctgctgagtcatttcatcctgttccatttgtcagccataaggtaaggagcagtttttctgatgtactccttttgcataaatgctactctccatcagcctcgagaagtagaaggcaccggtatggtatcccaagctcattcacaggggagaagagatgcctgttgccacaaaatgtgaatgttgggtgtacattcaggtgtcacgtacgtggtgttgattgtctcagcttaataaagaaagatgccgtacacattttcctttaaaaagtctcacttggcttgtttgacaggcacagaagatgtgttattaaacacttgcaaagcctgctgtcatttggttttaaacagcactcgtcgtctttggcggggcgtgtttgctcagcatcatggaagggggatgtgaggtacccaggtggcagtttctctaccacgatgctttctctgcttgctatcgggagaaatgttctttcctatgttgtgggaaggcggaaagggcactctgaaatgtaaggtggccttttgtattagaatttcatggctgagaccaggcgtgggggctcatgtctgtcatcctagcactttggaaggccaaggcaggtggatcacctgaggtcaggagtttgagaccagcctggccaacatggtaaaatgccatctctactaaaaatacaaaaaattagctgggtgtggtggcagccacctgtaatcccagctacttgggaggctgaggcaggagaatcacttgaacccaggaggtggaggttgcagtgagctgagattctgccactgcactccagcctgggcaacagagagagactctttctaaaaaaaagaaaagaaaagaatttcatggttgattgtcacaggaccatctttagtcccaagatctgaggcaagggaatcgttttcaataggaaacttttaaatgtttgagcagcagaaagggagattgagccagaagaacttgctggtggaaagatggtggaagctgggagctttgaggttctaaaaatcctggtgtgtcaggtcaggtagtggggcaaccggagcttagggtgagttatacctgatgggacttaactgggtaaatgtcatctagtaacccaactacattcggcattaatatctggacaaaaggtggaatacacccgggttctttgggcacaggcgaaggagaggtctcatagtttgatgttgctcaagaagggaaaacaagcaggatgggaagaggtctaatcagccggctggagtggggtgctgggtttagttcattccttcttaaactcagccagttctcattattcatggtggttttgatctataaagttgccacaaaccccaagttagccaatactgagccatcactcctagggcagtacagcgctcggttcctgcgagcctctggtcacaacattttcagcaacagatccatacataactttttcttatatatgtttctttttaaagatacgttatttaaaatgtattgttgattgattaacattgagctcacggccaacagcagtataagtgctgcctgaatgaagcttctctgacctgtgcgttctctgcaaggcatacctcagccttcttgcacttgggaacactaggagtacccctcgccacgcgtggggacccattttaaacagcaaagttggctgggcacggtgactcatgcctgtaatcccagcactttgggaggccgaggcaggcagatcacctgaggtcaggagttcgagaccagcctagctaacatggggaagcccagtctctactaaaagtacaaaaaaattagctgggcatggtggtgtgcttctgtaatcccacctattcaggaggctgaggctggagaattgcttgaacccaggaggcagaggttgcagtgagccgaagtcacgtcactgtactccagcctgggcatcagagcaagacttcatctcaaaaacaaaacaaaacaaaacaaaacaaaacaaaccaaaacagtgaagtcaccaacaaatagcagaaaaatgtgaaaaacatggcattaaatagaccatgaaatggacacttgtttatgatgtgagacctcagacaagaaggcagagcgccccgtgtttgacctcaggtggggacacatccggcaactcagattcttttttttttgagtggagtctcactgcgtcacccaggctggagtgcagtggtgcaatctcggctcactgcaacctctgcctcctgggttcaagcaattctccagcctcagcctcccgagtagctgagactataggtgcgcactaccacacccagctaatttttgtatctttagtagagacggggtttcaccatattggtcaggctggtctcgaactcctgacctcaggcgatccacccgctttggcctcccgaagtgctgggattacaggtgtgagccaccacacccagtcagattctttgcttctgtgtgcaggtctgtgaatgaatgtaggccaagagtattgattctgagcttacaaattttagccagtagacacatttacacatacagaatccatgaatcaaggcgattgactgtactttgacaattatttgtttagcactgtaggaggaacctgcaaactgttccttccctctgctcacatactgcccagggtaagacttctgacaccagaggtgcagggatgcttcctgccgcacctggcagttctccagcagacaccagctgggtgtcctgcagttcagttcaattctgacaccatcgacctggagagagcctcagaccccacaggtgagggctcagccccacgagactgcaccccaaatcagggtccccacgactgcttcctcggttttgattaatttgctgggactcagaacttggaaatgggccaggcacggtggctcaagcctgtaaccccagcactttgggaggccaaggcaggtggattgcttgaggtcaggagttcgagaccaaccgggccaacatagtgaaaccccatctctactaaaaatacaaaaattggttgggcatggtggtgggcactgtaatcccagctactcgggagactgaggcaggagaattgcttgaacctgggaggtggtgattgcagtgagctgagatcgcaccactgcactccagcctgagcaacaagagcaaaaccctgtctggaaaaaaaaaaaaaagaactcagggaaacactgcatttgtgctccctggtctattataaaggagatgataaagggtgcaggtgagcagaacaggaggaggcacacagggtgaggcctgggagggcccccagcacaggagcttctgttgccctggagttggggtgtgccaccctcctggcacctggatgtgtttacccacccggaagctctctgcaccctgtagttcagggatttttacggaggcttcatcatgtaggcatgtctggttattagttcaatctccagcccctctcccctttctggagggtggggttggggggtgtggagctgaaagctccaggcttctaattgtgtctgggtctttctggtgctcagcccccacccaggagccaccaagagtcacctcattagaataaaacatccttttatctccctggaaattccaagggattaggaactttgtgtcaggaaccagggtcaaagactaaatattagaacaaaagattgtcctggcacctggaaattacaaggttcttaggatctgtgtgccagggactggtggcagagaccaatatgaatatttcttttcttttctttttttttttttgagatggagtctcggtctgtcacccaggctggagtgcagtggtgtgatctcagcttactgcaacctccgcctcccgggttcaagtgattctcctgcctcagcctcctgagtagctgggactacaggtgtgcaccatcatgctgggctaatttttgtatttttattagagacggggtttcactatgttggccaggctggtctcaaactcctgacctcaggtgatccacctgtcttggcctcccaaagtactgggattacaggcgtgagccaccgcgcctggcccaatatgaatatttcttattattttacaagcacttgcggtgtgtcctgtggtctccgtcctcagcgtcgtggtttagagggtgcctgacaggcagggtgtggggttagtggggttggggagtgatttccggggcacagtgatccccagagtatgtgtggttgtccagttcactcactcctcgtggcctgctcggtgctgggggtccacactcacagagggcatggtctgtgccccttgggatcaggcagctgctcctggtacagatgagttgggagatgacttcctccagggcatgtgagaagctctcaatgaccaggccagctcggattcccagttctggccgagccgatgtgctctctgttgccacattccgtgtcacttcccaggcctccccggcttcccattctcggggccaggtgttccgtggatggggtgcggtgcggcctttgataccagaggcctgggatcgctttcctcctcggtttctgtgtggtcagtggcgccttcacctgtctcatgccctgccatgctgccatgcaagggcagagggctggtgttggggtggtgctggggcctggggagtggaatatcctgctctgttaagatgctggggatcgcatgtgtgatgctggccacgtcagccagtcttccttcctgccgagaccaccagccctcggtgcagccagccgtatcacctggttatagtcacgccgaaacccagctgtttggaagcgtggccgtggggccttggatcccttttcctttccacgtgttttgtggagacgaataacacaggcatgcgccgtgcccaggtggaggcaatgttaggaaagcaggaaggagctcagagcaggaaatgtgtgtggactcgcgtttgttgaagggcctggccgagttccccagaggctggggtcagtgttcaagttctgatgcttcacgtccttggaggccaaaggacgtgaccttgaagaaggggcagttctcacctgtgggcctaggagaggtcgttggccttaagacattactccaggtaattatatgtggttcctacctataatcccagcactttgggaggcagaggctggaggatcgcttgagcccaggatttggagaccaccctgggcaacaaagtgagactcctgtctctacaaacaaaaacaaaaacaaaaacaaacagttggctggatatgatggcatgcacctgtagtctcagctactcaggaggctgaggtgggaggatcacttgagcccgggaggtggaggccacagcaagctgtgatggcactaatgcacttcagcctgggtgacagagtgagaccctgtctaacagcaacaacagcagcagaacattaatccggatagttctaggatgagggttctcagagctagatgggcctttgcaagttctttccactgatccccaggtttggttgattgtatgaaaccaagaggaaatgtacagggtttttgtgaagaaaggaaagtgtcatttctttgggttttactttgaatggcattggatgaggtcctcagagcttatgtggggccagcccagcctgccccatgtgccccactgagaccctggaaacttggctttctcccactgctcccccagtgctcactgactagttttggggttttgtggggaccctttgtctatctgcttcgtcttccccagatgaatcaggggacgtggtggtaccatagtggtgctgagggcagcttctgggtgggggttctcagaaggagaagtctgtccaggaagattatattttattaccttctccctcatcttatttattttctgtttttttagaggctgggtctctatgttgcccaagctggtctcgaactcctgggctcaagcgatcctcctgcctcggcctcccaaagtgctgggatgcaggtgtgagccactacgcccagcctcccacctctttcttatttctttattgtttatttcaacaggtttttggggaacaggtgtgtttggtgacatgaataagctctttagtggtgatttgtgagattttggtgcacccatcacccgagcagtgtacactgcacccaatatgtagtctttttatccctcacctacctcccaccctttccccaagtccccaaagtccattgtatcattcttatgcctttacatcctcatagcttagctcctgcttctgagtgagaacatacgatgtttggttttctattcctgagttacttcacttagaataatggtctccagttccatttccatccaggttactgcgaatatcattattttgttcctttttatggctgattagtattccatggtgtgtgtgtgtgtgcatgtgtgtgtgtgtgtgtgtgtatacactgaaatttctttatccactcattgattgatgggcatttgattggttccatatatttgcaattgtgaattgtggtgctataaacgtgtgtgaagtatgttttttgtctgatgacttcttttcccttgggtagatacccagtagtctcctacttctttttaaaggaagccttgctctttcttaaaagctgctaaaaaggaatgagagtggcgctacagcaaacatctattgagcgcctactgtgtaccaggtgggtggctatggtggaatctaccacttcttaaaagtcaccatccaagttaccgtttttctgaaatactttgtctttcaactgagtgctttgtttttagtgatggccagtgaagggcccaattcaaacagaagcagagccgggggatactgaagggcctttctccctgtgagccccttagaactcaggcagaaatattttagcaaaaagtcgaatctgtacttctctggcttttaatgggttatattgaaaaggatatgacctgcctctaaggttgtaacttacgtttggctcagtcttaattatcttaacaaggggtgcctccccacccatcatccccataccttgtatttatgcatgtattgacttttctcccactttgatagcttgaaggcagggctgcagtgtttctcaccttggcaccccaggcttgagtgatgcctggcacacagtaggtgcacggcacacatctgagttgagatcctgatacgcaccctgtataagaccttcaacagcctgtcgaccactcactgcctccgtttcctcatctgttagatagggatgatcataagggttctttcttgcttgccttatggggccttgatgagaatcaaatgaaatgatgacatcagtcccttaattatttctcctcctcctcctcctcctcctcctcctcctcctcctcctcttcctcctccatctcctcctctcttcttcttccttttttttcttctttcttctttctttttcttcttcttaggcagggtctcactctgttgcccaggctagagtgcagtgggatggtcataggctcaagtgatcctcctgcctcagcctcctgaataactggaactacaggtatgtgccattgtatctggctaagtttttgtagagacagggtctcactatgttgcttaggctggtctccaactcctgggctcgagcggtcctcctgccttggcctcccaatgtgctgggagtacaggtgtgaaccactgtgccaggcccctttaatttattctgaaaatggcgtgtcaggagctgggtcttggctgccttgcttgcattgtgaaatccccttgcctggcaggtaggaggcagtcgatgcatacagggtgagtgaatgaaatgttagttagttgcattacattgaagtggtctaaacctgactctaagatgtgactactaggctgctgatccttttatgatttttcaagtgcgtagttattttccttttaaaagctaatcacatttcctttcctgactgatcctctgttatttctgcctcctcccccaaggggctgaccaccagccccaggcatctccttggccagctcagtggatacacacacgtcaggaagaccctcccttgccccagccttccttcgtgggtggcactggacactgggcagatggaaaggccctctccatggagcactgggctggcgagggccttcctgtctgtgccctcatgatgtcctcacttggctgtcgaggcatctcctgggccatgaagtgctgtttgctgtcctggccttggattcctgcatcaagtctcccagcaggaaaactgttaaaccaaaaccagtgttgggaactgcatcagagctggggaccacatcagtgctggggacctggatcagcattggggacctggattagccctggggacctgcattagtgctggggactcgcatcggcattgggtgtctttttgttgcttcctcaagtcctagttttgactctggatgaagcttggtttgtgccgtgggagtggagtgttgggggacaggggtgaccggcgggtgagccctcactgttgatcctggcctcgaatgggagaggggcactagtgcccctgggagtgggccaggcatgtcccagtccactgcctgccccagagccccgcctggagcacctgctgggtcgggacatgggcctcccgtgggcctcaccgcttcctgcttcagcagaactgggattgtcagttaatcgagcaacacctccaggaagccagcctcaggaaagagcttccacagggagttgggggactggtaattggaataaataaaagctaatcgtgcttcctggatgccaggaaccactgaaatttgtggattcccacagcagcacatgaggctggtcattgttaataacccctttttaccgacgaggaacccagaccagacagagagcccgcctgtgtcacctggtagggaggggctgggcctggtgttataaaccaggagagggttcaggccgaggaaagggggagcaagttgccggccaaggtaggtatcatgcgagtcctacttctcccctcattcaaggaccttcctttggggaagtgagtgctcccgagagcagcctgccgcctccgtgtcggggcagcctcagcttcttctttctgtgtccgatatttgatttctgttgtcgtggaaacggggtggcaagtgttccatgtgttagcatttggtcctcctgacgtagtcggcacacgggagatgcagctggggtggcacgtgcccacagtggtgccacctcttgccgggggtcaggcagaggagacccagctccgtgccagcttgcagacccccaatcacttctcctgtctcagggcccagagagcaaaggcagtgggaggccaatgtctgttgttcagtttagctctgagccacgtgcatcttcagtcagcccaggggcctgggcgcgcccttccttccttctttgtgcatgggggttttcctggggagcagttgccctggcccatgaggctgatgggagtcaagacagaaatagtggtctgtggtcagcaaggagctatcgctggaaacaccccggtccttccacagcctgaccctctgtgaccttcctcaaaggctccccaaagaggctttcccttgaagtgcaagtcatagtggcgcccctgccacgtccctatatgaacggggtgtgtgcccgcctgccctccgacgtccgccggctgtgctggtctgcagagctgccgccagctgcaccctcctcgccagtgagttctgttgctttcgtatcattttcagcaggagctaaacccaggccagcccttcttttcttttctgctttatggcagaattttgttttgcaagaatggaccctgggtggctgcttgacttttcccaggaaggtgatggggacgttggtgttaggacgatgggcaagggggtccaggttgtctcactgcggccccagagggatgagggtctgacttgtggagtgaaatttccagcactctgctgggggcgagtagatcattgggcccagaagaatgggatttggaacattctcaggcacatgctgcaattaagattttctttttcataggggtacctgatactgtgggtttctctctctctgtcttttttttttctctctgagatggagtcttgctcttgtcacccaggctggagtgcaatggcgcgatcttggctcactgcaacctctgcctcccaggttcaagtgatcctcctgcctcagcctcccaagtagctgggattacaggctcccgccaccgcgcctggctaatttttgtatttttagtagagacggggtttcatcatgttggccaggctggtcttgaactcctgacctcaggtgatccacccacctcggcctcccaaaatgctgggattacaggcatgagccaccgcgcccggccatgggtttctcgttagtggtcttcggttctgtgtttcccctctaagtagctgatcgtggccggtgcctggctttcccctggtcaccactagatattctgtcttgtctttgggaggcagagtcagtagaaggtgctttgcactgggcatgcctgggagtgagcccagccttgctgttattagcgcccatcgtgacggtcggccaggctgccctatgttcgatttttcctcctgtgaaatgggaacaacagtagagctgatgtgtcctgggctttctgcatcccagggactatcccagctccttaacgtgctttgctcagtgctatcctcctaaaaagttttcttttacagttgagtaagctgaagcccagagaggttaagtaacctgcccaaggtcacaccgcagatcggaatgggagtcaggagtgtacccaacagcctggctccctagtcagtgctctcaacctcagcttgaaggccgcctccctgggccctgctaggggacccagtaagatgacagttattcacattctcctttgtttctgataccaagcaaactcctggtaaatgctccttccccacttttgtggaataaagaatgcacatttttttctgagctctgcctgggtatccttaaggagagggacgctgtgcctgggacgcagatgaacaagataggagctgtttcctggaggagctcccaggctgatttttgcctttgatgttctgcatctttttcacaggctttttgtagatgtgtggggatatttctagaggagaaaccagaggtggaaggaggggcataatgaaattgaatgctgggcatctcttagctcacattatatgaggctcttcagggacaatagaccttgcaataaaaggcaaaaaggtgattgcgcacagagtgcttttcctgcacagtgctgggcgggatggggtggatggggcttggcggctggaggagggtagaccctgcccgcacctcctgggacctgtgcgggactttgctcaccttgctgtttctaaccaaggtaccagattctcttcactcaggtgtgtcagattttaacccttgaggctagaaccttgccaggcttattcgaagtcagtggttcctagtagtcacagggcccctgccctagaccccagaccaggaccccccggcccctgcccgcccgccttggcctggtggggtaggagtcactgtgaaaggggtcctggagcccagtatcactccagcgacatttcccagagagcatcctggggccagtgtggggtgtgggggaacagatactgagcgctctgtcccctccccttggagaatctcacagtacattagcagagtcaagactctgagaagtccggtaggaaaagacacctgcttagcttcccttaacttcacgactcctccacctccttgacctttgcttgattcatgtgtgacctgtgaacgtctaaactgcaggactcactttgggagatactgatggagaccaaataggtgtcctgctcatatatcctccacttcttcagttttgctcaggatccactgggcttcctaaaatgcaaacgaattgaaaagctgtgctgaatgtgtttttctctgtctgaaagtacagccacccacgaaaggaggaggtctgctaagttttcttttagaaaaggggtccccaggctctgaatgcttgaggacctcattgggatcaccccctccattgtgggctacccatcctccacccgctgtggcctattgataacctcccagccaccacctatgctcctagaggccctgactggaatccctgtcctcaccctgagtttgtcacctccttccaaacttcgtgtcctctgttgcagttgaggacctggaagtcatgattgggctgattagtgatgggtgtttattttgaattcttaactaaacaaggaggaatcacatcctagctccgtattttactagttatgggaccttgactttcccaagatctactttccttgtcagtaaaatggcaataatcggggtaacccataccctgattgctgagaacccctgtaggcgtccatgcctggcccaaagccaggacccaggaagggaggcgcagctgggcggcctcttctgcgtctctgccagttgctggcttggattctaacaccctccttccctccctccctcgctctctaccagtgggatctgagaccatgaaaacgtttgaaggtttctcaagcgtctgtgactgccccacgtctgtcgttgggtggaaaggactttgtaattgaacggagtcagttgtaatgtgaatgtcatgtggagctgcttttccttggcaagtccttgctgtgtgagccattgtttccagatctgtagaaccctccctaccctgtccccctttccgggctattgggaggctgagcgagctcatcatgaggcccctgaaagatagtttctgtgccctgtggagctgagtccccgagtctctgtccccacctcacaggccccctctcaccaccctattgggttggtaaatttcaagttgggcatcagataggacaagggaaggggactggagaaggaagagccgacagtttgccctcaggacttcagagtcactcttttttgtttggttggttttttgagatggagtcttgccctgttgcccaggctggagtgcagtggcgtgatctcatctcaccgcaacctccatctcccgggttcaagcgattctcctgccttagcctcccgagtagctgggattacaagtgcatgccatcatgcctagctaatttttgtatttttaatggagacgggggcttcaccatgttggccagacttgtctcgaactcctgacctcaagtcatccacccaccttggcctcccaaagttgctgggattacaggtgtgaaccatcgcgcctggcccagagtcaccctttctttttgtgccttattagacatcttcctgctacaggatagcccagaagaaaggaacaagtttccgtcatgaataagtcccctacctactagggatgtagggataaaggactggaactctctttcttcaccctgcagggcaaactccttcaagactcagctccaggaagcctctctggactactacactccctcctgagcccccagccttctcacatacctcccttatgtgtctcctgggtgctggagccctcagagcagggcctgtatctaagtccccctgtggcccacccagtgccccgtgccaggcctgaccatagtggatgtcactaagcagttgttcaatgagtgaatgaacaaatgcaaactaggcccaatcttatcaaattatactagaataattgtataaaaaaccagacttctttaagtggaggaaatttaaagtcagaagtgggctgggcacaatggctcacacctataatgctagcactttgggaggctgaggcgggcggatcaccggaggtcaggggttcgagaccagccagcctggccaacatagcgaaacccgtctctattaaaaataacaaaatttagctgggcgtggcggtgcatgcttgtaatcccagctactctggaagctgaggcaggagaatcacttgaacccaggaggcagaggttgcggtgagcggaggtcgcgccattacactctagcctgggcgacagagtgagagtcagtctcaaaaaaaagaagtgaatgaatacgaccatacctgcttttccagctcctgactcttaaacgtctcgaataccaatgccaaataaagggaaccgagagatgaaaggtgtcactgtcctgatcttcagatgcagaaatttctgtgtagctgaggaggtggggcccgcttgcccccctttgaattttgggttgtgcttgagcagaagcattcattgcttggagaaagcagaggagaccccagaagcacttccctctgaaagggagaagcaggtaggccaaggcagcggttctgggaccagctctggggccacctgcttttcccacactgggtctgtggtgggctcggcagctggcctgcacacaggagatcctcaaaacagatgagcgagcatgattgccatttttacactccctcatttaatccgcagcactggaggaggtgtgattatggtgtgtattttgtgcagccatttggtggacacctaccgaggacccgccgtggggcaggctgctggctgggctctgaggatgctgacgaggacccttctttgggatcctctgttcgggttgaagacagtttatgaaaacataagataacagaatggccgactctgaggcaggagccaggggtgtgtgagtgggggtcctggaaggggtctctggaaaccagaggaggagtggtcctctgaggctggccaaggctcccagcagagagacgggggcatgggcagaagcctgtcgtgccagtgagccctggcatttctgagcccctgatcggttctgttgcctgcacgacggcctgggtgagcaacactgacaggagacccctgccttagtaccatgtctcctgggctctggctagtggcgcctcctggcagcagctgcccaggccacacaggatgctggctacatgcttggctggtctggccatccctgcatggccccgctgtcactggtatctggagatcacacccagccagagcctagtgccaccctcggatgcttccttggggagggaggatgccctgtttccatggcaaccctaggtgggaggccagggcttcaggcaagctgctgagcttttcacagccctgggagtgaggagcagggcaggctgaccctggcctgtggggcagaattagtagaggaggagccccaccatccctgagaagaggaggggagtggggtggggaacattagacaatgttcactgcccctccctcagcttcccagctgcccacggcagtcccaggccaggccagtgtgggcgtggggggcagttagagcgtggccgtgtggtgtgccagcacgcagtgcaacagccaagacaatggagtcatcccctgcccctgggcccttccctccaccccacctcatgtctgcactaggtgaggaagcagaggacggaggagcccagtgggctctgggagctcctgggactcctgagtcggtggggacggggcttcccagcctcaacactgaggattcttggttgtggagctctcctgagcattgcggggtgttgagcggcatccctggcctctacacacgaggtgtcagttgtgacaacccaaagtgtctccagatgccactacgtaccctcccagtgtgggggtggaggaatcgtccccagttgagatccgctgagctgagaggctccccggaagcaggtggtgaaggaagggaaggccctgggccctggagacatggatgcctgcctgggacacacacaaacacgcacgcacatgcacgcatgcatacactcactcatatgcacacatgttcatgcatgcacccgcagtgaccctgaagggactagactatttttagagcacttttaagttcacagcagaattgagtggaaggtgcagagatttcccgtgactgcacggccccaccacgcacactatcaacatcctccccctctaacaacgtccagaccagagggtgcatctgtggtacctggtggacccacatggccatatcagggtcacccagagtccacagtttccatgaggggcccctcttggtgctggacattgtgtaaggacagggacccccatggtagcagtgacactgccctgagatccccgtgccccacctgctcatccctgtctccctctcactcctggcaacctctgctcctttcactgtctccgtagttttgcctgccccacagggtcgtgcagttgggatcacactgtctgcagccttttcagactggtttttcactcagtgagatgcatttaagtttcctccacgccttttcacagctgacggcgcgtttcttcttggttccaagtggctctttctgcattgtctggacggatccatttgttccctgtttgcctcccagaggatccgctgctcttgctgcagatgtatagcccaggtgctgtggagttgggatggagcagtcgagctgggatcagagcccaggcccctgccctgaggttggagctctctgactgcacctggcctaggcctgtgcattgtctaaactgatggccgtggggcaggggacctggagcgcaaagcaggagaggatgctgaagggggcaggtggggccgggacttgggagtgtctggaaggaggaccgcctgcctcaacccagggctggtctgtggaggccagagcgctcagcccctcaatgctaggcctgttgtgagtttctccatgaggtggccctctcagaaagagtggctccacagcagctgagttgggggccccatggcagctgagtcgtggactccatggccgctgatttgggggatgcctgtccttgtagagactgtcacctctaggaatggtgaaagggcggccacccgcagccctgtgtcctctttctagtcctctgtcttgtaagcccggtccccacagtggccccagtcctcccctgccagaaattcgttctcctcagaaatccgttctcctctctgatctttcaggcctagagacaggctcttccctccggagggtgcagcccaggggttctggtaagatacagagcccagcctcaacatagcaggaagtttttccacaaatacacagttcttcaagaccacatgcagctgtgcgtggggtgtgttttgaagggcaatggcaggagcagtgtatgcctcgtggtgcagggagcacgagttgtttataggcgtgcctgggtcctgggtctctgtgcaccctcctctagattcatggggcatctgcccaccgtgagatagataagccagggtgcctgcccctttctcaggtgagatgctgagggccagaaacatgctgctgtgtcccatggaggaggtggcctgccccaactcccctgcaccctagggagagtgcccacaggctgggggctggggctgggtcctgtgccccctccccagccctcggtatgtggctcgctgaggtgtgcgccggaatgttgggcacatcctgtctgataccagcttggctggaagtcgaattatgatcagaatatcacatgatgtgtggcctgggtccccctttggttgacactcttgagtatgggtcctgtgcctgcccggggccaagcagcaggtgcaaccgggcctgccctggggcagcatggggtgtgctagtgtcctggggccactgtaacaaagcaccacaacctgagtggcttaaacaacagaaacatagtctgtcacagttttggaggctggaagtccaagatcaaggtgtcagctgggctgtgctccctccagggctccgagaggatcccccttggcctcttccaggctgtggtggctctggtgttccctgccgtgggccacatcactccagcctctgtctccctcttcacgtgggcctccttctccgtctgtgtctctgtcctctcctcttcttgtaaggacgcctgtcattggattagggcccaccctaatgaccgaatctgcaacttgattacatctgcaaagaccctgcttccaaataaggccacagtcacaggtgttgggggccagactccagtgtgccttttaggggagatacagtgcaatacacagcacacagtgaggtcttccagatccccagacctatcttcttccagaccgccagacaacaccgataagggtgaagttggcttacgagtcctggccaggatgtgacggggagtcgccaggtgggtgccggggaggtgggaagctctgcaggggattggagaaccacacgtcattgcccacatgtgactttaaaccttagcaatgatattggagggggatagttactctttttttttcttctgagacagtgtctcattctgtcatccaggctggtgtgcaatggttctagcgattctcctgcctcagcctcccgagtagctggtattacaggcacctaccatgacactcggctaatttttgtgtttttagttgagacgggttttcaccatgttggccaggctggtttcgaactcctgacctcaagtgatccgcccacctcagcctcccgaagtgctgggattgtaggcaggggatattactctttacagctagggaaacagttgggcttggtgacatgatagagacaccaggtcccttgaggacagggggccatttgcagagccgtgtggtggaaggagcctgaatttggagccccaagctcacagcgtgggtccttgtcacatgtcctgtgagctctgtttgcatccttagctcaggcaagctactgtgttgaactggctggacacagtgtgtctgtctctccctcttccagagaagtcctcacttaaggttgtgtcactgtttttactgatgttggaattggcacttggagatgtgaactttcccaaggccacacacccagatgagtggttagacccggacctgcctaactccagcatatctttttcagggggacacaattaaatccacagcatggactgagttcccctcttctctgccaccatcctgaccttttcctggccagggttaccatgtcggggcaggcatgggggaagtggtaagggaggtatctggacctagtaaaaggctctggtcctcctgcttcctcttgtaaggaccctgtcaatcacatcgggccccctgaataaccaggctaatctcccaccccaaggtccttacctaatcacatctacaaagtccccctcttgccatgtgaagtcacaggttcctgggacttgatgtgaacatctttgcagggaccatgatccagccttccatagaggcagtgacagatggagtagaatataggtcctttgagtatttatttatttaagatggagtctcactctgtcgcccaggctggagtgcaatggcgagatctcagctcactgcagcctctgactcctgggttcaagcgattctcctgcctcagcctcccaagtaactaggattacaggcgcagaccaccaagtgcagctaatttttttgtatttttaatagagatgaggttttaccatgttggccaggctggtctcaaactcttgacctaaggtgatccacccgcctcggcctcccaaagtgctgggataacaggcgtgagccaccgcgcccggcccctgtgagtttttacaagagacactgcagtagagagaatggtagagtcctcaaaccctgattcagtcgttcatgaattcactgagcactcaacgtttcccgcaatgtgtgtcctcttctttgccagcctgctggtgtgctcctggtgcttggtccaccatagatgggtgtgcttggtccaggaggctgatggtgctgacatctgggctgatattcaccgtttttagtgacttgaatgacgtccatgcagaagagctagtgcaccatccttgtgtttgaaaatgcccgggctccagcctgagaacctggtaggccagtaattggagggacagtagcaggatcgagaagccatctgtgtcacgtgttcttggggacaaagaggagacacaggctcaaggaacagcaaggtttgtgggacacagctgtgtctgaaaacgtcaagcagttagctcatccctggctacttcctgtgaacccattaaatccccaggctgaggaggacagagggtgagggaatctgaccccttactcagccctttagccagcggctgctgtgctaagccattctgagaagccaccggtggagaactgacttcaggtcgtgctgactgtgaggccatccagttgtttttgcacattgaaaacaatacattacactttgggaggccgaggtgggtggatcacttgaggtcaggagttcgagaccagcctggccaacatggtgaaaccccgtctctactaaacatacaaaaattagccgggcatggtggtgggcgcctgtaatcccagctacttgggaggctgaggcaggaggatcgcttgaacccaggatgtggtggttgaagtgagccgagattgtgccactgcactccagcctgggggacagagcaagactccttctcaaaaaaaacattgttccggatttgctaataaggaggcaacctcctcagaccttggtgtcacaggagaatggcccgcggcagccttagggccagttgtgattttatccacagtgttggtcagatgcgtcctctgtgcttgtttaatattcattctgcttgcgtgaacaaagccatgtcagtttcagtaacgcttgtgccagggggcacccggtgtggagcagggctcagtaaaactgctgcaaagaatgttccaggctttttgaaattacgtggagttgctggggctctcttgaggctgttaatttacttagggctgctgtgacaaaataccacaaacccagtggtttaaaccaacacaaatctattattttacagttctggaggtcaggagtcccaacatcaaggtggcagcagggccggttccttccggaggctccaggggagaatcccattccttgccttttccaacttgcagaggcacctgcgttccttagtgcctggcctcttcctctgtcttcaaagccatctcccgatctttctctgtctccttcgccacacctcctctggctctggccctcctgcttcctcttgtaaggaccctgtcaatcacattgggccccctgcataatccaggctaatctcccaccccaaggtccttacctaatcacatctgcaaactccctcttgccatgcaaagtcacagtttcctgggacttgatgtggacatctttgcagggaccaagatccagccttccatagagacagtgacagatggagtagaaagtacatcctttgagtttttacaggagacactgcagtagagagaatggtagagtcccgaaaccctgattcattcattcatgaattcaccgagtgttcacggagcacctgcctcagtccaggcgtcatgttgggagcaggggagacagagcaggccatgcatctgtcctttcagagcactgtagacgcaaatcctgtagcacagatgtgccttagactaatagtgcctcgaaaggagaggaaggggaatggatgcggggagtggggaacctgacctgctttgtggggtcatggagtgactctccacctgccgtcatccctccatcccttgtttggggctgttcctccaaaggtgcagtctccagcaggggtgtggggacccctgtgggccgtgaaggcctttctccttttctgctgtgggcattgcatctgttcctgatgggtagagttgtctgtgcccggtggggcccaaggcagtgccatggtggttctttgagtatctcaggtgggaactgagctgccagcaccagaggccaatggcttccagcactccccaaatccacctgcttttggaaggggcctgtctccgaagcaggccgggtcctcctgttgggggaagctttcatggaggcatctgtgtcacttctgcaggggagacagccgctagagggcactgtccttctggcctttcccacatccccgtttccatggcaggtgcatagtaaagcctttctttttctaacgacttaatgatttaatcttcttattttctcagcagacaacgctttggacttccctggatacattgggacgttaccagtcacattaattaatacgagtttcacaacttgggaaccagcgaacgtgcttctccagacttagcttctgcacggccgtttctgctttcctttatgaagtgcgtttctctaagagcctggcagtctcatggggctcgtctgttgctggaagtgagcagcgggttccattgccccccgcctcggtggggctcattgtgcagcttgctggcaagtggctgggctcggaggggcggtgacggtgacacacgccaggggaaaggttggcatcctcttctgagaattgtttcttttgggtttcacaccctgcccccaccttctgctgcctcgaggctcttttcttcttattattagctaatgacagatttcatgaccagtgactgaaatcatttggaagtaccccctgaaagccagcgtgatgggttggagaaatgtgacagacgcagcctctgaaaatcacagaggcagaggcttgcgtcgaaggacttgctaaggaattaggatgagagtggtcaggaggcagtggctgctgggcactggagctgagggtgaggggccgagaaaacgggaggcaaatggggtagctcttttttggggcgggggaggctggctttggggatgtgtatcccactgtgcaccgcaaggtgggggcactgggcggtaggttcccgtgctccggaagggtggcaattgaagggaggaattaaagaagttggccaggtgcggtggttcgtgcctgtaatcccagcactttgggaggccgaggcaggtggatcacttgaaatcaggagttcgagatccacctggccaacatagtgaaacctcatctgtactaaaaatacaaaaattagctgggtgtggtggtgcacacttgtaatcccagctactcaggaggctgaggcaggagaatcgcttgaatctgggaggtggaggttgcagtgagccaagatcgagccactgcactccagcctgggcgacagagcaagagtccgtctcaaaaacaaaaacaaaaacaaaaaacaaaaaacaaaaactgactcatgtggctttcagtctgagaaaccaatcagatcatcattgtctctaaagaatgtgtcctcctttgtagacaagaagctcaccggcccctccatgccccggtttctcgcccaggtgggttagacggccaacctgacattttaccgtgcacctggaagtctttcttcctgttctccttcccacaaaggattcatttttctgtggttctaacattttcctgatcaccccagggacaaaggggaagaaaagaccgtgtttctgggccaagggaatcatctgtttaacatgggcttcggagctttttttacatttctatgtaagcaacttttcgtattcagaagacccagtttccctgagccagatggactccttccatctcggggtggtctgtatttcagattcctgcagcaggtggctggtcggaatgcacaccccaggaggtgaggctggggggatgttggctcctgggctgcttgtactagcaagtccctaattgcggagcggactccttcctcctgagcccatcagcctctacgtggccacatcagggtaattgggttccttgtgaaacacgactgccaggctaatgtaaaccttaatggaaaccctctttttccacccaattaagtggctggaggtgggatgctgtgtgagagccgtcagttcagttccctgactttctcttgtagaaattatctatgtagctccatttggcctacataagcttagcatttgtgttcattcattcattcattccacagatattcagagagcagttatccatgtgctgggttttatgcaggatgtgaggccatggtcatgaatgggacctggcccctgtgcactccttgcggggtcggggggtgcagggagatgagcacagtccacaatcacatgatcggggaatagggtttgtcattgtcatgtgcacggggagctgtggaaacccagaggaggggcccgaactgcacccagggatagaggatgtgcagagtgtgctttccagacggtgggaaatgggtggagctagctgacctgaagtgaagggcattgcaggttgtggggacagtcgagcagaggggcagagatatgacctacagaagtggcctggaatggcctcatcagacgatgagtgtggaagcatggtaactgcagctgtattgatgagaggaggggtctgctcattaacagtcatcgggtaccactatgaaggttttgcgttttaccctggagctggtgggagccatggggtgcactgcagcagggagtgaccaacgccagctttgtgtattggaaggatttctacatcagacaggactctcttggtttgcaaaggacagaaaacccaactcaaaatggcttaaaagcaaaacagaattcactggtacatttgacagaatggtctgtggggttggatggcctcaggtaaggcttgatccagcacatagaaggtgttgctagatcctagattctgttctccccttccccgagctctttcgatctggtgccttcatctccaggctctgtatagtggtaagatgatgggacggcttcaacctccatcctttctgggtcaaggccagtgggaaggagtgcctgtctcattctctattcctggtaaagtctcagtgcagttcattagctctaactgggccatgcccatccctgactgtgttcctgggaggccagtgtgccagctggctttgtcctgggatgcctgctccaccccagagctgaactacaaggcccgagcatggtggcaggaggggtggctctctctgagggaggctgagtcttgtttgcctgaaaggatcaatggatgctggagaagaaaagcaatggtgtccataacagtcacctccagaaggggagaggctgggctggggtgggaagagtttagggcagggcttgcaggggccaaggtggccatcctggtgagaaagccccactggccaatccaagaatagggcacgagatgtgagcctgccaagggtactcccaggtctggcatcttggttctttccgctgcgttcttggcacagacactcatgccagggcctttgctgtcacccatagtctcagagtcatgttattattctgcagtcatctgtggggatgggaccgtgcaggactttccctccccagcttcctccctccttcagggtagctcactgtgtcccccgaggcagccagtgctgccgggagaggcccgagactccttctgggtctcagagccatttctatggttgaacccagtgtgtgtccttccctgtagaattggctgccactttgtttcctttagggtccccactgcaccctgtacataaccctgccaggacatctgtttattttccattcttgtagctttatttttatttcaaaaggagtacaagaacacagtctggtggcagagcctccctctgtctcctccttaccttcagccactgggccttgcatcagtaatgctgctcttgtcattctggagcatgccctttcatttctttttctgtgaattttgatacgtacacatagaaatacatagtggtgagttttctagttgtattttttacataaatatcatgctgtatttattttaaagtgtctcaccatgttgcccaggctggacttgaacccctgggctcgagtgatcctcccaccccagctccaagtagctgggacaacagatgtacaccaccacacccagcctttgctgtattgttctgcaacatggttttctttttctttttctttttctttttaattttttgagacaagatctggctctgtcacccaggctggagtgcagtggcgtgatcttggctcactgcaacctccgcttctcggcttcaaactttcttcccagcctcctgggtagctgggactacagattcacaccaccattcctggctaatttttgtattttgtgtagagatggggttttgccttgttgccccgctggtctcgaactcctgagctcaagccatccacctacctcagcctcccaaagttctgggattataggtgtgagccactgcagctggcccaacctgcttttgcttttttaaaaaatctcaacaccatgctatgtattgcacttaattaattgtgcatcgaatccttcacgagccttctgtgccaggtgcgaggtcggctgctgggtggaagtgaccaggatacgtcttccctcggctacacgcagactctccacggtgcaagggcagggcctgcccagccccatgcccagccctttggcatccatccaccagtgttagttagatcagcaggctgtcatgcccaaggcttgctgccatctgaataggacagggtttcagcagtgagctcttgatgtggagtctgcgccacctgttgaccttctttggatttaccttattgaaatgttcacacatttcttttagcttctcaacttatttcatcttgagaaatgggctggaacctcatgccccagcacaacaagccccataaatcagatgttcaagctgagcgatccttccggtttgggccacagtcacggggctttcttactcctctagtcatgtcagcaccgttcagaaactcatccttggcttagagatgatagtgagttacatgtacataaatacaccgagctcattaccctgggccggcatcctgcatgacaagggcccacatccatttctcggcaaaaacaaactacatctgccacttgaaacgtcaagaagcgctttcttgtatgttgtgctccatggatcactggaagtcctttccctcttttcccatgtccgggccaggaggagcagctgctctctggcactgttagcctttgctgccttttatcctaggcaagacactttgttattcctccgatttgtaatcccaagaaccttggagattggacttggagttcgtaacctcctggggagggccaggcctcacatttcaaggcctttgcacgcgtgatgtgccagcaacagctcagccctttgaattatgatccgcgactccctccaatcaccttccttctggatgtcagaaaagactgcccaacagcatctcctcccagctgccgaggctgatgatgtttttattctgatttagatctcacttaggtcttattttaactccactgagctgcaagatcttcactgaagtacaactggacttatttttagaaaaactgctctgttaagaagaccttcgtgcctgatgaagttagttattctgataaattacagcttctacgaagaaaccacacccctctgagtacggatggaagttggaaaattcatagaaagctgtcatttcctggcagaggcctggaaaacctcatttaacagagatgtctttgggttcctgcttaagcccaagcgaaggatcccgatgccccctccccagctgggaagaggagctggtggcgtgagttggcacagagccgcacctttctttctcctcctgtatcctcccgcaagctctgaagaccactctgtttctttgagcaggatcagttgtaactagaagtgggtaggatttgaaaagggctggttaagtgtttaaaactggggcagctttcctgccattttccagttcttttagatgtgcagggatggagaatggctgtttttgttggggttttctctttgatcctggttcagacggggccctctgaaatttctcgccctgatcttttgttctctatgaaaaccaggaattgcacggatggtgtagaaagtccccgtaggtggcaaagcatctctgctgtgttgaaatgacacacttagaaaagtgtcagaaaatggagttgccattgctctggccccccaggacctgtggctcagcctccattgggcctttgtgtctgggccagaccctccaggcaagcccccagtgaggctcttgggcccgtgattgcaggggcgccttgccatcccccgtgtcctgccctggttctgctagtggagcaagaagctgatcagcctttgtgttttcagatttcttctctccgttaaggtaaccttgttctttaaaccagcttgctttcaaagttgttttcctaataatatcaaaagggggaaaaaaagctgcctgaaaatccttttttgggaaagagcctgggcataaataaataaatacaaccatacaaagaagaagattaaaaaaaaaaaaatcaaagatggaactttcgcatttggcctgaggtataaatggcaggcttctgatgacatgcttttagtttttgattctctttctttccttttatgttcttgtaattccaaatcaggaacgatggtgtttttttttttttttttcttttttcttttttttaaaccttgcccaatctttgggtggaggctttggaagccgcacatattccaccattatagttactcaaagctgacgcttcccgaggggtggctgcatgctggcgactgtgccgagggtgtgtgtccctgaatctttgtgatctctctgaggtgtgttaggccccactttacagatggaaactgagacacacagagccgtcaagcagcttgcccaaggtcacacaccttgtcagtggtcaagctgggatccaaaaccagcagcctggctctgggattctaagctctctgttgtgctgctccttgaatatattaaaaggcctactatgtgcaggaactgggttggcactggcaggaaggcaagttcgggaaggagatagttacatggctgtgtggcttcagctggggagaggggaacacccaggagggcttcttggaggaggcggccagtaagatgaggttgaagataggtaggatttagtagggcacagtgaggtgcaagatcaggtagaactggctttagtcctgactctggggcttcacatctaacagcacaggaccagccactccctcacagacttgtttatttattattattgttattatttttgagacagacggagtctcgctgtgttgcccaggctggagtgaagtggcacaaccttagctcactgcaacctccacctcccaggttcaagcaattctcatgcctcagccgcccaagtagctgggattgcaggcgcccactgccacgcctgactaatgtttgtatttttagtagagacagggtttcatcatgttggtcaggctggtctcgaagtcctgacctcaggtgatttgcccaccttggcctcccagagtgctggaattacaggtttgagccaccgtgcccggcctccctcagacttgttaggagacaaggtgaatggctggcatggaagatgccctgcacatagtaggtgctcaggaaacgttagtggtgctctccccctttccaatggacagtcagcaatatgggttggacaagtatgttctgtaatccgaggttgtgtgccctctggctggcccacaaaatttgaattaatggctcgtatttataaatggggagattccacaccaaaccccacatttccagcttttcttgaaaactcagatctggtgactgcagcctgcacttcccactctgccatcccgggctgagcgaggagtgcccgtctccagagacagtgtgccaaggggccctcctcctatcaaatgccctcctgtctctctcttcctacctggccccccgtgcaggccacagagcgtggtgctgcaggtgaactctgctgcggtgggaacgagttggcatcgactccctcgtggctggctgctgggtttcgtgtggacagagacattcatcttagaacaatgcagacacttaggaaaacaagcacaaggcggtctttttcccttaatcacccatctcatgaaatcaagccccagtcccttggaagctcacaccctccacaccctccagacactgagagaatgcatgccagcatgcctgtgccagcgcgcctgtgccagcacacccgggccagcacacccgggccagcagatctttctctgtgactgaagacagccggcacttcacatctttgaagggtttgtctttctggcaagtagaccggtactttaaaaaccaaaacattcctgggattcactgaaagccagtaaactggcaccgttcaggtggcgggggggtcgggggaggggggaagccaagggtgtgagaggagcccctccttccaaaaatcacaccgatcctctgaaggtgacgatcagatccaggctgcaagttcttctgcaaaggagctgtgtccataagggaacccaggctgcaaaatatagcaaggcccagaagggcatccctcaaaccttcatggggttcagctttggacatgctggctgtggtttgtctccactgcactctgcaaagagccccgaaggccctttccttagcctggccatatttcaaggccagttcaattgctgcctcctccaggaagccctccatgcttctctgtggaataggggacctcgcctgccttgtggtcactcttcctccagtctgtgtctctcttggagcctaatcacagagaccctgtacatccacagctgcctctcccacttgcagggagtagtttgtgggccatgtgtgggtgctcacggttccccttattcctcaggaaatgtgaggaagttcctgtgaggccggtattcccaccaccccatgttacagatggggaaactgaggcttagtgcggtgaggggacttccccgaagccacacaccaacaagtggcaatgcgagatttggactggggctctgtggccacaggcctgggctcctcctgccaaccgaggggtctgccagcctgtgcccccctcctcctggtccccgaagcctttgcttccctcaggccatcgtgcataaccagccccttcagaatgcgctgctgagcagtccctgggcggtgttcgtgagcacgtttctcatttattaaggtcacaaaatccctggccctgtttagtgtcatctttgatgttcaagggcggtgtggaaatctctgttttgatatgacccaatttctaggctttcaaaatgtggcttctctcctcctccctctctgtgtttttgaaatcaggtgagcagggctgcctcgaagcgttgaccacttgccccgaggtctccctccccacccctcaggcccaggcacatgggtgcagtgccagctctcgggccttgccaagaggactctcgggcgtagcccacctgtgtaatcctccacacatagggaaactgggtcttttgttcttcctctgccatcagcgtgagcactgcaggcagctgtgctggacgggacctccctgcccctgttgtgtcctcctatgatgccagccaggacatggaacttccaccccgaccccctgtgctccagggctatcatattcccaaggatttctgtgaaaaatcacttttccctgtttcctttctgccttttaagactctctgctggttacaactctctttgtaactcgtcatgtggtacaaatacttgctgaaatttggtccctgttttctcagctgatctgggtgacctgtgggggttcttctggattatttttagagaggtggggcagagggagtctcaaaactctatgtctgtatcatttccctgtgaaggtatttaacatttgtccactgctggtgtagcgttatgctaaggattttggaaattcaaggatgagtggtgcctggatcttcccttaggatgctggctgtgggtggaggacagtgtgtgcggcagccaggctggctcgcggctggaatgtgggttacctggagagggcctgctttttttttttttttttttttgctatttaaaaaaattgttgtaaaataggcataacgtaaactttaccatcttagccattttcaagagcagagttcactggtattaagtacgttctcattgtgcagccatcaccaccacccacccacagaactctttcatctttccaaaccgaaactctgccatcattcaacactacctctctatttgctacttcccccgcccctggcatccaccagactgctttctcctctatgcattcgcctactcgagggacctcctactggtggaattgtacagtgtttgactttctgtgtctggcttatttcactgagcagaacattctcaaggttcacccatgcggtagcctggtccgaatgtccttcctttttagggctagataatattccgttgtatacgtggactaccttttgcttactcattcatctggtgttctcaaatgccaagactcagtgactgcagcagtgcccgaaggttccctcgaatcaaagaacttcctaaccccaacctgtacctaggctctgatactcctgcatcaggcagtcctctaggataaggtgcctgtttaaaatgcaaatatattaccttcgggggagtgggtaactggcatcctggggccccgctgccattgtccttatgagggagggaggttgtgttgtcctggaagtcgggtccacggtcacgtcctgagagtcccatcacgtgccatgctctgggctggggacttgatgttcattgtttggttacatttagcccttccaaagaccctggcatttttgcagtgttacctataaattccatgtgcggaaacatgggttatttccactcttttttttgagatggagtctcgctctgtcaccaggctggagtgcactggtgtgatcttggctcactgcaacctccgcctcctgggttcaagcaattctcccacctcagcctcctgagtagctgggactacaggcgcacgccaccacgcccagctaatttttgtatttttagtagagacaaggttccaccatgttggccaggatggtctcgatctcttgacctcgtgatccacctgcctcagcctcccaaagtgctgggattacaggtgtgagccaccgcacccgacctgggttatttctacttttgggctattttgagtcctgcagctatgaaaatgggaataaaagagggtccgctttttaagaagctgaatatcggcctttgctgacatgagaggagctggcatccttgggccctgctgccattgtccttatgaaggatggaggttgtgtcgtcctgaaggctgggtccacagacgtgtcccaagagcccatcatgtgccatgctctggactggacgctcaacattcatggttacattcagcccttccaaaggccctggcatttttacagtgttacctataaatgccatatggagaaataggtgcagagaggtgagtgggatgtacctggggtctcacggccagcatgagtggggccctgttggcctgctgctccaaagccatcatgccacacccccttgctgttccatcatctgccgctgtggaggctggatgtccagagctagaggtgttcaaggttcaaggtgattctggtgttaaaagaggaaataccattttacttctgaacctgtttcatggagaaagaggtacagctccgggcacactggcctgggtacctttgcagcatgtgatcagggactgctccccagcggccctccaccagtgccatgaaagtggccagggccctacctgcacccggcaccatggatgcatcttggggctggaacctcgagtcttacatgcagcagaggctgaggctgtgactgtggagaaagcgtgacattacagaagcaagggttttggcacctggtgtctgtgtgggtgggtattcctccctggtggatgtggctgaaaggcctgcagggtctcactggtgcagggagatgaggggtcatttctggttctgggattgtccctaatcactgggcgttccagatcctgtaactgttcagcactcccttgagacaggaggtcatggtgtttctgacttggagcctctggctctctttattagattctgttgcatgttccagccatcctgacccgggtgttccatcagatttctgtgcctgtgaatgtggccatcaccagtgaccccactttaaactccagattcacctgtatgcatgaccggagggggttagcatcttgagtccgtggttcaggacgcagccccccggcagagggaaggcagccccactctctcatgccccatcgctgtggtccatgctttgtctgcctcagcagtcttggtcagatctggaagcatctggaggcatctggaagctttggtgtcttagttatgagtttcaaagggcagtgaaaacagactggcagagctcagcgagacctgggaaatatttggggtggggaggaactgcagaatgtattcttggttcagagcatttttccctctgactctttctgggcaacagaccttttaggaatgtttgttaaatgctgaaaaaaacaggaattgatttctctctgcgtccacagccaacatgtgaggccacggcactccgtgtatactaacctggtttttctttccttttgctcaacagtgagtgacctgcaggaagaaggcaagaatgccatcaactcaccgatgtcccccgccctggtggatgttcaccctgaagacacccagcttggtacgggggttcctccgctccctgccctgagacagttgagcttccgtggcactaagttggtcttggggaggccaatgaggagcccgatagatctggcctcttgatcagatgctgggggcatttgggagtctaagttcttagctcaaggtcatctttagaaaagtccattgggaaaagcaagtccttcattaagggtttctgccctagtcttaaaacgtaagttttatttttcaggtggtgaagcaaacagattgggagaagactgacttgaaaagatagtttgttaaactcatagttctgaaaggaggtgtagcaggccactcagggccatgccatgccacgccatgccacgccacgccacaccatgccaagccacgccacaccatagcacaccatgccacagaaggccacatggaaagcactagtgtgaggcagaggcagaaggagcagggctaatgcctttatttgatattttatgtatatattttttgagatagagtctcactctgttacccaagctggggtgcggtgatatgatcacagctcatggcagcctttaccgtccaggttcaagtgatcctcctgccttagcctcctgagtagctgggactacaggcatgtgccaccccgcccacctaactttttaatttatttgtagagatggggtcttgccatgttgctcagactggtctccaactcctgggctcaagcagttctcctgcctcggtttcccaaagtgcagggactacagatatgagccactgcgcctggccccaacacccttactgtggctttctctgaaggaatgggcaaggctgggtgaacaggcctaggcctggcttgttggaatcgtttcactgggctttgcggtgcaggagctgtcctgagtcttctcagtaagaagactcttcttcttccacaccacgtggcgtggcgtggtatggtgtggcgtggcgtggcatgtccccagggccaggggagattagggtgaggatattggctgggagtgtaggagccccgtgagagcccaaggaaagaggtggctggggactctgggctctgcggctcaggctctgagtggttttcatatgaaaggtgtgctcacagagggtggtttaccatctctaggaattagcttgccctggaggtgcaatctctccagagtcagcaaggccccgagatgccaagcaccagaaaatacagaaaacagggcgggcacggtggctcacacctgtaatcccagcactttggaaggccaaagtggacggatcacttgagttcaggagtttgagatcagcctggccaacatggcgaaaccgcgtctctcctaagaatacaaaaattagccgagtgtggctagcctgtaattccagctactctggaggctgaggcaggagaatcgcttgaacccgggattgggatgttgcagtgagccgagatcgcaccactgcactccaacctgggtgacagagcgagacatctcaaagtaaaaaaaaaaaaaagaaaaaaagaaaatgcaaaacacaattaatatgcttcttccctttgggccagccagagctgcccgcggcctgggcttgcagggtgggctctgccaagtggcccaggcccctgcgctcactgcctgatgtaatgggtaacagccaagacacattttccttaaagtgtgttttgggatctagctgatctggaaggcatttatggaacattctgcgtatttccaaaccctggttcgaagggaagtcccggttcatcccttttttgtggtttccgtgacgaggccaggccagcaagagcttatggagaagaaacgccgatgcaagttcagccgccaaccgacccgaagccagagctggtgatgctgcctgaggtcgcaccagggtccacggggctttctctccctccgcttagaagagagtggccccaccaggctcggtggctcaggcctgtaatctcggcactttgggaggctgtggcaggtggatcacctgacgtcaggagttcgaaaccagcctggccaacatggcaaaaccctgtctctactaaaaaatacaaaaattggctgagtgtggtggcaaacacctgaaatccccgctacctgggaggctaagtcaggagaatcgcttgaatccaggaggcggaggttgcagtgagccgaggttgcaccactgcgctccagcctgggcaacaagaatgaaactccatctcataaaataataaaataaaataattagccaggcatggtggcacacgcctatagtcccagctactcaggaggctgaggtgggaggattgcctgagtctgaagaagttgaggctacagtgagccaagatcacaccactgcactctagcctgggtaacagagtgagaccttgtctcaaaaaataataataattgaactcactcactgaatatttgcacagcacctgattctttctgaagtcctctttgtatatttcatatcctttgggctcataaatgtcatcattgtagcgaatattgggggtccactgtgaatgcttctactcctcagtcccttcagtgaccctgtgaggtgggttgtatcattatccccattgtacagatggggaagctgaggcacagatctaagatcacagagatcactagtaagtgccaaagtcttgaaccccgggcattttgcccccagagctaggctcctccccctgctctagaccctctcagtgaagatggtggccctcatcagaggtgagtaggacaggtccctgtccttgggcacgttttattgcagctggctatgacgcacaaggtggggagggcgggggctcggttcccacaaaacactggcacagagataccaccctggcctctgggcactgcttctcctctgactgaagtggagagaaacctgaaccaggcccacctagcctgtgtggacccagacctgctgaagattctgagcccatgtctgaccccccggcaccccctggatggagcagcgcttgctgtacccactgtggtgtcccgggactgtgggctcctcgaggggtcctgcctcagtcttggagccaccgagaggagcatggcacagtttagcgaccactaaagtcacacagctcagagatggcatggcggctggtgtctgctctcagcttccttttaggaaaaacaaggagcctctcacagcccttttcttctctcccagagtccctggagtcctgttcctcaatgcaggatgtcagaaagtcccagggcacttggcagtgagggttcctggccacccgaagacctaccaaatgggagtatgcgggcccaggcccctctgctttaaacatgcctgcagtgactccggggcccactgaggtttgggaattgctcccctctaggccgcgtgagcagcccgtagcagactgagggccatgatgtgcagtggcctgcgggggtttcatgtccagggtccccggtcaaggctagcaggtcatgaatgctgacaggcagcaagggctgactgtgagctctggagcccccagatacagaggtgtttctcatctggagcaagcgcctgctctgaatcaggcccctgccccgtgagacgcagctgctccctggtctgtgcagagcctctgattctggcctactgtcaccatcaccaggtgaccaggagatcccggcgggatctgcagacatggacacactgccacacatagctgcctgcctggggcctgctgtccaccctctcaggcccactgttcccctctaggcggggtcaggaatgaaagctaccccacggggacaggtaaagaccggagatgcctctgagaaagtgtttggtaacagtaagcctcgaaacggcatctctgtcctccacctttcacagtctctgggtcagacgccccattcctctcagtggtcccgccgactgaggcaggacccctcaagaagcacacagtcctgggacatccgagccaccatggcatgctgcccagtctggggtcagacgtgggctcagagccttcaggagggagcagcgagttccctgtgggggccacatgagctgggcgggcccgaatcttgcttctcctcagttcagcgagagcaaggtgtggggacatgctagatagggcaatgctgagatttttagtgtgggttgaaggggatgtttccagaaacgggctctctgaaggctgggattgggtagtgacctgctcactctccgtcctgcaccccctctcatacacgtgtggactcacggcctggccctgctccttgcccgcctgagatgggtggtccagagggggtctcagacatgggtcacacaggcacacaaagtcctctttggggctggagagcttggaagatttggcattcgggctcaaggatctcagctggggagctgaggtctgaagggtgaaggaaacatgggccagggagagagtgtcagacagcgggagcaggtgccaaggctcagggcaggtggcagcaaggcttcaaggagtgagggaaggccggatgggctggagcagattgcaccaggagggcaggaaatgaggcgggagaggggccttggaggccacatggaggacgccggccttgatcccagcaggagtgggaggctgcggaggcctttgcagagatatcatcaggactcccgagaactccctgcacattacctggagtgtccttttcaggcatcagatctgtatgacttcaaaattagtttctccatgttgtcagagtttacactctgctgccgggaagttgcatcacatccgtgtcagcagcaaagtttcactcaaagccattttctttctttcttttgtattttattttattttattattttatttatttttaaaaatagagacagggatttcactatgtagcccaggttggtctggaactcctgggctcaagcaatcctcccgcctcagcctcccaaagtgctgggattgtaggcaggagccacttacgctcagcttcaaagctgttttcattctgaccgacatggtcagtgtccccagccccatgggagcctgtctgggctctgggaccctggtctcaactgtgtcctggccatctccacttgtatgtcctgggggtaactggcttctgcctggagcccctcttgtgccttttttcctctttaagagagaggtgtggtatagagcctcccggtgagtggagcctgggccccacccgacccatgctctgtgcaggtcccggagctggacagtgtggcagcctgagacccccttgcccttccctgtgtgtgttcagaggtgctcggcgcccgctggcttctgtgtggtgctgggcatttctgctgtggagcacgcctagccttggtgggtgccccctccgcagtcccgcctccccactgtctccacggcactgtcctccatgacgggctcagctggctgcctggtgtctgtgggatccaggctgaaacgtggagggaaagcaaacaggtagagaaatagaaagagggtgaggctgaacacgttttgctgttacacatcatccccccccacctttttttttgctatttatttctcaatattttttctgcatgttattttacatacaacattgcatattgattcttttccatggaatgtaccaaacattttccatttcattataaccatccagactcttcaaatgtatttataaatagtggccacagggaactacctggtgcctgaagctttcccacataccagattccggccagcggaggcatctcatgccctgtgaatgctgctctctccttatttctcctgaaaaatggaaatggtttggaccagctgctggcggagtctgggaggagcgaggccgggcagaatgatgagtttgacttcatccctttccagaagaggggaaggcgggaggatgccccatccaccttccagaaggcggttccttgcagtcaccctcccctagtgctgggttctctgcttctccatttgtcagagatgagttggcctccccctggttccccgtgtccctgccacccccacaatcgctgaccgtgacttccttttgtccctggcagaggagaacgaggagcgcacgatgattgaccccacttccaaggaagaccccaagttcaaggaactggtcaaggtaaggagctccgtcttggttggaatcttcctcttagggcgaggacttggctttggggttcagggctctcatggacaaagggagctaaacccggggctcctgaaagggatgttggtgctgcatgagaaggtgggcagacatgttggcagaggaggacggcagagaggatccagcccgaagtgccaagcgcctcccatgtgccctgctcggctggggctttaacgaccagtcttgtgaactctttgctggacagagctcggcaggaggggattttaggattaggaatgagtgctggcgtgagctagtgtagtaccttacagatggagttggaactccgtctggagcctggtggggtctagattcagatttaaccctgaaaagcaggaggggtcaccctggccactcctggccaggagccatctgatgccgatgcctgcgctgagtggacagtcagtttccaccacgtctggaggcgtgaatcccagctgggcgaggaacctggctgccccgctcccagaagtcagggaacagtgagggaaggggcccatggtgctggccttcttgggcagcggctgtccttctccagcgtggctcctgctcaccgtgaggcagtgcttgtgtgggtccaaggacagattgcagttttggttgctctgatcgaaaccacggtagggcttgagagagaatcccctgaagaggagaggctgtgggctctgcctgaccttggtgaacccagggtgggctcttgggcacacggctgtggcagacacttggcttccatagcccacggcgagcttgggcaccccgggattcttgaaaatgccgatggtgacagtgtctgccagaaacagacatttttctattaaaagtgctttttaaaaagcttctccaccttcaccaccacagtggacccaatgctgggctgtacaactgtgttttcatgagggctcattcagaataagtaagacggcttgcaagttatgttcttttaaaatctacattgaggctgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgaggtggcgggcacctgtagtcccagctactcaaaaggctgaggcaggagaatggcatgaaccccggggggcggagcctgcagtgagccgagatcgcgccactgcactccaacctgggcgacagcgaggctccgtctcaaaaaaaaataaaaaataaaaaataaaatataaaataaaataaaataaaatctacattgagaccgggcgcagtggctcatgcctgtaatcccagtactttgggaggccaaggcaggtggatcacctgaggtgaggagttcgagaccagcctggtcaacatggtgaaaccctgtctctactaaaaatacaaaaaatttgccgggcatggtggtgggtgcctataatcctacctactcgggaggctgaggcagaattgcttgaacctgagaggcagatgttgcgttgagccgagatctcgccactgcactccagcctgggcaccaagagtaaaactccatctcacagaaaaaaaaaaaaaagaaattccaaatgtcagttttagggtccacccaaagatgttgattattaataacttaaattatttaatttgttttattttttccctctgaatacccactttgttatttcaaacagaagaacgttgatgaggaaagtcactgtcttttagccacgaaaatgttgttcttgggggatatttaagcaagggatgcatgagaattatcaggcttctacaaagaaacagacccaattgtgtcaatatctagagagaggtttattatgatattggctcacttgactacggaggctgagaagtcccccgacctgccatctgcaagctagaaagctggagggccagtggtagagatgccagcctgcgtctgcagccctgagtaccgggaacagggtgggagaagatccaggtgctggcactagcagtccccggcagagagaggtgaatcccaacttcctccacctttttgttctatgggatcagatgaggcccacccgctttggggagggctgtctgctttactctatccaccaattcaaatgctcatctcctctgaacaccattccagacacacccagaaacaatgtttcattggctatctgggcaccccagagcccaggcaagttgacacagaagatgaaccatcccatgcacctttctaaagatttttttctttgatttttgagcaatgcttgagagttcacaaactccattcacaggattatctccttgaaacaacaccctggggagctgtgtcattcttgcttccatgtggagactcagagagaggtgaaggggctgggcgccatggctcacacctgaaatcccagcgccctgggaggccaaggttggggggaatcacttgagcccaggagttcaagaccagcctgggcaacatggtgaaaccctgtctctaccaaaaaaaaaaaaattaactgggtgtggtgggaggcacctgtaatcctagctatgcaggaggctgaggtgggaggattgcttgagccccggaggtcaagggtgcaatgagctaagattatgcctgtgaatagccactgcactctagcctgggtgacagagcaagaccctgtctcaaaaaaaaagacaggtttaagtaactccccacccccaggtgctggggttagtgatgtgtctgggcttgaatggctctgtccatttggtgctgtgttcactgagccaagttgagtgcgtgtggggtcctgtgctgggccctgggattcggggatggataagtgacttccctgctatgcaggatttgatttatgttcctcctggatgtctgcagtgccacccacccctgcctttgctgctttgctgccaaagacccccaggctgttttggccttggtggggcgagggctggctgctgcatgtcttccaggtttcagattgagaagaaggccacattgaggggcatggggtggactgatgggaaagctaattagcatcctttggggcaaagtacaactatggggcaaaatacaactaagaacaggaaggagctgaggaataaatgcctctccccgacttccctgatgtgggcttctgagaccatggctcatggagatgggctgcatggctgatcatcagctgggttttcttctgaagccatagccagctcatgcacctgcctcacctcccttcccctccctgttgctcgtctagggtgccctcccctcacccccaaacccctgccaaagaaaaggcatcagcagtgagctttgtcctggctctgtttttcagggaacctgggccagaatcatggtccccaaagatgaccatgtgataatccctggagccattgactatcatcttacatggcaaagggacatggtgggtgtagttagtgaccttgcaatgaggaggtcatcctggatgatccaggcgggcccagtgtgttcgctagtgtctgtataagagggacatggggagctttgactgcccatgaacatggcagcttgaccctggaggcaaggtggtagcttctggctctgaagatggaagaaggggccatgcactaatggatgcaggcggcctctgcctctagaagtggaaaagacaaagaaatggattctccactagagaacccagaaggaaccctggagcctccagaaggaaccagccctgctgacacctggattttagcccagtggaacagattttggactttgacctctaggactgcaagagaatccactgagccgttggaagcccctgggtttgtgttaatttgttacagtagccacaagcaactaacaccatcctgttctccaggctgctgcctccagctgcagctggcgtgccctggccactggggccaggcagggtgggttttgatacctgcagcggcagcatccttggccatttcctggaagggccagttgccagacactgagatgcctgttactgcaactgtcccaccagcctggagcacgtgtttctggagacaggcaaattctggaaggctccacctgctctcagactgcaggttgcgtctcaaagcaggctggcagacattttccactcttgatcaatcattttccaaaataagcatagacacagcaacccggagagcagcttcggtttggctgtcggtggcgtgttagttactgtagtggtggcacagaggcgatatacgttaaatattagttctcactgactatagccttttaaacagagcagcgtgtgggtggcagcaggtgagttggctatactgagcttgggctgcccttggttgattcttgtttgtcaggcatgcagggggctctctgtgcgtccaggcatattccctgtctggatttgcttgtgttcatggattttcagcacctcctttcttctggtttgggaatgagtcaggtcctcactacacaaggccagagcagtatgcgtgtgtgggtaggggtgagcaggtgtcattccctgcctcccctcctccttcactgccccagccaccctgaccaccttgctgttctgaggacacactgagccagtgcccactgggcatcaggtgaaaggggacatcccacaagcccaccctcacttctgacaccaatggcaagttcaggatctccaacactgccctgaggtttggtcatttgctagagggactcccagaacccacttaaagctgtcaccctcacagttacagtttctgatggtgaagggatacacatgaaaatcagccgagggaagagttgcccagggcagagttgaacgcacccacacagcacctccattgtcctttcaccatggggtcataggcagcgttactctcccggtgatgtgggacaatgcgcatgcagtattgccagccggggaggtcatctgagcctccgtgtccagagtttctgctggagctcacttgcatgggtgtggctgactgtccacatggctcatctgtctccagcccctccagcagctggctgatagagtgcaacccaaagccccctccctgaatgacatagttactccctggctggcccgagggccccaggtaagcagaggtactttatctggcagggcatttcggagcttaggagatcacctcccaggggctgaggtcacaggcccaacctctctgtgggcaaggttaggttcattatcacgtacctggtctttggactttcaaaggcccatgcctggagctgtcttcaacacttctttcagttttctctcaatgcttcctccttggagacgtatttcctgcccctgtcactccatcactctcctcctaaccccagttactttttctttgctgggcttgctgctgcctggagtcatttcctatttactagtttgtttttggtctttctcctcccctagaatgtaatcttatgctgtgagggaccatgaccattctcttcccagctaaatccccagggctggagttgtgctgcacatgcagagctaattcatccttgatagatagtaagagaaccgatgggggtctgtgtcagcagcaccaacatgaggttcacaccagcgtctcccaagatggcatgcggcttagagacaagacagatgtggttgctttttgttgttgttgttttgtgttgttgttttgagatagggtcttactctatcactctatcacccaggctggagtgcagtggcatgatctcagcttactgcaacctctgcctcccaggctcaagtgagtctcctgcctcagcctcccaagtaaatgggattataggtatgcaccatgatgcccggctaattttttgtatttttagtagagagggggcttcaccatgttggccaggctggtctcaaactcctgacctcaagtgatctgcctgtcttggcctcccaaagagctgggcttacaggcgtgagccattgcatgcccagccagatgtgtttttttttttttttttttttttttttgctctaccccaaacctgtgagatggcagggaggaggctctgggaagagggggtgagggttggggtaaacctgtggattggatgctgatgtaggtggtcccaggtgctcccttgggaggagatggacagtccggatggtgcagacaaaacacctccatccacattacctgcgtaattctctttgctttccagaacatcctttgtgtactgtggactgtgatgatctaatgctagtggattacatctaagtaggccttagtagaagccacctcccagtggttcctcggaggcatttggtccagaagcagatgattttagtgcaaagcacagaccgtatgcaggcctgagcagatcaggggacagacagatctggctgacatcctgatccgctggctgtggtggtgtggccattgcttgtagccacattgcagtcttgaatgtcccccttggaaatgggggacatttccaaggatgcctgcctggtcctctagttttctctttctctgttctctgtcatctgcacttttttcctcttgtcttgattgcttgtcctgtctcccctagtagacaccccctctgacctctgctgcctcaggactgttgctgtataaaatattgtgagatgccctctgctcctgtttaaaaaaaaaaaaaatccttagctctgggtaagctaggcactgagaatgaggccagtcattcaaaacttgtctctgagcattgattatactcatgtattatactgttaaggggtgaaggtcggctctagggtcagcttcctggatttaaatcccaactcagattaaagtgggagaataatagcaccaacgtgacaacctcaaagtgtcatttgtaaggataatgttagatcatacacttgatcacccgttagcagtgtaagggcagtgtgggaacatgagcatgaacagggcagcccagaagggagttgaatggacagatgggcaatgccagtttggaagtgggtgcatgcatccggtgggttcaggagcctggaagacttatccaaaagtcatctttgctggtgtttcttcctgtgtattttctctaaccttctccagcagtgacctgaattacttatgggtgaacactgaatgctgcccaggcaactagaggtttatagatgagatactttaaatttttaatgattcttaaaagagggagtggctattcttatgctttccagaatgaatagccaagggaaacctgtacagttgccatataaggagaaacctagacctggccttagcctctaggtcctggtgcagattcttagcacgtagcgcctaaaacctttgcgatttcctgagtgataggagcgtcttttgttattcataatgagatctgggtttatgctaacgaggtgactcagggtgggggctggccccagagtaaccaacacaggattagagggttgggtctatcagtcctacccacccccagcctctgggtggggtggagaggggctggagagtgaatcaaatcaccaatagccaatgatgtaatcagtcacacttacataatgaatcctccgcaaaacccatcaacagtggggttcagagagctttggcgctgggaaacacacatggaggtgctggagggggacacgcagggagagggcatggaagccccgcctccctccccgaaaactctgtcctgtgcagtgtttcttattaattacactgtccctgagttctttttttttttttgagacggagtctcacactgtcggccaggctacagtgcagtggtgcaatctcagctcactgcaacctctgcctcccgggttcaagcgattctcctgcctcagcctcccaagtagctgggattacaggcgcccgccactacgcccagctaattttttgtattttagtagagatggggtttgaccatattgccctggctggttgcgaactcctgagctcaggcaatctgcctgcctcagcctcccaaagtactgggattacaggcatgagccaccaccacgcctggcctgctgtgcctgagttctaacctttatagtaagttggtaatcctcagtaaaatgcttttctgagctctgtgtgttctgccaaatcactgaacctgaggtgagggccctgatttgtaatcagtgggaagaggctcaagtagcctgggagccccatctgcagctggtgtctggaatgaagtcaatttggtgggactgagccctcagcctgtggggtcaactgtagctagtgttagaatcagactgaactctaggacaccccattggtatcagataatcagagaattgctgttggaattttcatgtgcgtccgtgtgaagagaccaccaaacaggctttgtgtgagcaacatggctgtttatttcacctgggtgcaggcgggctgagtccgaaaagacagtcagcgaagggagataggggtggggccgttttataggatttgggaaggtaatggaaaattacagtcaaagggggttgttctctggtgggcaggggtggatctcacaaagtacattctcaagggtggggagaattacaaagaaccttcttaagggtgggggagattacaaagtatattgatcagttagggtggggcaggaacaaatcacaatgctggaatgtcatcagttaaggctgtttttacttcttttgtggatcttcagttaatttaggccatctggatgtatacgtgcaagtcacaggggatgcgatggcctggcctgggctcagaggcctgacaggaatgacacgttgggtgtcagaaaaaaaacacagaaaactccctaagcagattggttgaaagcaggctgactgcatgtcatctgggggtgcgtctccccccaagagcaggtttcacatctcattccccggttgattggacaagacccttcctgtctttaagttctgttttcttcctccctttgtctctccgaagaaaatcagctgcatgaaaacgatcctctgggcagaaattggtgctgttggagccgcacagaggtgccctcccgtgccccctggcccccaccgggccgtgtctcctcctgcctgttgcaatcagccctcgtccgactctttttggaagtgattaaaacataactgtcatagctctgggggagacaggctgcagatcctgattataattcagaaggatctaaagaaaaagtaattttttaaaaaaattctggttaaagccaaagctcataagacgtgtgtgatggagtggtatgcaagagcacaattaatgtatgtcctagacatctgcccacaggattcagggctggcaaatgagtgcgtccctaaaaataatgactagtgctatctttaaaaagtcttttgtggcatagcagattaagatggatggcctgggaagtacagtggcagcgtgtgctgtggtatccaggaataagttgtacctcctcggggtggcagtggaactgggccgtgaacagcttttgcttcccagagaggactgccatggcctgctgcatggaatttgattttaatctgtttgttatttttgggtttggtcttggactgggtttgaaatccagatgtgacttttttttttcttttttcagttttctttatagcagcaatgttgtatcttgtgtgtttcctaacaagactgagctctgagcaaggcagcctctggaaccaaatgtctgcaggcccaggagacctttctagaaagttcataggtgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaagaaagttcataggcggttctgcagtttgagccccttctgtgggtctgtgcctgctttagccgcttgagatatggcattgaacaaaacacaggccccgcctgggagaagctgccaggccagctggggagacagacctgataagtgaaaatgagatcgcgtggcctgcatgctccgaagaagactaaggcaggaaacaggactattttctcccgactgaattgtcctggtatccttgttaatatcagttgactgtgacttgagacttatcttggacacccctttctgttccgtgggtctgtgtctgccttgatgtcagtcccacagtttcgacgactggagctttgtagtcaggtgtgaaacagtggagtgtgggtcctccagttttgttcatctttttcagattgttttggcaatccaggagtcctttgaatttacatatgcattttattttattttaattattaatattattattattttttagatggagtcttgctctgttgctggagtgcactggtgcaatctcggctcactgcaacctctgcctcccaggttccagagattctcctgcctcagcctctcgagtagctggaattacaggcatgcaccaccatgcccagctaatttttgtattttcagtagagacagggtttcaccatgttggccaggctggtctcaatctcctgaccttaagtgatccaccagcctcggcctcccagagtgctgggattacaggcgtgagccattgcgcccggcctatatatgcatttaagacctgcttgtcaagttctttagaagccatctggatagtgattaatttgtaaaaatgatacttattatctttttgaactgccaaagtaatatatgctgctgaaaacctggaagacagaaaaatccaatagaaggcagggctaattttttttttttttccatgtatgtcccttcaggcttctctgtgtttttcatttttcctacacaaatttggaatcattccagagctagtaagcatctagggccacatttggactagtaccttgggataaattagagctggaattgccgggtcatatagtgtgcacagggctagggactgacttattttcctttctgaatgaagactctgaggtctagagaggttaaatgagtgactcaaggtcacacagctaaaactctggtggagctgggtcttaatgcagaccctacatattcatgccatgctgtatttatacaggcatgtacaccagcgggtcgggattttagggggtgttttaaaattctgcctgcaaaacctttttttttttttttttttttttttttttttttttgagacagggtcttgctctgttgcccaggctggagtgcagtgtcaccatcacagctcactgcagcttcctcccaggctcaagcaatcctcctgcctcagacccctgagtagctgggactacaggtgtgcactgccccacctggctaatttttaattttttttgtagagatggggtctcattttgttgcccagggtagtctcaaactcctgggctcaaacactcatcctgcatcagcctcccaaagtgctaggattgcaggtgtgagccgctgccccaggcaaacccattttaaagccatgagccaaaaattataaaagacatgcaaaatattatgagtagtcacttatctagtatttgcggcatctctcaggcttggggctttgctgggagctctgagggggtggaagaggctctgtcactggccttacctggctgtcaagggctgagtgtttggtggagggaagacgtctgcagcctgggaggctgcgggtcagaaggaggtcagccggggagctgggaggatcgtggggaacccgtggtggaaatcagcatggcgagagagtggaagcaggcagaggagggctttgaagaccaaaaagggtagttaggattgctgctctgtgtgtctgtaaacttggtgttgtctctcgaatttaaatgacatgctttgaaaacaaaaaaacaaacaaaaaccaaacccataaaatctcactaagtggccagagcaagttcccggggggtggcgcatagatgcagcggtctgggttctgtggctgggggagttggcttggggtccgtggctgggtcagtcttcaagagccaccctgggtggcactccaggtctcttggtctggggggaataccctgaccccagcggtttcacggcctcctccccactcagcctgggggagagtccagggtcggccctgtccccctccccccactcctgtcactatcagtcccctgtgctcagcttactggcagggttcctcctggctgtcccctctgcctccagcgctctttcctcaggtgtccacgcagctcgtcctcacccttttctgtctctgctcagatgccgcctgaggctcccaaaacagggtctcactctgtcacccagggtggagtgcagtggtgcaatcacagctcactgcatccttgacctcccaggctcaagcgatcctcctgccagcgagcttgttacaattcctgcaccaacacggatacattgttactaactaaggccctacaccagcaaagatacattgttactaagtaaggccctgcaccaacacagatacattgttactaagtaaggccctgcaccaacacagatacattgttactaactaaggccctgcaccaacacagatacgttgttactaagtaaggccctgcaccaacacagatacgttgttactaaataaggccctgtaccaacacagatacattgttactaactaaggccctgcaccaacacagatacgttgttactaagtaaggccctgcaccaacacagatacattgttactaactaaggccctgcaccagcacagatacattgttactaaggccctacaccagcacagatacattgttactaaggccctgcaccaacacagatacgttgttactaagtaaggccctgcaccaacacagatacattgttactaagtaaggccctgcaccagcacagatacattgttactaaggccctacaccagcacagatacattgttactaactaaggccctgcaccaacacagatacgttgttactaagtaaggccctgcaccaacacagatacattgttactaactaaggccctgcaccaacacagatacattgttactaaggccctgcaccaacacagatacattgttactaactaaggccctgcaccaacacagatacgttgttactaagtaaggccctgcaccaacacagatacattgttactaaataaggccctgtaccaacacagatacattgttactaactaaggccctgcaccaacacagatacgttgttactaagtaaggccctgtaccaacacagatacattgttactaactaaggccctgcaccaacacagatacgttgttactaagtaaggccctgcaccaacacagatacattgttactaactaaggccctgcaccaacacagatacattgttactaaggccctgcaccaacacagatacattgttactaagtaaggccctgcaccaacacagatacattgttactaactaaggccctgcaccaacacaaatacgttcttactaagtaaggccctgcaccaacacagatacattgttactaactaaggccctgtaccaacacagatacgttgttactaagtaaggccctgcaccaacacagatacattgttactaaggccctgcaccaacacagatacattgttactaagtaaggccctgcaccaacacagatacattgttactaactaaggccctgcaccagcacagatatattgttactaaggccctgcaccaacacagatacattgttactaactaaggccctgcaccaacacagatatgttgttactaaggccctgcaccaacacagatacattgttactaagtaaggccctgcaccaacacagatacattgttactaactaaggccctgcaccaacacagatacgttgttactaagtatggccctgcaccaacacagatacattgttactaaggccctgcaccaacacagatacattgttactaagtaaggccctgcaccaacacagatacattgttactaactaaggccctgcaccaacacagatacattgttactaaggccctacaccagaatggatacattgtacattgttactaaagccttgcaccaacatggacacatcattactaactaaggccctgcaccaacacagatacattgttactaaggccctgcaccaacacagatacattgttactaagtaaggccctgcaccaacacagatacattgttactaactaaggccctgcaccagcacagatatattgttactaaggccctgtaccaacacagatacattgttactaactaaggccctgcaccaacacagatatgttgttactaaggccctgcaccaacacagatacattgttactaaggccctgcaccaacacagatacattgttactaagtaaggccctgcaccaacacagatacgttgttactaactaaggccctgcaccaacacagatacgttgttactaagtaaggccctgcaccaacacagatacattgttactaaggccctgcaccaacacagatacattgttactaagtaaggccctgcaccaacacagatgcattgttactaactaaggccctgtaccaacacagatacattgttactagctaaggccctgcaccaacacagatacattgttactaagtaaggccctgtaccaacacagatatattgttactaactaaggccctgcaccaacacagatacgttgttactaagtaaggccctgcaccaacacagatacattgttactaaggccctgcaccaacacagatacattgttactaagtaaggccctgcaccaacacagatacattgttactaactaaggccctgcaccagaacggatacattgttactaagtaaggccctgcaccaacacagatacactgttactaactaaggccctgtaccaacacagatactttgttactaagtaaggccctgcaccaacacagatacattgttactaactaaggccctacaccaacacagatacattgttactaagtaaggccctgcaccaacacagatacattgttactaactaaggccctgcaccagaacggatacattgttactaagtaaggccctgcaccaacacagatacattgttactaactaaggccctacagcaacacagatacattgttattaactaaggccctgcaccaacacagatacattgttactaagtaaggccctgcaccaacacagatacattgttactaactaaggccctgcaccagaacggatacattgttactaagtaaggccctgcaccaacacagatacattgttactaactaaggccctacagcaacacagatacattgttattaactaaggccctgcaccaacacagatacattgttactaactaaggccctgcaccagaacggatacattgttactaagtaaggccctgcaccaacacagatacattgttactaactaaggccctacagcaacacagatacattgttattaactaaggccctgcaccaacacagatacattgttagtaactaaggccctgcaccaacacagatacattgttactaaggccctacaccagaatggatacattgtacattgttactaaagccttgcaccaacatggacacatcattactaactaaggccctgcaccaacacagatacattgttactaagtaaggccctgcaccaacacagatacattgttactaagtaaggccctgcaccaacacggatacatcccattactaactatggaggtgctttattcagatatcctcagtgtcacctgttctcctttggccgtctcagggttcctcccaggacaccacattgcattcagtcctgaggcttctctgggctctgacagtttctcagactttccttgtttctgttgaccttgacagttttgaggattactgctcagagagtttgtagactgtccctctgttggggtttgtctgatgctttcttcatgattcgatcaggttgtcactttggggaggaagtctgtgaggtcaagtgccattttcatcgcatatcggggcacacccatctgcacaccttcgctattggcgtcggtcgtcatcacctgtgcaggcgtgctcacccggtttctccactggatccagctttattttcctttctatcaaccatcacaacctgaaactgtgggcgtccgtgtgtctcttggagtctagtagaatgtaaggccctcaaggcagaggcctcgtctgtcctgtttgtcaccagagcctggtccgcagtggtgcctagtaagttagtccacccattcaccacatccttacagagctctggcgccaggcagcaagtgctggtgctgcggacagagccacagacaagccggtcatagcttctggcctcatagaccttggagtctaacaggggagagcctttcaaagatttgctcccattgctaatgggacaggatgagacagggtgctgggggactgagagctgtgatgggggatgctgcctggagggctggggtggtctgagctctggaggaggaagtgctgctcaggtagtgagggagggggtggtatctgggttaggggaagtggcgtgtgcagaggccccgtggcgcagatgagcttgggctatttgaagaaccccagcgaggaggcagggtgttcaggtggctgtggctgtggcccaggggcaagagggagatggggaggagtggaactggttaagaagtggacagaagtagggtgagaaggcaaagtccaggatctgagacaggaggatggtggccttcctgcctcccttccttcctgccttccctggaaaggagcacgcctggggtgtggtgagtcctgttagagatgctcacggaaccccctctccccaccccgccccgtggcaggggcatggagaggcgggccctgtgcttagggggtcctgggttagggacggcgctggaagttgcaggagggcagaaaccggcctctgaagagagtggggagggagaaggggagctgtccagggccctcaggcatgcatcatgtaagggtcaggggagtcagggaggatcccccaaaggaggctgtagagggtgaaggaggagggcaggaagccagtgagtgtgggggtctgtgggccatggggggtgggggaggcagctctttgggaactgagggggttcgggtgcagccctgggactcccaggccagtgctctccctccccctgccagccacctcgcagagagagcccggggtggaagcagggtagttggtgctgtgccctgaccttcagaggtggcattgacaagaccagaatgccacagggccatgcacctctccctgcaaactgccctttaatttatttttacctctgttccttgtgggcttgtgtgtcaggttcgatatttttatgttactgggaaaatagaatgtgcttcacagaaatttgccttgtggccaatattgcaggttgcagctgtttcagagtgacaggggacggtatattctggacttgtgcccttttgttcatctctgagaggggccataaactcccatttccgagaggttactgggaccaatgagatcatttattagttttccttgcacaggaaaatcacacactctgtgccattgattgagtccattttattttgtggaatagacatgtcagaagcaggattggccaggtggaattgtgtttggcgggagtcctgtctttccataggtactttcataatggaagcaatctccttctgaagtgtatcacccggtgaactgaatggaaaatctcttgtgaaaaggcttaagaggaaggctggcctggaaaaatgaaactcacatccacagagagacttgtacctgaatgttcatgtcagcaccactcacaatacctaaaaaggggtgataaccgaaataaccatcaaccaagggatggagaaacaaaatgtggtcccccatgagatggaatatgattcagcgtaggcacgaaagaaggacggaaacatgctataacatggatgaaccttgaaaacatgctcagtgaaagaagccacacatgaaagggcagacatcatcggctcctattaatatgaaatgtccagaaagccaaatccgtggagaggggaagtagatcgaatcacacacttttaaaggatgaattgtgtggagtgagaattctatctcaataagggtgcatacaaaatgcagctgacggtggtcacaccaagcctgtcagtaatgatgcataacttccctttgctgtcctgggttagggtgggttgagacttagggtgaccagggaggaatggatatcttgtgggtcaccttgactgtcttggggtgatgagagggcagtattaccaatgcttaatcatttgcccccataccaaggtgaacacgagatgctctggtcctagtggctgcagagttgtgcagcctctgtccctgtgctagctctggacctggtggtggccgcagagctgtgtagcctctgtctctgtgcttgctctggtcctggtggccacagagctgtacagcctctgtccctccgcttgctctggttctggcggctgcagtgctgtgcagcccctgtctctgtgcttgccctgtccttgtggtggctgcagagctgtgcagcctggccccagagctgtgcagcctctgtccctgtacttgctgtggtcccggtggtggctgcagagctgtgcagtctctgtttctgcactttccctggtcactgcctcattgccgtggcgctggtggactgaggccataatgcctgcgtctcctgcaggtcctcctcgactggattaatgacgtgctggtggaggagaggatcattgtgaagcagctggaggaagacctgtatgacggccaggtgctgcagaagctcttgggtgagttcacagcagggacagctctgtcccacccccatctccctgcagcggccctgggctgggccaggattctctgcatagtgacatcggccacaggtcctaggaagacactcaaagctgcagtgtgcatctcccaggtggtgcccaggccctgggctgtggcttcagggtcctctctccccttgccgtttctacagagcacccagccatggggcagcagcaggttggggacagcttccaaaactgcctgcggctcccatcctgttgggtctcaggcccactttgtgtccctgccaccctcttttgacttgaactccttcggttcaggatgggaggcagcaggagggaagcgggtctgcagcaatattctgtgagtgaatgtgtcaccaaatacatgatagctcatgttccctcaccaggggcgggctctagtgtctgcatttgctgggtgaaggcagtttagtgatcttcccgggactgactgatgcatggtttgatgtgcagacaaaccggttgtttattcatcagatgttggatgagtcccgagggctgggtaccagggatacggtgatctttgaaacagacgtggtccctgtcctcagaacttacagtctgtctgaaaagacaaatatttttgaatggttacagttactgttcagattgcttgtgatgagggccttcggagatgccgcaggttctgagtagaggacgccggcctggcctgggggtggggcggccttgcagctcatatggaagaacgagcgaagagttgccaggcaaagaacggaagagcagagttcgcagatgatgcatgagaggaattcttggacttgtagtgggttctcacgatgcctggcactgtcatgtctcattgtcacaatggtcctagggggcagtactgccatcgccttcgacaggtggggacgttggggcccacagtctcctggtgaacagccgggcagcctggccccaagcatagctcttgagcccggccgcggggcctttctctgacctgtctacggagcagccccaggtacagggcctgggtcaggcgctcctgcatgatcacagctggttctcacaacagccctgggggtctggctgaatgagcagatgtccctggttgtccccacgatgccttttgtttggatccaggagtgaatcacacatgaacgtttgtctcttcttttaggcttctttcatctggaaccgccttccctttccctctctccgttctgttctgtctttctgtcttttatgacgttttggaagggtctgggcctcttgtcttgtagaatatcctcccatcgggatctgtctgtctcctcacgatgagatctgggtcacatgtttctgctgagagtgtgactgcgctgcctgcttgtcctcctgggggcatcgtatcaggaggagcacacaatgtcaggctgcctgtcattggtggtgctgacagtttgatcactgggttaaggcagtggcctatgggtttctccattgtaaaggtgcttctttcctgttaaaaaaaccacttttttatttgttctattttggtagagtcaggatctcactcagttgcccaggctggagtgtagtggggtgaacatagctcactgcaccctcaaactcctgggctccagtgatcctcacaccttggcctctagagtagctaggactacagatgtgtaccaccacacttggctgttttttttttttctttttttgaaatggagtcttgctctgtcacccaggctggagtgcagtggtgcgatctcagctcactgcaacctccgactccctagttcaagtgattctcctgccttagcctcctgagtagctggggttacaggcacataccaccatgcccaggtaatttttgttttttagtagagatggagtttcaccatgttggccaggatggtcttgatctcctgacctcatgatccacccacctcagcctcccaaagtgctgggattacaggtgtgagccactgtgcctgactggctaattgttttgtattaaatttttaaatttcatttttttgtgttagagacagggtccttgctttgttgcccaggcctgttttgtactggcctgaagcaattctctcatgttggcctcccaaagtgttgggactacaggtgtgagctaccatgctcagcccttctttcctttttaatacatggtctctagaggggcagactctgggactttgtgaacgtcctgttcacccatgatgcgctccccatgattttatcatccgctgattatcattctctaaattatgctaaatatcatctctaaatattatgctggaggttgcaaaatagtgatttctgtatctttatcatggcttccccacttattagctggcattttcttctgtaaataagtgcttttcttctcctgtgtccttttttaaaaaaaaaaaatcccctaaaatagaataacacattcccctggactgatgaattattttatgttcaaaagagaatggtaattagatagcaaaatctgggccttatgggtgcttgtggctcctggggtgtcattgcttctagtctctttaagccaaaagaggtagcaaatatatagttttttaaaaattgtgagttcacactgctacttctaattccagttcaatgctacaagtttatcccttaactgtcagcattcagtattccagtctccagggagaaccttggttccagaaatatatttgctatttactctgattgcatacaaaaatagtgtcagaattacaataccaatacctctatcaactacaaacatgctaggtacaagatttctttgccattattttttaagtacaatatatccactaagagtatatagtcagaattctgtgttcagaacttaactgaattattttctttttgagtggtcatgtcatccatttaatgtataaataaattaatttgtttctctctgtatttagtttttgtgtatatgtttacatttaattttatttaatattacttttaaaaatgtaaagcatttacatgcttcaaaagtcaaaactatggaaatgacataccttgaaaggtcttagccaggtgtggtggctcagcctatcatcccagcaccttgaggggctgagccaggaggatcacttgagccgaagagtttgagaccagcctgggcaacatagtgggacctcgtctctacaaattaccagtcgtggtgatgtgcaccgtgcacctgtattcccagctgctcaggaggctgaggcaggaggatcacttgagcctaggaagttgaggctgcagtgagccatgattgtaccactacattccagcctaggcaacagagtgagaccctgtcgatcaagagagagagagagagagagagagagagagacagagagacagagagagagagagagagagagagacacagagacagagagagagagagagagagagagagagagagagagagagagagagaggtctcactgctttctctcccacgtatacactcccaggtaacaattttcaatggattctgattttatccttcttatgtttctttacaaaaatgtccatatacacacctactcatttcccttttattccttgcataaaaggtgatgtattttgtacattcttttacacaccctgcttgtttcgcttaatatgttctaggaatccttgcatgtggagatcacctttctttttctttatggctgcattgtactccactgtgtggatgttccttcgtttattcacccagtctcctatgtggggcatttttgtcatttctaatatttttctatcaccagtaatattgtgggaatatcctcgtgcagatgttacagaaactagaattgttgacctcaagtgtaatgggttgcttccttgagctgaccactgtagaggaaggaattctcaaattctgagaggcttcacctctctcacctctggccttcccaggtctgttgtgccttggttgatctttcctgtagccactttctgtcttccctggactgttcagtgtgcagacatgatgtaatatttccattaaaaaatggctcccttgctcctgcaacactccaatttctctgcatcactcaaatgtattgaccattagatttggcaccggatgggtcattggtggcccagatgagagcagttttggcgcagtggtgggggtaacacgctgatcggggagggtccaggggcagagaactgtgcctttgaggtacataattttgagagggagagagaggaagggagtgaacctgtggttgctgcagctgcttttcttttcaagacagggtctcactccattggctggcctggagtgtgggggtacaatcatggctcactgcagcttccacttcctgggctcaggtgattctcccaccttagccgcccgagtagctgagagtacaggtgcatgccaccatgcatgacttattttttgtattttttatagatacgaggctttgccatgttgcccaggctgatcttgaactcctgggctcaagcaatccacccacctcagcctcccaaagtgtggggtttacaggcatgagccactgcgcctggccaatacgaggctttgccatgttgcccaggctggtcttgaactcctgggctcaaacaatccacccacctcgggctcccaaagtgtggggtttataggcatgagccactgcgcctggccatagtagctccttttcatgtctgtccactgggaaccatgcaagctgcctgctgaaattacgtggatggagcccctggcacagtgcctggcacaggtctgtcgtcaataagcaggagttgttattgctgttgttttttaaacagacaaataaatgccaagagcagaactaaggagtatctggctcgctgctgggtaccccatccaccccaagtcccctgggtgactggcacatgacaaatatttgttgattaagtcaatgaaagaattcctgcagtttcattacctatgaagattgtggggtcctcttgtgggacatgaaagggggacagatagatgagtattgtttggatttttggtcctcagtgccatccacagactccagaagggatcagctatttgctgaacaatctttcagttctcatagagccctgatatgttttcagggtccacaaatgcctgtgacggtggcctcaagaacccagtgtccccttgtaggtgggatagcatacctcttaaaggtcagcatgagattccacccatgtcatccccagcattggtggggtcagcagatcctctctctggggtttcttttctgctcaacctccctgctttgatggactgcacagacaagccccatcttggtggaagggtctccccatgggctgtcctggagggtcactcccacagatatgccccatcctggtggaagggtctccctgggggctgtcctggagggtcagtcccacagacaagccccatcctgtgggagggtctccccgtgggccatcctggagggtcagtcccacagacaagccccatcctggtggaagggtctccccgtgggccgtcctggagggtcactcccacagacaagccccatcctggtggaagggtctccccatgggccatcctggagggtcactccctcagggcagggctggtgactggggtgggatcatgtttttctccgctgttgtgacagaggagtatctgctgcaggggatacgtggactgcggggggactgccacaaggatgtgaatgggtagggggtggggtgctgtttaggagagagagagactaggggagcccctgccagagaaacttggccctgaaaacacaggggtgcagcatctgtagctgcctctggacagagtttgcacactctgcacaaatggctcttacagaccagctcttggagggaaacctcctaggcttgtgacaggtggtggtgagggtggggggatgaggtgctggggaggccatgtcccataactcactctgaaggacacagtgatgcttggaccacattgtttgtccttattcatctggccctcagaaagtatatttggagggaaacatgtctgtgtttgttttggtcacacattcattcattcatctgatgaatgaatgttcattggcttacatgtgtcgggtggctcttggctgtagagacacagtgggaaacaagagagatgagccccgcaccctgcgcctgcccactcccccagcacacattctagcagagtgaagaaagagaagtattatggggtggagtggttcaacctgaaacctagatgatgttttaaaggaatgacaagtgctaggaggaaagtaatagaaggttatggggtacagtggtgggtgggggttggggaaggcaatccagggaagctcctctggggaggcgacatctgagcacatgtctgcacagtgagcttgggaagggcgttctgggctgaggctctaaagcgagaaagagcctgttgtgttggaggagcagtgaaaagaagcggaggcggggcccaggtggcagagagggagggagagagccaagagatgaggctggggccagatctcattcagccctgctagacaacagtctattccaagtgacaggaagccattggaggttttgggtagggctgtgacgtggattgggttagagtttaaaaggtcacttaggcttctgggtgcaggatggatggggaggagagtcaggagttggaactgagagatcagtcaggacaccattgccatggcccaggcatctgatgaagtagctcagcccccagagtggaagggcagacatggggaggtactgtacagttaaactgccataggaaccaagactgatggccaggtttgtggcttgagcaactggtaaatgggaagccgttgggagtagggtgggaggttgggaaggcgggggtctgtgttgtacatgctggggctgagatacctgcccttttggaggtgatgctgagcaggtgagcctggagtccaggctgcagtgtacgtgtgaacccagcagcactgagctgatgtttagcaccgtgggactgcacggcttcacccaaagagggtgttccaaattttatttggctgaatgccgaatgcccaagaattaacatctatatttggctaaggtgagaatccccatcttagaatgagatcccatggtacaagaataagtctgaaatgttcatcaagattgtgtcataattatcacaattttattattaaaaacgttagtggccaaagttttgatgttttgcattgcagtatcagtacagtcacacccagcactgttgggtaccacttgctcttgaggtcttcaaaccagacatttgtgatgctagatgctcactttcaactcagaaggctggaggagcacgtggacctttggctgatgctgtctgaagggatactcctcatgtgaagctgcccctgggctgtcagtttttctctctctgagtggctggttatggtagagacttacctcctctttgatcttggatgtgaagattgggctgttgctggtgatggccctctgttgaagcagtccccccaattggtactttgctccctacctgaagcagatattttctaatattttcagaagcaaacttgagtgttttgttcactttcattttttatttctgattcttttgcctgcacctgtggcttctcccacccaatgacttgaaacagtatgtcagcaagccttgtatctggcagcctggctgtggaactggccctcagaatctcaggacaggctctgaatttgcatctgcatctcagccgtggttgcctgtaaaccatgccagtgccttctatagagcagaattacaggggcatctttaaagctgcatcttcccctctcaaggcacatccttttggttccctcttcagttagtgctagcaaatgcagcacttactccggagttgctgtgattgtccatgagtcctgctatatcagttgtgttatccataaagtataacatgaggcttcctttggctcaagcagcctttttcttgtggagtagctgctgttccatcttgtttgaataatcacataagcacttgagaaggcaattctaaaatctcttgagtgtcaagtggtttgacatattaaaaccactttttttttttgtactgaaaaaaagaacagtggactagaatattcagatagtaacacagcatcagaatgtcttgcctcattttgtgaatgttgttacactgaaatgacataatatactgttgatgtgagatcctcttgatgtgatactactgatgtgatcacctgatccttgagctccaggatgccaggaatgacactgatgtaggcattcagctctttggctttccaaaggcagaagcccaaaccaaataggagattttagctgaataccaaggtcaaagccaacttctgtgcatccgtagtagagaagaggtctgaggactgggtctgggctgtcagccattagtggtcaggaagaggaagttctggcaaaggtcagtcacaagggagggggagccagaggagtgttgcattcaggaagggtaaaggaggtgtttctaggaggtgagaggaggaaagagaacagacttctggtttggccatgtggaaattgcccagagtgaaccagcaggacccctgaggagtccctcttctttttttttttttctcttgagatagtgtctcactctgttgcccaggctggagtgcagtggcgtgatcacagctcactgcagccttgacccctaggcttggatgatcttcccacctcagcttccccgggaagctgggatcacagatgcataccaccatgcccagataatttttgtattttctgtagtgctgaggttttgccatgttgcccaggctagtcttgaactgggctcaaacgatcctcccaccttggcctcccaaagtgcagggatcacagggatgagccactacacccagccgaatccctcttcttgagagaagattctggaagcagctgccgggttctctgccacatgccaggtttctgggggtgtagctcccctgtgtttgcagtgcagccctcaaggtagactgcatatggccagagtgaggtgcccgtgctgtgggagctcctggctgtcgtcctgctggtcactcacgggcacaccctctccttgtgaaggtgaagttcttcatcacatgtgtactcaacccccatgtggccatcactcagggtcacctgctacatgggagaatcctccccagttttctctctttctgtgctaggaagataggggtcctggccacaacagagccctgagctgctcctgcggcccccgccagtgggcacagtgatgtctgatgatgcaagtgatcatgtgccgtattctctgttgcacaggagtcacccaagacccagcctaaggcagcacacaggcatggccagtctctttggtctctgttgcctgctgtttccaccaccaaattcatattttcaagtcctacatgcagggcccacccatgtgacctcattttaccttaactgcctctttaaatacaggcacattgcaaggtatgagagcctcgcccactaggagagatgggtagcctggcagcctcccactgtccctgctaccagccagccctgcaggttgaacctcggaatgtgactgtatttatagagataataataggctgggtgtgatggctcacacctgtaatcccagcacttccggaggctgaggtgggcagatcacttgaggtcaggaattcgagaccagcctgatcaacatggtgaaaccctgcctctactaaaaatacaaaaattacctgggcgtggtggcacatgcctgtaatcccagctactcgggaggctgaggcaggaggatcgcttgaacctgggaggcagaggttgcagtgagctgagatggtgccattgcactccagcctgggtgacgagagtgaaactccatctcaaaaaaataaaaaaattaaaagaggtaatgaaagtaaaatgaggccatacgagtgggtgggccctaattcaatatgtctagggttcctataaaaagaggagattaggacacagacatgcacagagggagaccaagtaaggacacaggaaggagagggcagccatctacaagccaggagaggggcctcagaagggtctaccctgccggtgccttgatcttggacttctggcctccagagctgtgacataaatctccgttgtttaagccgcacggtgtgtggcatgcttcgttgcagcagcccagacaaacgaatccagtgtcctccgctcctctgccgactcctcttcctccaccctgggtgacgtggccatgttcagtctgcggggccggatggtggcaggtgcaacgggggcgcgtcaggcttcccatctccctggtgggcgaggctctcagaccacccagttctgtatgatcctatctctctccttccttctccaagctgccctgctctgccctttccatggttgttgaacacctgtgggacctacttgctctctacttccagggcgcaaattcagacagacagctgtggatgactcagcgaggagctgttagatccagatggagggaaatcagatgaataagcgggaatcgtttccactcccctgcaggatgtgttttgttgggctgctttgttttttctcttgcagtcattgccacccaatcagatgttttttacgggtgtttatctccccactagggacctctgttatctgtgccatatccagcacctaggacagtgcctgtcccatagtaggtgttcagtccctatctgtgagccaacaaacgcatgatcgaaggggtattccgagcccagcaggccttgctctagaattttattatcttgaaagggatgccaaagctgtttgttttctaattgagggaggggaggctgctggggagataacactgaagacatgggggcctccagctaaaatgttttaaacagaactttgtgctgggaaccacttgcaaaacagaaaccccatttgtgactggcctggacttgattgctttcatgatggcatgtcaatgccgcgtcactgacagcagctgtgtattgaaggctctgtgctgagtgcttgcagtcaccctcccagtgaaccatctcacgatgctctgtgacgtcgcttttgttgttttgcagagtggatctatcagtaaacactggagtcttagaatcgaagactagcagggaaactgggggtccttcctgctgtgtggccctgcagcgggcgtggggtggggcgctggtggccggcacctgccagtacctactgctaacaaaagggaaattgaaggaggtgcaggctgggctggagctcagtctcagtaattgaatcttgatgaaatgtgacagttcttgtctgtgctcctccggattgtttcctgttcattcttggtaataaaatcatcgccagttctgtgaatatctaatctaacttcctattgtggcattagaatgtttaagaaacaagaatgggagcctcaggtgtgtggggaggcagaggcagcttttaagaccttttttaaaattatctttatcagtcctctcccttttgggacccacagggacagtcttctcacctcctgactcccactttcattcttcccaggtaacctccttgcctctcaactacatcttattatgttttttccattttgtatgcatagaatgttcccgagtataacacccacagttttatccttaactattcttcccttttcaatctggcgtcattctctaaggaagattagtgacctggaagctcagcgttcatggttcaacatctcaagacgcccccatggccacatggtaacctgccccgcttcggggacctccttgaggctggggtcttggtggttttgagttcctccagtatatctctctccccttcctccctccctccctccctccctccctccctctctctctctctttttttctttcttctctctctctctccttccttccttccttcctttttctttctttctctctctctctctctctctttctgaggcagggtctcactcaggttgcccaggcttgggtgcaatggcatgatcttggcttactgcaacctccacctcccgggttcaagcacttctcctgcctcagcctcccgagtagctgggattacatgtgtgcgccaccacgcctggctaatttttatatttttagtagagacgggatttcaccatatttgccaggctggtctcgaactcctggcctgaagtgattcacccacctcggcctctcaaactgctgggattacaggcatgagccactgcgcctggcccttccagctttttctgaccctcttctcttgtgcttctcattgcagaaaaactggcagggtgcaagctgaatgtggctgaggtgacacagtccgaaatagggcagaaacagaagctgcagacggtgctggaagcagtacatgacctgctgcggccccgaggctgggcgctccggtggagcgtggactgtgagttccacgccacagggggagggactgtctggagggagcccgtcctctcgacattcgtcatccacatttgtcatccacattcatcatcatcccatctggccttgcatcttaaaattgggttcatctccctgctctgtaagaggtagaacattgcaggggagaagaacaggagaagggttagggagatcctagaaaagggacctggtcaggccacaattctccatcctccccatgctgcagaggagagaggcaatgtttatggatgggtggatcagagggactttgagagagagaagcagccttggggggttcttgttgggactcaaccccaaatactggtggcagcaacacctagtgggctgtttgtctatgaccctggcattatgagatgtgacatcacggtattttcagccaagacatgaacccggcaggtgaaagactaaaccaggagaagctggaaagttctcctcggtcctgcccactccttccccacctccctcccctggaagcagggccatgagggtgtggcttcagggctctctgtgctgggccagaggtctccgtgctttggtgagctgggctctcagtggtaggcaggagaccctggagcctggccttgcacccggtttcttggtatcgagaccttgggcagacccaggctgtctcgtgggtggctgggtccgtgggtggggaatcgggtgccttgtaaactgtaaaaccctgcaggagaagtggtgatgttgaccaaacctgagtccgcatgctgaggaagagagaggacagactcaggcaaggcaggggctaatgtctaatgtccccagagtggcctctgctcttggcagcctacccttgttgggatggttcattgcggagagggagcccttttttagtgccagagataataacgcacatccttgtgatgggtaagtggccgtgacctgctttccatgctcttttcccttctgtgctaattttactatcctgttcctttccctcatcactgcccaatttattgcttttaaaaacattgtgcttctaaaagtggttgcacaagtcaccttaggccaacaggaaaggagacagtgaagctagaagtaaattcaccaggttgctcatcagctctcttgatttgtccacacttcgctccatccttgtctcgctggggtctcatttagatgctgtgtctctgttgccttctgcacgtgggctcaggttcctgtgtaacctgatctaaagcgtctcccttcctccttcctcctgcagcaattcacgggaagaacctggtggccatcctccacctgctggtctctctggccatgcacttcagggcccccatccgccttcctgagcatgtaacggtgcaggtggtggtcgtgcgggtgagtataaccgagtggtcggcctgcctgtaactccgccagagaggcaacatcttcctcctgcagttttcctgccctccccctccttttttccccccaggaggctaccttctatttttcccttttgacaaaatgtgtgtctcaccctggctccgagataaatgattggaacgggaacaatggcattgatttgatgagaggcagaagcagaggcatgagggtgttgaggtttaattttccacatttttgaaaagaacattcatttctctccaaagccaactggttggaattcaatccccttgaatgtgcttattactcattggaggaggttggccccgcgggatgaaacagacacccaaattaaagccgctttgcattcgttggggattattcatcatgccccatcatctctttttttgggttcatttctcttgattcacttggagaaatggaaccagaacccaggtccttctaacagagggtgaagtagagttacctttctcttgctatttcccttacatttattttttattttattttatgttttgtgaaagggtttcactctgttgcccaggctggagtaccatggtgcagtcatggctcactgcagcctcaacctcttgggctcaagcggtcctcccgcctcagcctcccaggtagctaggactacaggcacatgccaccgtgcctggctaatttcaaatttttgtagagacaaggtctcgctatgttgcccaagctggtctcgaagtcctgggctcaagcgatcctcccatctcagcctcccaaaatgctgtgattataggtgggagctgccatgcctggccttatttcccttacatttaagtggacagtcgctgcctagggttcgtgtgtgcagtttccctcagtaaatgtgcaatgagcgcctactattctctaagcactcagcataggctgccgagccactaaaggaggaacacatgcctggcgtctgtgggggtgaccactgcggccagagttgaggtcacgctcggaaccttggatgcctctgtgtttattttactcgagacatccggctccactttcctctggtttttaaacttctcagtcccgtggtctctgtggtcggggaggacctggctgtcactgtgttttccgaacccattctggcccctctgttaccctgggagctcagtcttgaccggacgggaatgctcctctctggcatccggcaagggccacctgccatgtgtccatgtttccttcctaaggaggatgtttgtggctggtggtggtgactcgggacctggggggccattcctatggccccgtgtcttggccactggttcacaggcagccggcctgaaaaggcttccctaggacacattgggatgtggttcccaagcctacctacgtcagctcggggccccaggagccctgtgcaggctcagaaactggagtatttcctttcaggcttgcacttgggtccaagataatctttgcggtttgcagaaagtttgaaccaggcaagcacttgctggtgcttcctgccataacgggttagaggagtgttgtttggccacgaccaaagcagaatgaaacgggagcagggggtcctgtgaaccgggcgcagttactccccagaccttagagccgccttctgtcttctctgcagccccctggcctctgagcttgctcaggggaccccttatctaaccccagatggaatggttggtgtaagggatgtggcatttccagggtggaaggaaggaaggaaagggccttatttactgcctggccacgtggctttgggctgatcacttgcttttgctgagctgcaatgcttttccccataaaaccaagattttactacaaacctgtaaaacatccagcttcatgtctacaatcctagacctgggcccagcacctggtgggtgcctcaggcatgtttgatccttgactaggtgaacacaatgtctggaccttccttggcaggcactcctgagaatcaggataaatgtcacccacactgttgttcaataacaagcaccaaccctgagtattccatggaggtcaaactcaggaaagggatggaagcccagatcttggtggtgtccactgtgggctggcccagcgggaaatgagttcccagtcccttgaggggttcagtggtggttggattagccacccaggctccatctggagctcctgtgacaggcgggctgccacccctaccatcaccactgccatgcccccctcactaccatcattacttttttttttttgagatggagtctcactgtgtcacccaggctggagtgcagtggcacaatctcagctcactgcaacctctgcctcctgggttcaactgattctcctgcctcagcctcccaagtagctgagattacaggcacatgccaccacgcccagctaatttttgtatttttagcagagaccgggtttcaccatgttggccagaatggtctcaatctcttgatctcatgatctgcctgccttggcctcccaaagtgctgggattacagctgtgagccactgtgcccggccatcattgcttttctatacctgccacgctctgggagaagtgtgacatatactgtgtcagtttcctagggcagccataacaaagtaccacaaaccaggtggcttaaaacagcagacatttattctctcgcaattatggaggccagaagtctgaaatcaagatgttgtcagggtaggatgtcctccctcatgtctcctcctctaggggaggggtcttcctgcctcctccagcttctggtggtggctgtcagtccttggtgttcttggcttgtggccacatctctccagtctctgcctctgtcatcacatggcctcctccctctgtctgtttctgtgtctgtttcctcttctaataaggaggtgagccatattggattaaggaggggctcaccataatccatgatgacctcatctgagctagtatctgcaaagacccttatttccaaatgagatcatgttctgaagtttgtggtagatatgaactttgggggaccctcttcagtcccgtgcacacacatgattgcaggggatgttccctgttatttatgttccttccaattgcatgcctcacctctcctggctgcaaagcatagaggatccctttggggaatcctgacctggggtgtttctcctgagacccacacaaatgccaactctcaaggccacgtggagaccagagggtggggaggaggatagggacaggttgtggtcgctgaaaggcaccctgcccagggtcccctgctgtgtactcacccaggcctggcatgcgtgttcaacaccacccctccttctcctgttgctcttttctaagatgatctccggccccgcagcttcgtctgccctgtcagtgcatctttcctcaactctccactgcctgattttgtatgtttattttggggttttcagaaacgggaaggcctgctgcattccagccacatctcggaggagctgaccacaactacagagtaagtggacccctgtcttgcccttccaggccctgctgccccgagtgagtgggaccccaggctgccacttcagccagggacaccagcgcccatggggctgctcccgctccacaccccttctctgtagcatgtgattctcatgctggttcccaccccagctctcctccctctgcacactttcttcagagtttttaacattagaactgagttaccttccacagactttgaattttttcattcctatcttaaaaggtgagctgtaagaacattgcaaagtggggcaggcagagagagttcaggatggttagagagaaccattgtctcagttcatttatccatctacattagccccatcagaggtgggagctacatctttaaaccagaactttcctttgacagacactactaagccatctgttatctcctagagaaagccagagggcaggtgttcagaagtctaaaaggcttcaaatctattgaaaatagcaaatcaaacagtatctgtggtatgtggttttaaggactccttgtgataacctgctaagaatctttagaattcactgcatttgtgcctcttgactaaacctgtttcagatgaaacagaacatttaaaaattgattgtctcagctaatccatcagctaagttcacagagtgattaattactgtgttgtgaattcatggatggtatttcaaaaattggagctgacacaggaaaccactcgtggcttgcaagctctcagggaagatgatgggacagtggagtgcaggctgatgcatgtgcagaggcccatgaagaggcctcccagtctgccccaggcccacgaagggaacagggagagctggaaaaggggaggatgagaatgtggttctttgcccagcacagtgggcctttggcagcagctctgcctattcagcagtaggagaagggctgctcgtggggaactgggattgggctggtgtcttagttgtttattgttgtgtaacaaatcacccccaaagtcaagtggcttaaaacaacatctgtttcatttgctgctcacaattctgtgggtcagcaatttaggctgggctcagctgggcggttgttcagccagtctcgcctggggttgctcatatgatgcagacatctgaaggctggatggaggctggggaggctgagatgggctccccctacctctggtggttggtgttggcctcccctgggtctctttcctcctcacagtgctgggcatcttcccagggtgctctcagggtcctgagagagtgagaatgcagctgcagtccccttgaggccttgtcttggacatccatacctatgtcctcaattctgtgagtcaaagtgagtcacaggtcatcctggatcaaggtgcaggaaacagactctgcctccttgtgcaggaatggcctgtgcacattgttgggtggtgggcatgctgtgataggagttcccctctaggtgagggggtcccatatgaggacagcaaggaggagctgggccccctgccataaaactagaatggtccagagacagagaatgagcaagtgggtgggagaattgtctcagctattcatcagcagtaagtggccccaaggacctgctgcatgccagcctccttgctggatcaacagagacactgagaggtgggctgagtgcagttcttttcctccagggcgacccatcctgctgatgagaaaggatgcatccacagacatgtacagtctaacacaggggcttgtgggaagtgcctcggggccctaagggaatttccaggaggaggggagcaccccaaagtcagggaaggggagatttcagtgaaagccacctcaatcagatatcagatggccctgagcagtgaggaagggagttgggattttctagcctgagtcagtgtccctctgccagccagggtcagggtaaaggagaggctgggtcacctctccaggatgatgccccaggtaggttctcctcagggctggtcatcccatccttgtctcctgttccttcccctccccgtggctgcggaggctctgacggaacatttgaatcattggatgtctgctgaaaaccagcggcccaaagatccacattcagtttcctaaggcagcattgccacctcctatccagtctcagtgttcccctttctctttcaagaggtggctatgaggtcaccccttccaggaagccctcctgtctgccaagcaggagtgcttggcttcctgttagttcccttagcctctggacacatgtggccaacattgaaatattggcttatgaggtctgtcactcccaggcatcctgagggcagggccacatagtgtttatctccaggggatgttaatttctgtatctgcacagcctgcacatagtaggtactcaagtaagtgcttgttaaataagatggagccaaaggacttgagcctagagggatttggggacaaagtaaagacttccttgcctctcaggaaggcagtgcatggaaaggatctgtgcactcactcactgggaatctttgaggagaagctgctcaccactcccgtctcccccattgcttccgctgccgcctgcctgagatcagggcctggcctcgtggttctccaggatcctttagttccacaagtcctgcaagtacattgtgtttactcctggaaacatgagtaacctgcaaccttgtgtgtgtgtttgtttgtttatttatttatttgagacagggtcttgctctgttgcccaggctggagtacagtggtgcgatcccagctcagtgcagtcttgacctcccaggctctagcgatcctcccacctcagcacctgagtagctgggactagagcgcacgccatgacacccagctaattttgtatttttcttagaggaggttttgccactttggccaggctcgtctccagccttgcatttttttattgttttgtttgtttgtttgtttgttttttgagacagagtttcactcttgttgcccaggctggagtgcaatggtgcaatctctgctcactgcaacctccacctcctgggttcaagtgattctcctgactcagcctcccaagtagctgggattacaggtgcctgccaccatgcccggctaatttttgcatttttagcagagatggggtttcgccattttggccaggctggtctcgaactcctgacctcaagtgattgacccgattctgcccctcaaagtgctgggattacaggcatgagcccctgtgcccggcccagcctgtgttttgagcgttccacggctgctggaagacctgttgtctgctgaaatcttcatattaaccactcttctgatttaagtacctcccctccaaacaacattaccagggtggttaatgtgcaaatagagatggtgatttgctgctgaccttgtgcaaacattaataattcacacaagcacctctcgtttataattagagcaggctggaacacagcaccatgtgacttgcgttcttatcagtaggcctttacctgggcagcgagggcccagctttctggctggctctgtccctcatcctccattgtgctgcttgtgaaactgtgttctgagtgacccatctcatggctctctctgtgttcttgtttgcaggatgatgatgggccggttcggtaagtaaccccagggaaagtggggagatggaggcatgttagggctcccccaggaagctcccagagagtgtacatggttatctggagggagtgggaaactagatgggtctcactgcccccatagttctggaatcctagagaaagtgcacagcccacccccacctttctgtataatgggcttgtttctcagagctgagagtggctgggttgtgctaggaggagtggggtggaaggctgggtgaccagctaggggagcaggaggggcctgggatgtaacactggctggaactgtcaggggctggagcaagagtggttgagggtaaaagggagggaggagaggcagccagcacatggagcgtcgttagctggctggaagagagtggctcagctctgtggatgtccttccatgtgtattatttcctcctggaaaccactggtttagcagacttccttagagtcaggcagccagggctcattcctggctggtggcttgtggcctgccccttcctctctctgctcctcatccgtgaaatgggagtgtaaaaggctctccccaggcaggggctgctgtgagtattgggtgagatcacaggtgagtgccctgcttggccgggggacagccctctatgtgggctggttttattagtgttggttttcagtggctcttcccaaagagagagaggtaatcactctctcttccctcatgaaagcctgagacctcatcttcatctcggtgagggatggtaacgtttcaaccctcagtaccaggataccccggccctcggcctggccagcctcagtgctttgggaagcatttcaaaagagaaacctcttgacccccagataccctgttctccagtgagcagggaggggagaacagctcttaaaaggaaaaatggaaaccagatagaagtctcccacctgcctctctagcggagctgatatctgtcttttgggggccctctgggtgggggtgccaccccctgagtcctatacaatgagggctgggccagcttggccatggggctctgtaacctcaagttattatggggaccagctaggatgccattgctgcttatctattgtattagggttctctagagggacagaagtaatacgatagatagatatatataaaggggagtttactaagggtattaactcacacgatcacaaggtcccacaatagtccttctgcaagctgaggagcagggaagccagtttgagtcccaaagctgtagaacctggagtttgatgttcgaaggcaggaagcatccagtatgggagaaagatggaggctgggagactaagccagtctagtcttttcatgttcttctgcctgctttttattttggctgtgctggcagctgattaggtggtgcccacctggattaagggtggtctgccttttccagtccacagattcagatgttaatctcctttggcaacaccctcacagacacacccaggaaccacgccttgcacccttcaatccaatcaagctgacagtattaaccatcacgcctgtggagaggggaagtggctcagatcctgcggggcttgaattgagaagatgcagccagcgtgtcccccctaggctttctttactagaccttaagctgtgctgggaacattcacaggccttctctgttttttgtttgtttgtttgtttgtttttaaggagaattccagctcttttaaattgtctctattattaaaaaacaaatgcaggaagagaaagagaaacatcctgtatatagttgctgagggaggcgaaaccgcagtggggtcacagctcatgggaccggggtgaggcgtctccccaccctgcgtctaggtagaggcgcgttttgggggcccagtgcccccctctgtcacctcttctccatcttttcttcctggaggaggctcagaacccctttggaattgtagaggcctaaagatgaggagagggccgggcgcggtggctcatgcctttaatctcagcactttgagaggccgaggtggatggatcatgaggtcatgagatcgagaccagcctggctaacatggtgaaaccccgtcactactaaaaatacaaaaaaattagccgggcgtggtggcgggcacctgtagtcccagctactcgggaggctgatgcaggagaatcgcttgaacccaggaggtggaggttgcagtgagccgagattgcgccactgcactccagcctgagtgacagagcaagactctgtctcaaaaaaaaaaaaaaaaaaaaaaaaaaaaaaaaaaaaagatgacagtgggcccctcaagcatttttgagtctttttgttttttttgtggcgctgtcacttttgtgtttggttcgggccttgttggaggtttagggaaaagacagtctgttcagttcagttgggagcacatgggcctcaggctgtgtatagcaccctgtggcccgagggcccagaagcctggccccggagcccctgccaccccatgaatgagctttagggtctgatggctggggcagtggctccctaggtaagagccaggtgtcacatgtgaaaagtggacccagctgccactccaggggtgggaggactgtggaatcgcaagaccatgtacaagaggccgatggaattgttctcgttactttgtaggctttatgtgctgtgcttgagaaaatgcaaacaggctattagtcggtgacaggcaattagttccacccccggccttgctgcttctgctgacgcaggttccgaagtctcctggttacccagcctggcaccctcaggcacagcagggtgtctggcccggcacccgcccctgtgggggcagcagcacgccttgtcttcgcttccctgccatgccattcccctccttcagcccccgagagcaccccagggtgctccctcctccagcaaccttcacctgaatgctctccctctagattaccccatggctcactctttcagctctgccagctcttggttcaaatgtcactgatcagggaggccctctctgactccactgccccaaactggcctccactggctctcctccccacccctgccttagttctttctgtactcatgtgacacaccaagcagcactcagctcatggggatggcctggctcctcttccctgtgccagtgtttacacaacgaagcttgcacgtgtctggcagacactggtgccagcaaactttcaggggcacccacagcccctgcctttctcctttcacacatggctccttgacccagaggtgctctgtgggctggagctgacctttcctcggggtgcaccccaccccctgccaaagcagccagccctggccacagtctgcacgcagctgggggcagatgttttaggagcttctggaaggccgggcagaccctccttggctaatgtgctgggctttgccaggagtggtcttctgggcctcagtttccccacgagtaccctgagccagggagggatggggactccattctgcccactccccatcattccggggagggaggtggctccacaggtcctcgctgcctcctgacagcatcactgtcctggatgaggtgggtgaggaggcttctctccacggaaacaagtctcaggggttccagggaggttgcagcctggtctccatggcaatgggtgagctggtgcggcttctccgcgggcggcccttccccctcctgggcctgccctgggctggaggctctttctgaggcagaggggaaagaagggggatgtgccttcctcactctcttccccctcattgtaactcctagtaattccccttcacgtctctcccatttctgccaacagggcttgttccaaaacctctggctccatcccatcacccgtggctcctgactgtgccctccataactcccacgttgcaggccacagcccctgttaacccctctcacagtccacccggctcttgaacctgcgctgggctttctggcatctctctctccttgtgcctgctggtccctcggtggagcgcctttcctcctcctcttgccccagcaagcctggcttgaaccccaggactgctttgtgaagccttcctcaggtccccccagcccttggttcatgggtcccagactcaggtgtctccagggaccaggctgataatataaaagaggagagtgtctagattatgcaatgataatgtcatctgccccttcaccccagggctgggtggcagtggggagtggtggggtctggcgcaagctggagagtccacacccccatccccaggggcagcttattgctgccaggtgggagtgcaggctcactgttgccacagcctccagttcttcaagagaagccagaagttaagaacttttggacaaactttccaatttaagaactgttcgctctcgccgggtaccgtggctcacacctgtagtcccagcactttgggaggctgaggcgggtggattacttgaggtcaggagttcaagaccagccttaccaacatggcgaaaccccgtctctactaaaaatacaaaaattagccaggtgtggtggtgcatgcctgtagtcccagctattcaggaggttgaggcagaattgcttgaacccgggaggcagatgttgcagtgagctgagatcatgccactgcactccagcctgggtgacagagtgagactctgtctcaaaaagcctaaagaccaaaacaaaacaaaagaaaacaaaacaaatgaaaactgttgactcaaatcaaaacattacagcgaccaagctgagcattcctgcagattgagcttgggcagccctggcatatggtcaggtcggttggccccccgtctggcttcgtcttttctgacactaacagggttgcactatcatagtttactccctctccaggccctcccccaagtctgtgcctcttccaagagaggagtccctccttgtttatctctgtgatgtccccagagcctgcggaggctctgggggacaggacgagcgggagctgtaaggactgaggaccgacaatgctcctgccaggctccatgctcctgcctctactcactgccccacttagttccacaccaagagcgaggcaggggctgtgagaatgctgcctttatggaggaagaaagggggtcggagagggaaggatttgcccagtcatggggtgtgaagtggggcagctagaacaaaataggatctattttcgttcccaaggccaagcacatcacaggggtgcagtatgctctctctgtctctctctctcccctaggtcagggtggtccctggggaggcccctgggttaccccaagacaggtgggaggagcttcctacccgaccctcttcctgtcaacctgggctctgcggctcccagggctgctccttgtattggggccccagcctggctggtaacagagggtccctccactgggctcagtcttctgagcatgctctgcccccaggaacctggaggatggaagttgggggccctgggtcccttccaaatgcccttgggtcctgtgcctggtccccagtgcccattttcagagcccctggcccctccctgccttgtggactgtgtgacgtgatgccagtcccctgggtccaggggcatggcagccggcggagaggcctctgcggccccgatgtctccttgagtggcttgactctgccagcccagcggtggcccagctaaatataccctggctgacgtcaagcactcttctgctcctggggtttttcttaagctgcatttatagtttgcgtattgctttgtaaagatgtaaaaatttcactttttttttttgttttgccccttagcagactgtcttattgagtgtagtcttagatgattatgaaaatcatttacagctgccgcattaggaagctggcgtgtgtgcagaggcagggcattttggtcaatgttggtctttaggtgaagaaaacttccctcccttcccccagtcacgcacatgctcacacacgcacacatgcgctcacacaggcacacacacgctcacacgtgctcacacatgcacacacgtgctcacacgtgtacacacgctcacaccgcacacacgcacacccgtgctcacacgcacacatgctcacacatggacacacgctcacacacgcgctcacacgtacacacgctcacagcacacacacatgttcacacacaacctcacacgcacacacgtgctcacacacgcacacatgtgctcacgtgcacacaggtgctcacacacacacatgcacacacgtgctcgcacacgcacacatgctcacacacgcaaacacgtgcccacaatgcacacacatgctcacacgcgcacacacacgtacacatacactttccttctctcctttcctctttgtttctcaccacctccacaaggccacggaaggggctacttgggctgggctgggcaggggggtgtgagctgcctcctggggcccagcctgggaggaagggtcagcatgcttcctctgggaggaggcttggccaacttctctccgtaggtctctggcttacctgggcctaatcccttctttctttttctgggctctctttgtctctctcctaggccagggcggtccctgaggaggctcccctaggccacccactagacgggtgggaggagcttcctaccccactctctccctgtcaagctgggctccgcagctcccagggctgctccttgggttggggccccagcctggctggtaaaagagggtctctctgctgggcttggtcctctgaacatgctctgcctccaggaacctggaggatggaagttggggggccctgggccccttccaaatgccctcctccctgtcttttctgccctggcagtgatgccccacagctctgtgtctacctggagacctcagccctctgcttggggtccaagtctctgttccatatgcccctatggaactcccccctccatggcagcaggagcaaaggctctgaggcaagtgtgcaccagtgtcagcaggagcagctgggaggccggttggtggagtgaagtcagggagggtgcatgtaggaggataacgctgagtctgagtgtcccatggcacgtgggagagaggatggattttatctgagtgtcccatggctcgcaggagagaagatagattttattctaagcatgataagaagcagttggagggttttagttgtggtgggagtggaggggggaaacaaatgatcctgtttgcacttggaagggctcactctgcctgctggggagaagggctcaggggccaggagtggagtaggaggctgcagctgctcccaggcgaggggcagtgaggcgtgagcaggacatggccaccgtcgcgggggaagtggttggattcacaggtgacatttgccagtagacaaggagtgtgggaacagggagaattcaggacgcctcaagtcctaggacgtggcaggtgcagatgccagatgccatctatgtgtttcatatgagaaggtaaaaagcaggtggaagggaccctctgcagcctctagtccacgctgttctggttgttcccaagcgctcttgctcgccttggtttggccgggactgatcatcagggtcagccctttcattctggtaggaattggaaggattctaggcaggtgtgggagttgaggctgaacctcctgagggatcagaagctggcagggccctggattagggcagcaccacgggtttccataaacgctccttcgtgtctctctttgcatgtcctcagagcgggatgccttcgacacgctgttcgaccacgccccggataagctcagcgtggtgaagaaggtgagctattggtgggatgttggatgtgctctcccctggctcgcggctttttgacagcacaaacgccccgctgggaagaaggtgggaaaatgtttggaatctcagaaatgtttgccacatggattgaaatgtaattacagtcaaaaacctaaccacagtgcataaaatcagcgccttttaactcaacctcgctgctccctgggtgtcttcctgcccgcccgctccgcttctgttaagtgaattacccagcccccatttctttctgactcgagaccttttttcaatgtggaaatgtttttaagcatgtcagcctgctgctctcgctggcctcatttaccatctacagcctgcccagtaaacacgcaggcctgtgcggctgagctgtgccatacatggatttggcccgtttccctccagacagagaatgggccctcactagcccaggcagcctgctggtcaatctgtggatggaaaaatctccgaggctctggagttgggggctgggtgtgatcagcttctgggggatctgccagggaggcttgttcccgtcaaaaggaactggagcccactggctgctcattaacttatccgagtgcctgcaggcatcccattcaggaggctgctgcatccctccttcccataacatcggaggagcgctcatttcaacccatggtgcaggcaagagagttctcctttgtctaggacagcttacccaaacagctttcttagtgcaagacttgtcagaacctttaataggctgacctatactgtacttctccaagagggagcttggtaggaagcatttttcaaacttgtttgtttatagtgggatttatttatctatcaattttggggtaagacgcattgtattttagtggaacccacttttggaaaatgttggcctgggtttggacgatgagatcattcatttttggaagcattttgcaaaaggctgttggaaccgtgctaatggtccttctgggacaaagccttcctagcactcttgggtggtgagggatatacttggagcatcagagtcccccacctccacctcgtcacatgtggcccccagggaccctgacagaaccggttcagggaatgaatcaaatccagcttccccacttatcagctgtgtgacttctggcgaagggcgagattataccccccagcctcagtttccccatctgtcaagtggggacagagatgttacccacctctcagggcactgtgaggataaactgggattctctctgtgcatgggcttagccggcagcgtatagtcactggtagcattgagaatggtgtggcctgagattgctttcatctctcggtagataccatgttaattcattctgcgaaagacacattttcggcactggagccaccagcaaggaagaagacagaatcctttgatttgcctggtagcttcccactccagcctgtcccttcctcacctccacattgcaagtttaggtgtctgtagctctctgtgccccagaatgaagtcaggggcccctgcccacctctgcaggtttctccctgggtcgtcccctcctactccttcccatcccacccacatccagccacagcctgaagaccccaaagggtttgcagatgtgtctgggtgcccactcggctcactctcaccttgcactggcccaccctcaggcccagctccaatgctccctctccatggtcttaacgggggtccgcacacccattaatggctcatgaaatctcccttgcattgcgtgtttccctgtagtgccctatctcttgacttctccgtcccaccactacacgcatatggagaattacatcacaggccctttggcgggggccaggggtggagctctctgtgtttgtgtccttagcaccaagcagcatgcctggcacatagtagctgctcagtaaatttgagcagaatgggtaagaaatcatatcatgggcaggctgggcgcggtggctcacgcctgtaatcctagcactttggaaggccgaggtgggtggatcacaaggtcaggagatcgagaccatcctggctaacatggcaaaaacccgtctctactaaaaaatacaaaaaaattaggtgggcatggtggtgggcacccttagtcccagctactcgggaggctgaggcaggagaatggcgtgaacccgggaggtggagcttgcagtgagccgagattgcgccactgcactccagcctgggcaacagagcgagactccatctcaaaacaaaacgaaacaaaacaaaacaaaacaaaacaaaacaaagaaatcatgtcatgggcagtggtggatgatattgagtttctatcaaagttggctttggtcactgaggaattacaggtgacaggttttaagcttgtgccggagagaagccagtgccccttggtacttacataatagggctcagagagatcaccctgggtggatctccccatgtattgcaaatcgataggcaggctgggcgctgtggctcacacctgtaatttcagcactttgggaggccaaagtgggtggatcacctgaggtctggagttcgagaccagcctgatcagcatggggaaactccatttctactaaaaatacaaaattagccgggcttggtgacgggtgcttgtaatcccaactactcgggaggctgaggcaggagaatcgcttgaacctgggaggtggaggttgcagtgagctgggatcatgccattgcactctagccggggcaccaaaagctcggatgatcctcagtggtctggggtgcaggcttcaaacctgtagctgtctagtgacagagtggttcaattccacctttgtaggcccggcgcagtggctcacgcctataatcccagcactttgggaggccaaggcgggtggatcacgaggtcaggagatcgagaccatcctggctaacacagtgaaaccccatctctactaaaaatacaaaaaaattagctgggcgtggtggcaggcgcctgtagtcccagctactcgggaggctgaggcaggagaatgatgtgaacccggtgaacccgggaggcggagcttgcaatgagccgagatcacgccactgcactccagcctgggcgacagagtgagactgtctcaaaaaaaaaaaaaaaaaaaaaaaaaaaattcagtaggtgtggctcaaggcagcactttcctcagtcttctgagtatgccgtttattgttccaggtcacacctaagatacatttgcaaatgtaatgatcctcccctggcagtttcatctttcttaagagcacagggtgctctccagtatgattgttaaatatgtcatgcgtgcacggattggcatatgtgtgcatgggttggtgagcagagacgtgtagccaggatagatgtgggcattatgccatgaaaactaggggctactgtcaggatattgagtttgaaacatgggctttttattttagcaaacaggagatgatgaaagcgtttcacagagctggggctggcaaatgtcaagcctgcccctccagatgggacctgcatgcgggccattcatggctcctgtgtctcttttattcttggcagtctctcatcacttttgtgaacaagcacctgaacaagctgaatttggaggtgacggaactggagacccaggtatgtgctgctttggcttgaaggatcctttgtccaccgccattttcagtcagtgttttgatcccaggtggggcgcgtgaacaaagctggcgccattttgttcatctcacaaggaactcccgtggtgcaggcagaaataaccaccgtggccttctcagcccctctgtcttcctttcctggggctgctgccacaaagcaccacaaacctagtggctgaaacaacagacctttgtgtcctcgaagtgctggaggcctgaagtccaaaatcaagatggggcctgggtgggttccctccaaggctgtgagggaggagctgttcctggcctccctcccagcttctgtggttttgccaggatctttagcattccttggcttgtacacacatcactcccttctttgccttcatcttcatgtggtgtcgtccttgtgtgtgtgtctctgtgtccaaatgtcccccttttatcaggacgtggtcatgttggattagagcccacccatggcttcatcccaacctgactgcatctatgtaaaccctgtttccagatacggtcacattcagaggtcctggtgattagggttccactgtatcctttttctttctttttttttttttttaaagacagagtctcgctctgtcacccaggctggagtgcagtggtgtgatctcggctcactgcaacctccacctcccgggttccaaccattctcctgcctcagcctcccgagtagctgggactacaggtacatcccaccatgcccagctaatttttgtatttttagtaaagacggggtttcaccgtgttggccaggatggtctcgatctcctggcctcatgatctgcctgcctcagcctcccaaccactgtatctttttttgggagacacaaaaccccaaaacacctgagtggtgttattcaacccataacacactccagggctccaccccagcccaacacagggcctttgcacacgcagttcctctgtctagaacgtgctggccccttcagcctctgctcagtgctgctgtcacactgtggccaggacctagcaaatgtccccctggtaggtatgtacaacacatttcttctgcaataagtatatcaagtctacttccccagccccgacccctactcaaagctaaaggagcatccttaaattatatttttgggcactccgagagcattaaagacaaaatatgattttcccaggattagcagggtgcttgaatgcggaggtttttgagctcttggtacagacatccctaatgcacagctgatccttcttaaaccccaaggtgaatgcattcattcccttctctttctttaactttcctcatttgcttttctaattaaaaaactaattcaggttcattgtagaaatgtctgaaaatgcagataagcaaaacaaataaaaatcacccataatcccgtcacccggagatgaatgcacagagggttttgttcaggccttttctctacacatatagcgagtcatggacagtgtgggtctgtatataaaagcatcacggtctgtttttaatgtatatatttatttgtgtatcgttggccaacacatttcttattttccgcagtttacaaatgttgcacatttagcctcagattattttctgtttgagacgttagcaccccagaagccactgaggtgaaaagtaaaaatcttcctttctctttttctggagacctcccccttcagactctccaggggcagctaactgcagttcatggttggatgtgtatttttctagatattttctttttctttctttctttttttttgagacagagtctcattctgtcccccaggctggagtgcagtgacacaatctcagctcactgcaacctccacctcctgggttcaagcaattctcctccctcagcctcctgagtagctgggactacaggtgcgcctcaccatgcctggctaatttttttgtatttttagtagagatggggtttcaccatgttggtcaggctggtctcgaactcctgaccttgtgatccacctgcctcagcctcccaaagtgttgggattacaggtgtgagccacattttctatgcacaaaggtatttttctaaataacagtggatcttaccgcccactgttttgtaatgtgttttgtgtcactaaatacactgtgggcatcttttggtgtaagagaaagtgtgtgtgtgtgtttctatctgatcctttttcccttgctcgatctatcggtctgtctatattttgtcacttttaatgggaagtgtatctcatcagcgggaaggctgcactgcacctcattaaaccagtgcctcacgactggatgtttttctgctcctgtaaacagcagtgcagagagcagctttgtgcacggctgtctgtgctcgtgcctgcttcctcggaataaaagcctagaagtggagtcattagagcgaagcctgcaccgcacactttgaaggctcaggaagatttgctgtgtgggggcccctggtactgtcatggggcgtgtgaggggcactgctcccccacatccataccagctgtccccacagcccttctcagaggtgtctgcacatcagtattagcagctgagcctcttacattgagactctaaaattaaatttgcatttgtttttatttactcaatatcttcatttttttccccccgattaatcgtactatatagagtcttaaaagtacatttaaccactggtcccccagaaaaggtcgctggttacagaaatgcagggatttttgttttgttttgttgcaaaggaatttgggtatttttataaataccatatatcatttatgaagactgtaaatcattaacgtcttgatgccctaggagtcggagaggccctggtttaatttcttcaatttctatttgtgtgtgggtgagtgtggtttatgtagtctggtatgtgtggtttatgcagtctgttgggggtgtgtgtgtgtgtgtggtttatgtagtctggtgggtgtgtgtgtgtgtgtgtgtgtggtttatgtagtctggtgtgtgtgtgtgtggtttatgtagtctggtgtgtgtgtgtggtttatgtagtctgtgtggtgtgtgtgtgtatttgtggtttacgtagtctgtgtggtgtgtggtgtgtgtggttttcgttgtctgtgtggtgtgtgtgtgtggttaagtagtctgtgtggtgtgtgtgtggtttatgcagtctgtgtggtgtgtgtgtggtttatgtagtctgtgtggtgtgatgtgtgtgtgtagtttttgtagtctgtgtggtgtgtgttgtgtgtgtggtttatgcagtctgtggtgggggtgtgtgtgtgtggtttttgtagtctgtgtagtgtgtggtgtgtgtgtggtttatgcagtctgtgtggtgtgatgtgtgtgtgtgtgtgtggtttttgtagtctgtgtggtgtgtgtgtggtttttgtagtctgtgtggtgtgtgtgtgtggtttttgtagtctgtgtggtgtgtgtgtgtgtgtgtgtgtggtttttgtagtctgtgtggtgtgtgtgtggtgtaggtgtgtgttttccctccttttccaaaccattcttacattgcggacagcgtcccagctctgtgatggtgagtgaactcctcagcctccctgagcttctgtccacagaattaaactggaggcgatgggcagtgtgaggactgggtgagatggcgcactgagatcaagtgggcagggctcggcaggggttagcactgcggatgaggaggcggtggtggggcctctgggcctccgtggggattctgctccctgctgagctagacagcaggttgtggagagagggcaccacgctgggtgcttgtgaaagtggagggtcacccgctcgcagctgggccccccagccctgccctctccttgtggccgtccctccctccttcctgtgagcccgtgtgctgggacagtgaggagacaccacggaaggaagaaaagactcagcaggctcagggcctgcgggagcagcggcgtggccaccccagacctcctggggagaggtgtgggttggtgccttcattcacgtggcagcttccattccctggaagttagtccatggagacgtgggcatggcagctcaatgttgttctgctgggaaggtgccagcacgcttaaccagggtgctgtgggcatgaagcttccatgtggagacacacttaaaagaattcttcaaacccgtctgatctccttaatgataggagtggctggctgctttgtggtgtggaaggctgagggcatgtgacatggaggccaagtgccatttgcccatcaactgacagcgtgttgaatttccaggcgcagtggctcatgcctgcaatcctagcactttgggtggccgaggtgggtggatcatgaggtcaggagttcaagaccagcctgaccaacatggtgaaaccccatctctactaaaaatacaaaaattggcgggtatggtggcacgcgcctgtaatcccagctactcaggaggcggaggcagaagaattgcttgaacccaggaggcagaggttgctgtgagccgaggttgcagtgagccgagatcgcaccactgcactccagcagggcccagaccctgtcctgagtcccttaagggactgttgcccactggcactagctttatgctttacagctctagctgcagctctccctgctaaaggtcagggcttctgatattggatgtttgtgattttgacttttcatctttttttttttttttttttgagacagtttcactcctgttacccaggccggagtacagtggcgcgatcgcggctcactgcaacctctgccttccgggttaaagcgattctcctgcctcaacctcccgagtagctgggattacaggcatgcaccaccacacccgctaatttttgtatttttactagagacggggtttcaccctgttggtcaggctggtcttgaactcctgaccttgtgatccacccaccttggccacccaaagtgctaggattacaggcgtgagccactgcgcctagaagtttttacttttaatttttttaaaaattcaaatttaagaattctggagattgtttgtacaataacgtgaatgcacctaacatgattgaactggacagttaaaagtagttaagatggtaaatgttatggtatattttatggtatattttaccacaatttaaattaattaaagagaaaggttagcataagcgagacacaaaagataaatggatatgcgattccacttacgtgagatacccagaggagtcaaattcatagagacagagagcagaatgattggtggttctcaggggctggggggaaggtagaatagagaattgggggacagagtgtcactttggtaacatgaagaagttctggagatgggtggtggtgagggtgacccaacaatgaggatgtacttaatgctactggcctgtgcgcttacacacggttaagatggtacatttcagcttatgtatattttatcacaataaaaaataagttagcaacattcaaacaaaaacattttaatttaaatagctgcatgtggccattggctaccatgttgaatagcagctccagaggccccctggagaatggggccacagtcactgtggtctctgctgcaagacagagtggtgagggccaccaggtcccagctctgcaccctgcagatttgaatgaatccttccagcagctgatgctgatggagcactcacgtgtgccaggtgctccctcccagccgtctcgctgtgtcttcacgacagccctgaatgatgggagtcactactatccctggggtcaggagtgggggacagttccagaggcacggtcctagccaggcagctgcactcagctccaaacactcatcatatttggtctttgcagagccccatgtgttagagccccctccccttttgcttttttctaggttaggagccaggtctcaaaagacttcacattcaggccttcacttgattccagattctcctgcctaaagtgagaggagggatggattgctttactttaaaatatttccagctgggtacagtggctcccacccgtaatcccagcactttgggaggctgaggcaagtagatcacttgagcccaggaatttgagaccagcctgggcaacatggtgaaaccctgtctctacaaaaaatacaaaaattagccgggcatggtggtgcgtgcctgtagtcccagctacttgggaggctgaggtgggagaatcgcctcagggaggatcacctgagcctgggaggccgagctgcagtgagccttgattgcatcagtgcactccagcctgggtgacagagtgagaccctgtctcagaagaaaaaatatgccccccttaagtttgtgcaaagcatttgccaactccttaccctgcccggaaacatcacaagtctttctctgcagtttgcagatggcgtgtacctggttctgctcatgggccttctggaagactactttgttcctctccaccacttctacctgactccggaaagcttcgatcagaaggtatgtgcatggtctccatccttggtaggggctcaagaaatgctcattgaaatgcagagcatagactatcccggcagctcttcctgcagcctggctgcattcttcagaaagtaaaaaatgcacaagtgatattgcaattagatgtaactctcagcaaaagaaataagaagcccatcagccgtccacaacgcatccgagttttgtttgccacattttctttgcggtcttttccatgggaccgtgtagtttttaataattgtgatcacatctcggtagagttgtaaacccttcccccattctgctgcagctccaccacctgtggttttccctgctgcttcccaagctttccaaataccatctccagtggtggcacgaagtcccaaggatggctctgttaccagcgtctttccattccccattcttgggcagtcaacttgaacatgtttctattgtttttccctactgaaacaacagagcatctttttgatacagattttttttttcattcctgtggattgttttcttaggaaaatttctcaaatagggtcaaatttggggcattcctttcaatctgggctggcccacgccacccggtcccgctgtcactgccctcgtgcgtgggcctctccctgctgtctgccctctgtccagggcttcccgcagccaagcctctcacagcagtatttagcacattgcctttaaaaacttggccatggatggtctatgttgctttggattcatgggcatctgtcattttattttcccaaagtgttagacccatgagtcagggaggcagacaatgtaagctggtggcgacagccagagaaatagcagaaatggggccagtgtttatcaatctgcccacttctggcacgttgcagtctgtttgcttgtggccaaatgttgttcctatcttgcctgctgagatggaatcaggacagattagagaggtcttggcacatggagtccatgttgaatcgagagagagagagcgagcgagcgagcaagagggagtgcagagggaatgagcagaattgtgcagaactcaccaggaaactcaccaggtgcctgtgctgtcatcctggaaatgaaaggtcagaccatccagcgaagaagcgcatgcatttccaggccccgatatggctggttgcagacacattgttttggagagatcttttctttcttcaaactagtaagaatgctggcgagaacagtgagtttagccaggagacctagggctggtttctttccaagacaaggctttgtacaaatgtcagaggcatcatctcctgggccctggccttcttccctttgaaactgggatgaaagtctttgacaattgctgccctggcctgcgaggcttgaggaggcttgagtcatctgccttcccctctgaatcggagcgaggaagggaaggctattttcaggtatagcatgcagcacaccattcatcctgttcactcaggagaaagggagcctggggtggcggtgtggctctgcgggtggctggaacactctccttcggaggatgggaggctgtcagtagttcctcctccagcccctgccttttttccctttctcctcatggcagctgctggcaaggtcttcatgagcccatagtatttattatctaccttgtagtcttcgtgaatcctggacaggtgggtggtccctgctgtggaggactcacccacttcaggctgggcccaacacccgtgtactcaaaactgcttgcggatgggatgttgatggcatcccttgctaatgtctcctgtgggctgagaccccgaggtgcgtttgctctggccctgggaatcctgacagctgctccacatttttgggaggagggactgaggttcagtgagcaaaaccagagatgcgtcatgagctgctgtccccgagggtagtaatgacttatggtttaaaacaattgcattggatttaaaaaatatcacactggacagctcagagcctgtaggctcgtgccccatgagctatctcagaggcatgagtgtggccttcagtttttttgttgcaaagccactgtttgagccttaccctgcactggccacgtgctgagcaccttgcacccattggtcatcattttgggagactctgcaggctccctctctctgtcgagtggggtgcatcctggagacgtggagatctttcctagaagaagacacgagttgcttccccctcagcattactggatgaggacagggaatctcaggaaggcttagagaccagcccagggttgcacggccagcaagggcagagccaggagggtcgactcctattccagaaccctctattctttcctcacctggccaagttgattaaaaccttttgaattgcagagagaaaggatttctgcccatgtggctggctcgaagcaggtgtgtatatggcctggtctctgctgggccttggggcctcctactgcagtcacagctggggtgagcggtccccaggcctctccgggatccatgtgctgggtatccagggatctaggctcaggggacacttctctgcctggcatgaaagagggctgggggaggaggcatggccttgagagataacaggcatgggagggtggcaatttcctgcctggcatttcctcagcctgagaagaaagcagaaggaaaatctcacttcaaaaccacttactgtggggccgagcggctgcagagcaatgaggcttggaaggggctttgctctccccttaaactgttctctcatggtgtaggggtgaccacctcgtcacccgatcacactctccagccgtctctgagtgtctccacgtgtcatgcatctcatccccagcccctcctgagcatccactccctcagcgtggaagaggattcctcaggcttaagaggtgcacgggagaggcacgtgaaaagaccggtccaaattggtgctgacttttacaatggagaagaatcttttcttaaaagaaaaatcttttctcgctattccctctctttgctatcctgtctccatctcgatttggggtcaagcctgttgtgtgtgtgtgtgtgtgcacgtgtgcatgtgcatacgtgtgtgtgagctcatttgatgatatggacggtggtcagctaaagggacctgtgttgctaggggagtggaggtgggaggctcttggaggagaacgggcacagattctacgtttcagtcctggttccatgcctgtgagccccgtgccttgtttttcttttcttttttttttttttttggaggcggggaaggaatctcactctctcacccaggctggagtgcagtggcacgatctcggctcactgcaacccccgcctcctgggttcaagcgattcttctgcctcagcctccttagtagctgggattacaggcacatgccaccatgcctggctaatttttgtatttttagtagagacggggttttaccatgttggccaggctggtcttgaactccagacctcatgatccacccgcctcagcctcccaaagtgctgggattacaggcgtgagccactacatccagctgccccatgcctttttagggcaccgatgtcctagcccatctcagcccagcaccaccctcctttgtgaaggaagatgatattcacctcgtacagggctgggaggggaaagggaacctgtatggaatacactgaccccatggtggatgcacagcacccgcaggtcgctccctgctctctccttaggggaactgcgttctgcaccctccgcacgggccgtcctcactcctcccccattgccagtgtttggccatcctcaggcccagccctggtgcagcactcccgcatctccaggcaggctgtcctgcagggttggggtgtctgccatgtggcccagtgttcccattggcagtttctgagttggcctctggagcagggtctccgtctgctgcacccccgcccctgggtggacatggcctgccctcctgccgggctgtgtcttccccactgaccctatgactagccagaccctcttgcggttggtgctggcaggtcattcgcccctttgcttctccgagcacaggccgtgtgcactgtggaagcttttccaaagcaccccacactgttttccagtgttgttcgtttgattaactcagggaagcctctttttcctggttaattattaaattacattgcaagtaaaattgttcttgtttctgattcattggcctcaaaatcatgaaaatatgatcgttgaaaggattttttgtttgtttgtttgcttgtttttttgagacagagtgttgctctgtcacccaggctggagtgcagtggcacaatctcagctcactgcaacctccgcctcctgggttcaagcgattctcatgcctcagccacccaaatagctgggattacaggtgtgcaccaccatgcccggctaatttttgtatttttagtagagatggggtttcacccattggtcaggctggtctcgaatgcctgacttcaactgatccacctgcctcggcctcacaaagtgctgggattacaggtgtgagctaccacgcccagccaggatgtttgattactaagagccctgaagtcccttgcactgtgacatctgtgcttgtttgctgtttgtttgtttgatgtcccctcctcccatcagccttggcttgcggcaggtgggtggctggatgtaatctggttcattgccggcatccctctgagtggtctttaaacacagcccagaaggcttttattttaaacctgttcagccatcattagcaggataaaagcttcaggtacatttgggggctgaggagtaatagaccctttaatttcaggggaagtcacggtagggcggaggtggccacgtttctgtagcatctaacaggaccaaggtcctgcaggctgacgcttgcagccaccatcgatctgacttccgttctgactggtccactgtccctactcagtgctaaggccctccctcccctgagggcaccccatcctgcagagacacagcctcacgtgcaggtctttacagcccttcctggggcagtgccaggcctgcgtgcctctgcacgggactcatcctttctgggcctcagtttccctgtctgtgaaatggggtcactgtgggccaggcgcagcggctcacgcctgtaattccagcactttgggaggctgaggcgggtggatcatttgagcccaagagttagagactagcctgaccaacatggcaaaacccgtctctaaaaaaaataataataatacaaaaattagccgggcacagtgatgcgtgcctgtagtcccaactactggggaagctgaggcaggaagatggcttgagcctgggaggtggaggttgcagtgagctgagatctcgccactgtgcactagcctgcgctctagaccctgtctcaaaaaacgtaaataaataaataaacaaagaaataataaataaaatggggcccctgtgacttctcatcaggtggctggcatctggggcagagcaggctcttggtggccgtgagccctcgagagcaggccgggcacctcatccttccatctctcagcccagatcactggtgtgaggggtgagaaccacctagtaagcgcacatggccctccgcagacttcctcacccgtgtctgcccaccctgtggcccgccccgggctcactgggtccttgtggacgtcagcgttgcagaggctcggtcctgtccatgccggctgtcctccagcagtgggccgtgtgtgggaacgactgttggaccctaacgctgacccaccccccttccttggcaggtccacaatgtgtccttcgcctttgagctgatgctggacggaggcctcaagaaacccaaggctcgtcctgaaggtaatgcccctggctcaggttcccccgggagaggtgcgcacggaggggaagaaaaacgggtcctagaagtggctggaaggctggcatgttgttccccagatgggccccacgtctctggctctggggcaagggtctgccaaccccagctcctcagtctcctcattttgggaaccaggaggacttcgctggtggagctggcagtgccggttctttaataaccacttgactttgaaggacgtggcctctgcccacagacctcaggattaagtgcgtctctagctggccactcaggctggaaatgcagcttcgtgccctgagaagaaattaaaggcttactcaactgtaatgactgttgggctggaggtcccctgatgctcagccaaaggcagtacttggtagcagggacttggcatgctctgcgtgggtcggagctggaggcaggaggccagcagagctggggcgggcggttgcttccctgtcccccccccggctcctgtgccaagttacctataggaggactctctaacctgagtgagcatcacagttccccaaacacacttcctaggtgtttggggacagccaggctcagcagaacatgggtggcactgcctgtgaaccctgctggaaagttacagggcagagctgaacattaaaggctttgacaagtcctatatgaagacatctgtttgcctccatcaaaacctttgccatgcaggaggagcccacagaactcagacactgtggtttagtgccctgggcccccactttgaccgtggccccctacctagccctgctccctctcctgagtcccccatggtgctatatgagttgggagcccatgatgcttcctacacctgttgccagcatccgctcaacggcgggctttgtagagtctccaaaatagctagaaaatggatcctgtcccttccatctacccactgcagccaccgcttcctgccagtccacgcggaaggttcctggccggtcccttcctgcctgttcatcctcctcttggggtttcacaggacaatttcacaccctcctgtctcgtgtgtatggctgtttattcttttttgttttgagacagggtctcactctgttgcccaggctggagtgcagtggtatgatcacagctcactgcaacctcttcctcttgggttcacagcatcctcccacctcagtctgtcgagtaactgggactaaggcgcataccaccatgcccggctaatgttttaacttttcttttttgtagagacaaggtctcactatgttgcccagactggtctcgaacttctgggctcaagcgattcgcccattacaggcacgagcccccatgcctggccttgtttattttttattgtccctccctccccactagaacagaagcctcaagggagcagggctttgtcccctgcatgccggtgctgagaatggtgcctggcctggaaactgctcgacagcacggatcaaagcacatgtccagcagggagtgtggcgagctgctgcctgtagataccggcccggcctgggtctctgggacccctcgttgctgctgccctgcagcccttttgttgctgtgaggcagggccatgagggagtggctagaggcccgagggatgctgctttgcctctccccagctgtgcatccttgaacaggttactttgcctttctgtgccagggcctcctcctctgttgaggggagtgatgatggcacctgcctccacgcgtcatggggtcgctggatggggggcggatgttcatcacacaggacttgtcagagccttcactgttcaactctgccctgtaactttccagcagggcccacgggcagtgccaccacgtgctgctgagcctgactgctcctgagcacctattacgctcaagtgagctgctcccatgagcactggaagagggtcctgcccacagaacacaccaggtccctgctgatggtggctgctagctcggcgttagtgtctggtgggtcgcacactgtcagggaggagaaatccttgctcatgtccactgtgggcttggctggggcttcctttagtttcctgtagcccaaagcctgggccctatctgcagcatggggtgcttcccccgtaccctcagaagagcccctggtggccctttgcctctgagctgctgagggagccctgcttctttgtcctcccgaacccacgactttttttttctgagacagagtcttactttgtcacccaggctggagtgcagtggcgcgatcccagctcactgcaatctccgcctcctaggttcaagcaactctcttgcctcagcctcacaagtagctgggattacaggcacccgccaccatgcctggctaatttttctatttttagtagagatggggtttcaccatgttggccaggctggtcttgaactcctgacctcaggtgatccacctgccttgccctcccaaagagctggggttacaggtgtgagccaccacacctggccctttgtcccgtttttgaggagtgaggcaggagcctgtccagaggccaggatatcctctgacaggccggcctcctaggagggtgtttgcccctgagcccggatgtgtttcctactcatctgccgctggacggcacgttagggaacccaccacggacgtgtggaaaccaggccagaggcagaggcactggtccagggcaaatagcaagttctgcagcctcccaggcagggtcccttgggtgtcccagggcctctgtccagcccaggcagggggcagagctggtctgcagtgctcattagcaccttcgctgggccagcactgggcaggggccaagccgcagagatttatgagatggggtccctgctgggcctctttattttgtggctgatgcaatgaatgagagacttttccttcttcattcaaaatcagctggggagcaagaatcaggaggtaacagagataagaatgacacggagaatggggtgcagtggctgcggtctccctgacaccctcctctgagctaggcagacttacccgggtacccagggctggtggggagggaggcagtggctgtggcctcccctgcaggcctgagactgccctgttggtccccacccggaggaagcagagcagtctcacaccccctgcacgtgggcgggtctgaagagccaggcctgcacctggttccctaggcccccagcaatgatgggcatcctggccccctgcccccttgtggggacctggcggagactccagtggggtccccgaccctgctcttaaggaggccccttgcctgggagaaaggcttgtggctcgctccaaattcacagagccgagtgcggagctcgatggtggggtgggtgtttggggagcacagagggactgaggttcatgggtcacagaaggtgattcctatccctgggcgcaggtgctaaggggtggctgtggttagcaggtctggcaggggtgtgagggttaagttctgtttgtccagcgaggctgtctggaagttctcagagctcagacctgggggctgctgcgtgggggcatcggtgtcaggctgctgctctggtctccctgtgagtccaccatgggagtggagtcagagggggccaggaggtgatggcccccacccctgggagctcctctgtccttgctgcccccctcgccttggccacctccaactccatggccgccattctccctcccctgcctccactgggctgttgggagctggggtggactcttcaggtcagggggagaccctgggatccctgacagagccccgggtgtgtccccaagcccgccgagccgagttccccgacagagccccgggtgtgtccccaagcccaccgagctgagttcagccctgcttttgctctgacagcacactcgtgggcaggtcatttctccatgtgagtcttggtcctctttgtaaaacgagagggaaggaaaggaggctgtgcaggctctgatgagggtgtgtgagtcgagaaactccatgcccagtgacaaggacagttgctgattcttagcatccaccccacctgctctctcagtaaccgatgtcgtttcttactcttgtgatcaggactaaagcacagggtcatcccatggctgcttttggatcacagggagtcaggactccaagggcctcgagcgttacctggtccaggcccattttacagatgaaggcactgagccccaaatcacggaagtcacttagaggtcacagagcaagtgaaatgaacaaggtgtctgattcccaggaaggttcttgtccacataaagaaagtggcccaagacttccagggccccagagggagctgtcgggtccattaagtgttactggggtttttggtcccggtaagtgtcattagccatgtcccccaaccggttcttagacatgtcctgatgcagatccaggaggggctgtgggagtgtctctgttcttgtcaccccaggtgcctgtccccgcagggtgtcagcccgcgccaggagctctcacaaaacctgtgtgtctggggaggcactgcccagagcgtcctggacatggtggtggccagtctttaaggggaagcgctgtgtgtggatgcggcagctggtgtcatgctggagacgtggcttctgagagtacctaccgcaatgacaggaggatggcacgcctctgaagtttctctgtttccttctgcagacgtggttaacttggacctcaaatccaccctgagggttctttacaacctgttcaccaagtacaagaacgtggagtgacgggggagctgtggatggtggcaggagtgtcccagcaagaaaggcggcatccgtctgtgccctgtgcctttccagggagccaggcgccatgggcttctggtccaagctgtgttgactgtcatccccaccccacccctacctcacgcctgccccaccccctgcctcttttggttgttgttcttaatctcctctccatgtagttcccagtgggcaagagcctttgaaaatgcaggattctaaacactcgtgcttgcgtttgaagcctcgcgtcactcagtcgcgtgggatgatgagtccgttgttgtctgccttggccgaaagatgaaaaaaagcctgaaccccaacccccagctggttgagagcaccctgcattctgcctcatggtgcagttagcgatcacaggccttcagaagtacaacatcagctcagcaggaacgccggctccccgaggacccaggcttgacgattcaccggggatctcctgggctgggctctccttggaagtgaggccttttattaaaaataaaagggttttgcagtttgaaaaactttaa

SEQ ID NO: 521 - DNA, 276076 bp, Homo sapiens
ggcggagtctgcaatgggggctgtccagcagtagcaagcagcgggccgatcctggtggagggttgggaggctgctgtcattttatgggtcggcagccagagtgagagtgtccctgctgccagaggactacggcgggctgggcgcggggtccccgcctctcgctcaccacacagaccccgcgcctcctctggcagccgcggtggtggcggcggcagagcctcgcccactccaatccccaccctctccatccttagtcattaaagaacagcagcgcctggcacgttcttggaggaccccgggcgcagaggaggaaagggagcaggcgcagggggactggaaaggcagcatgcgctcgccaggagcaacctcggcgcccagggtctgaggctgcagccccagttcgccattgtgagccgccgccgggggagtccgctagcgcagccgtgcccccgagtccccgtccgcgcagcgatggggcacctgcccacggggatacacggcgcccgccgcctcctgcctctgctctggctctttgtgctgttcaaggtaggggagctcctccacccctttttcccagcggtccgggcggcagccgcgctccggcgccctcgctctgccgttgggagcggcgcgccccagggcacgatggcccagccgcgggaagcgcctgccgtgcagcctgggcgcacgctttgttgtcctcgcgtgtgcgtgttcctggtggtcttgagaggtagggggcggggggaagaataagggaagtttgctccctccggctttcgccctttgtgctcttttatcgctgctgaaatccacatcaaaggtgggcttgttggatcgtgctttctcaggcaaaatgaggtcactttcttttctggtttccactgcaccccaacgctgcttaacctttccgccctccctcgcacagaatgctttgtcttaattttccttactgctggaattatacactggagagtggagggggactgagctccctggacacaaatggactgccagggctacgttagggcagaattttctttgaataaggagtgtcaggtagagagcttggtaaggattcctctccccaactcctatcaacatctttacaattccttttaaaaagtctccagactttctccactatatttacagatgatattacccctagatttaatggtggaaaaatatataataataaactttttcgtatcttctttggaatgtgctaccctgaggttttactttgagaaaaatgaaaagcaaaggagttgcttttgaaaaatcagtttgacaactatactgtacataaatttttttgaagaaatgtcagctagatgttttcttggacggcgatgtgaagttctgaagtgattgtctatcactcatgtcttcagtggatctactttagttctgttgttagtcttttcctctctccgcaaagcaaactcaagaatgtcgacaggtgacttggagctatcctttcaggaccacagtgataccttccctagaaatggatgccaggttaatggatccaaaggttttcttattatagagtcacttcttgcttatatgcaccattaattatgaatgcctaaaaagaatataatggaacaggaccaatggattaagaacagcattacttttaaatactccatattttcatttatcttaatgaaaaatataaaaaaaattcagggagaaacagcaacagaatgcctaagtaagaccttaaaatatatttaatatgttttaacattttttcttaaattatcaataatcattaattttaaagtatggtaaataataagctcagttatatgtttttactgtaggaggttgttctttcatacacatcataaatgcattagacttattaggttgtctattagtcgttttctaactatttatcaaactgtcacaactattttacctatgcaataattgtcatgaaccaaaaattagaaaccaagtcactatgcattttacgagcaacagctaagagttatatgtatgacatctgatccaaacctaacgtttagcacaactgcaggtttttgcgtgagttcttcataatgagataattccagaaataagagaatgacttggttgggagtgggggtaaggttttgcaattaaaataaaataaatgtggccattgtttgacttaaaactcgatattggaatgagaaaatgcagttagtgatggtgtaatgaaaatgttagtgattgtcatagaggtccagcctgcttcacataataggtatattcctgaacattgcaggtaaatgtaaattatggcaaactgcttccatagtaaatacattggcaaagtttgccatttaaataataattattgtagtgggacacataattttgtaagaaaaatcattttcctttattttatgtgaatgtaatatttttgtcacctgaatataaactatatcagaggaaagaagaaaaaactgtatatattaaataccttctatgtgctggttttttaggcattttacatacgttatttcatttaatcctattttgctgcagttgacaagagttgttcaaaaaaaatggtaaattgggcacacagtgtaatatcttacatttagaggatagtatattacatggtgcgttgggcacatggtataatctctttataatttggagatatttttgaattaaaggtcctgattaagtgccagtaaaacagatctactcaagcaggttgtgactggaggatgagaaaaaattcattattaaataccaaactgctaactgtatctcaataataaaatccaaaatgttccacgtgtgccgagtcagaaatgaaacattctctcaactctcccttgccaaaataatttccatagttttcactatagttaatacatttttcactactccatatgtgtatcctttatataagagtgaaaattctgaaggaaaataagacagagaaattcaagtatgaggcttaatttacagctttacattttccacaactcaaaaataagcagctggatatcagtggtggaaaagtaggaaagtttgaatgtgtatgaatggctataatcagttccattgagggagactaaatgtgactggccaagaaggtctttgtgccatcgttccttatccatggagcagtgatgagcacatataatcgggcatctcagactgtctaaatcattcactgcacattatgaagctaatatctgcataatttatcttgcctaaacacaatgttggttatgaaaatttttatttttatatcaatattgatggtgtatataaaatagaagaaaaaatggaactctgttattatattgaaggctactaatttcaaagtcttctatggatgaatgcaagtgaggtatttatctggcgagcctcgctgttgtgtgtcttcccataattcccagtgaaagaaatgtaacttcctacacttgtcctatctttactaaagccctcctagaaaatgtcttcctgtatcagtttactcagtataagtactttgtctactaaggtgcaaatcgtggaatatgacatcataggaatttgaagttggccttccctgaaatgttgctttttagtagtcagctggaatatattcctaaactcaagtgcttggcgtgtgtccttcttttttaaccccttctctctatttctttctatttctgcttttaccagagatatcatcaaagaatatcaaatttaaaaagggtcttaatattgtactttctgaaacaggtttatatttaattctataatacatgagtgttatgatactggccattctactcttatccaggggaaatatctgttttccacggtctgtctgcctttcctttcctatgtctcccctcgcaaccccatacacacacacaaagaagtttcacttttcgtggttgaggtttcatccataaattgcacagtgttggcaggtgaaccataatcctttcattttgctggagcagcttagatcctttccatcacaatgaagtttgctgcccttaactcccatgtcatctgactcctttaataaatcatattgccaaccttttggagaaacctttttacatgtgacatccccagtaggttggcaaaggctccctgggccatgcttctacagatgatcgagtaataatccttcccactgtgaacatatgtttccttttgttctttgttttgtgagagactatcgttgtgtgaaggaatgaaaaattcacattacacctctgcctcattttggcccaaaagaaaatgcacatttatgtggataactgattaaaaacaatatgagttgtactttattttaaaatgtaacactatttctactatctaaatatccaacttaaaggtatttaaacgtataagcagatttactcctgaaccttataaatataattctaacttgaggggttgtaaaagaatgtttgatgtcagatacagttgatgcacttaagtaaaacattgtaattggtagcagtgtggcacaatagaaggcttaacaacaatgaccacaagttttcattttcccctaatttaatgcctctccgtacacagtttcagtgatgttgcattttcagaaacatatcccagtgcagtgatgagctttactgtaaagcacttaatgttttcatttaattactccaaatatgttgtaaatatttttgaaataaaggaatgtctactgtaatatttctatctttcatggtgctagtatgtggtgttaggaatttaatagaaggttaataaacagatttaaattttctgcattatataaaagctctgactgagaattatgaaatattgtaatattgacttgtgaacacatctttaaggaaaatataggaaaattatcattatgggagttaaataatcataactacaatgcactcattacattcaaatagtaaaaattttaccaatcacttatattagaatcttattaaaaccataaattaaaatatcagttatttttcccagaaatgtaatattctcagttgctcatttattcattaatgttacctcacctctgtttaatgttattaattaaaaagtagcaaatgacatactaggggaaattgatttttttaacctgtatgggtgacctacaatttcagctagtacccagatatacaggtaatatttttgcctcctcttccacatcaccactccgctatgaccacaaccaaccagaactgaccaagatttctgtgttcctagtagaaatcctcctaatgttttgtcagacatcacccttaagagatgaagtattttctacaccctggtcttggttatccctatggtagtgtttaatccaaggtcgtataacccaatttcttacagaactcttctatagtcatcttaaatacccattatatcagctctttttgctcaaataaatatgtaagttttttttgtgcgctggtgtcattgatttgaggaacccaaacaaggttaatgtggctcaagtaaagtgagcaagagtgtgaatggattgggatgagtgtgaatgggttccttctctcctggtgctgttgactccagcaggtcccatagggtttctatcagccaataagaggtggctcacgcctgtaatcccagcactttgggagcctgaagcaggtggatcacctgaggtcaggaattcgataccagcctggcaaacatggtgaaaccccgtctctactaaaaatacaaaaaacagccaggtgtggtggcaggcacctgtaatcccagttactcgggaggctgaggcaggagaatcgcttgaacccagaaggcggaggttgcagtgagcaaagatcacaccattgcactccagcctgggcgacaagagtgaaacttgtctcaaaaaaaaaaaaaaagtatatgtgaataacctccttaattaaatacctctcatgtaatctgctatcaccaattactcctaatgtttcccttttccaagcttgttctaggtcttcagaacaccaatccttagattttttttcctctgcacattgtacctttgaatttatttctatgagtaagatcatatcttagccttgtgccagaaaagcgttcgcaagtctttcagcatctaattcccgaatgaaagatttcttctttccttagacattctagttacttaaaggccagctcctttttcttctgaatattttaaaaccaccaaacaaacagaagatgtttgaaacaaggttgcggggatttcctgataaaaggtttttttctttcctttttttcaggaaattgagatgaaagggagaaaagtgatatatgcttggaaaaatatttcagaaacagagaatcagaaatggaaataggacttcaagcttgagagcggtattgcaaattatgagtatgaatggtaatttctgtaagaaaatgaatataggggaaattagagaatgaaatgaagaacatttgatgaaaacaaatacactgcaattctatttatatgcaaataaatgtattttcttatcaaatactctttatctatttggtttttcactctttataaataggaatgctgcacagttcatttttctaacaaaactatttctatcttaatgaaaatttaaactaaataaacctatttttaaatgtgatttttggtatatttactagcaaattaaaagaataggaatgcaatttatctacaagtagtggtgcaagatcagaattatattaatagtaatctatatgagatttaaatgatgaatgtttcccttttttgtgctatttcattttactgttttcagataactgagactttgttttattttcctctttctgcctactaagtttttaatatcagtgatttatataacgggtgaggaaaggcgtcatatgactctaccatgctctcaatactgttccttcattattacccgccattgaccaaattaagtgcagaggaatttctgaccctggttctctctacctttaacccgtatcagagaccaattatgagcctgctgtgctgatatgtgtcttgtgattctctcttggttccacgcataggaatttgtgattggcatgtacaaaccagatgtcagagaattcaaaagaattttcagtgccctttgtatcttcggtcctatctgaagcctgattcccacctccctatacttactttctgaatcaatattgtattttgataaactctagtattcctgcttttggatcctggcattaattataattaaccactccttgtcttttagtttccttgaaagagcatcctataaacattttttggctggccaatctttccccaatgccaaaatggaaagattgagaagctccctttcttcttcaatactgtcttttgtattccagaataaagactcactgcccaattccatttagttaatcaaacatccattaagcatctaatatgtgccaggaattttactagatattataggtacagaagtggataatactcagttgagtccctggcagtggcatattgggaacatggacacagatgatggtcattagaatatggtgttttgttttacggatgaaaatgtgggctgctagaggagagacacttaactatttagtggtttgggaaattatttattttaagatgattcctgagctgagtcctgaagcataggtacgagttaggtttaaatatatacacacaaaggcagagaaaactgcacgagcaaaggcccagtgttgtgaaaagcatggcagagtttaggaaaatgcagatatatatcaaaggcaatgaagccacaggagccagatcagggagacttctacatgctgagccagaaagaaggatctctgtattctctaggggaagaggccttatcgaagggtttaatcaaggcattagtgagataagagttgcatttcagatagagcgctttgcctgcaagaaaggctatcccaaaggtagagccagcctggaagaattaaactagtagcaggttgttgaaattatccaattaagagacgacaaacactggcattagggtgacagacagtcaaagagtggcaatgttgaaaaatagctacattggcaagactgattagatgtgggaaattggagagagcaagatgtagggtaatttcttggtaaccaaccctcttgcctggaagagtagcggtctcaagataacatgtgtgctggacagtctactctcgagatcaactgtgctggatagtctgctcttgagatcaactcacctctccactgtgcccagtgccaggaagtgtccctctatggaccatttcttcctgttcccttgccctttggttcctagtgagtttggccaatagaaggcactagccaaagattactgctagaaggagggagaaatcaaatcatttattctcctagcctccaccctggccagcccccattaggcagtggcttcattctctcttccagttctatagtcagcccctcttacaaggctgatgttctggccaaattcctgaaacagttctctgtctttatcccttgagagcaatagcttctccctgcttctagaccctaagtatgttttctccatgcttaatacattatttctgctccaaaccttgatcgctttggctagtccatcccttcatttcattctctgggattttctttttgagtgtcctgctgggaccatgactgatataagacatggtaggtttggtggtagacctttgagtttgaagcagttgaaaacaaataaataaacaaaaacaggtacttgatatgagtctgaagggtagaggagatggaaggcctggagatgtgaatgggatcccctagcagagagaaagggagtgaagggcagtgggccggaagggggtcttgagaggcaccgattgttaatttcaggcaaataaggaatttaagaagttgaaggcacagccagagaggtacagaaggaaagcaaaatcaaggaaacccaagatctaggaaatttcaagtggaggacttggcaaacagcatctaatgcaacagagaggccctataagctaaggtctggaaaatatctttatattaggaaataggtaggctattggactctctggagactgggaggtataaatgcttccgggaattgaagaataaaaaagcagccccttatctgataagagcataggtgccaggtgagatcagagagacctgaagtcaatatcaattctccactatgctatttactggcagtaggatgctgggaaagttatttcacctctctggattcccttttgttcatctcttatacatatgtcttagaattattgtcaggaataaataagaaaatgaccacaaagtactgggaacagtgcctagaatacagtgagcactcaattaatgttatgtataacaataaactaaagagaaaaatagtaaaaataggcaaagtgaagtcaaagaggtagggcaataaaaatgtgtacagagcagcatttcccaaaatgtgctccacagtacactggagaggctggcaatactcttgtattgaatgttattaaaaatgaatacctttgtggtgacatgaatttgggaaattattagtttaactttgtttaaactagtattaacttgtttttgtgtgccagaatttcttagaacttttaatatgttaacacgtattgtatcttccacaggagaaatatgatgtataacattttcaaacttgtttgattatagtatcctttttgtttctctttctttcttttttttttttttttttttgacagagtcttgttgctctgccaccaaggctggaatgcagtgacatgatctaggctcactgcaacctctgccttccaggttcaagcaattctcctgcctcagcctcccaagtggctgcgattacaggcatgcaccagcctgctcagctaattttttgtatttttagtagagacagaatttcaccatgttggccaggttggtcttgaacttctgacctcaggagaataatgaatatgctctaagaaacaatatttatgcttatatgatagatgctttgtttatctttcctttgtttaaaaaattataaatgtaaccttaaggataaagaaaacatagcagcaagatcaactgtaatttaaatctcagaatcaggagaatttgcttggaaagcaatcatcccaactttcttataaaacactgatgttcaggaaaatgcttttggaggaaaatacgtagatatcttccttactttatggactgtactaattctggcttcagtaattgtacatgtaaaatgtttctttgagttttgaatcaaaaaatgaaccatacattttaacatcattttccaatgtaattatcttaatatatagcttaacagaccaatcaactttgttcagtatatatcattgaatcataaagccatattttttcaaagaccatctagttcaaaatttaagctgatgcttagatattgtctctaatatcactgctaattaatcataaatggtgacattaccaacagctgtaaagtagccattccaccttcagacaacagttttgttgttttgttgatttggtttggtcttgagattaactacttctggttgtagcattcacatgttacttccatctctgtttgactttagtagagcactatatagtaactgctcttgctctcatgcatgttatgaataactgctttgccaacagacctgatggcttataaagataaaatgtgagaagcttgtcatctcactgttctgtcctcatcctccatcacacaactttaagctatttacaccagcctgagttttctgcctattgccatttttttcttttttatagccccaataacaaattgagtagaaaacagtttttattcttcccgagggtgttccacgatgaaccatggtaaggagttgggaatgctagtgtgagaaaaatgcatggcacatagtaagcattctatacatgcagattttatattattccaatctctgctcaagaaacatttttattcagcacttctttctgaacagcctatctaaaatcatccctatcactctaatattttaccactcttacctaagcttctttttcttcagagaatgtatcattcactaaatgacattacattgcatattttatgataacttagctcctctatgggaatatttataggtttcatgacagcaaggactttgtccattgtgttcactgttgtatcctcagctcctggaagagtgcctggcctatggtaatgtccagtgaacatttgttgaacgagtgaatgaatgagtgttgaataaataaatggagtgagggaggtcaaatggaaggtatgggacagactcgagacagaggaatagcaggatgcaggtgtgcaagcacagggagtagagaagctgcacagtgagatgagctaggagggagggtctatcaggcaggcgccactgagtcgggctggggaggcagtggcaccagggtggaggatgacctggagatgccattttgctctggtggagggaatagaggttttattaccacaggtgaaaatgagctcatttagacatcaagataatgttcctgacccttttttttctctttattttatcaggttagagtaaaccactgaggaccaaatgatgggtgcccaagtcataaataggttcccttgtgtaatgaagcaaaagcatagcttttctgatcatttattctccatcgtattcattgactgtgcctataatttacttacttataaaaagtaagtttttaaaatgtaaaactttgtttttatcttggctctacggtttgaaaatgtcaaatagaaacttaatgtgtaaatctttttttctctcaccatgcacgtcatataaccagattgtctctagacctcaaaaggcatttctggaaactcacacaactaactgaagctctgatgataaattattgtttttcttcaaaacttaaaacttttatgatttcctttacttttggaaattttattgtttatttttttaaatgcacatagatacctcacggaaattttaaaaatgactttttgaaaatgattgtcttttcctggataaaattccattacgtaacttcttatagaaacaactggtaatttttatactcagttgaaatactaggtgataaatattttattatgcaacacagacagtgagttaaacatgctgattcatgagtgctacataaagtgttagtacatatagaccaaaaacctgaattgtccagattttcaagtgactaacatacaaaatatatgcttaagacaactgctattacttaaataattcagtatttctctggtaagttgaaaggtattacataatcttgtaatgcactgatctatatccatagtctattaactgtactgaaaaagtactgaagtttgggttagctgtaatttttattctacaactttaattttgtttctgtttgttggcaaatcaatatatcatccaaagccaaaaatagaaggaaaattgtgatcaaattatttacactctcacatacatgactgaaaggagtttttgctcctgcctttataaatttatgatcaggagactcacttctggagtataaaaatagcattaataattctttaatgaattgttttccttaaaattaataatcttctttactcaatatcaaatcaaaatttctggaaacatttgaaaacacatttacacaagtctctttctgtctctggagtggctacactagaattaagctaattgtcacacatcatcctgtctctgagataagccaggaatttccaattttagtcaagttggtgatccataaaatagatatcctagtaaaattactatgagctttctacttactttgatattgtgctgataactaaagtgtaattataaaaattgaagtgttgttactgccaaataccacaaagtataagcatcacacttataataatacatattgacaccatcaccttaagaaatatcttctcatttgaatgtacttaaaattcttagatttttatctaggaaaaaaaattggcttctaaagttcgtgaatgttaagttgattaataagataaatagtaaaagaccgagggaatggtatattgtctccatgtattattaaacattgagtcatgtggtcatctcttaaaggattatagaaaaaaaaggtttttatgaaatgcattggtgtaatagccttatttacatataaacatagtgaggagatgtgcccaagtttattctgcattgccatgggggaatttcctctgcaattttccctaactaaattatactttttaattagtcttttagaactgactataggccttattcaaagtggttagatacttgagatttgtaatatggaaattgtggtattgacaaagctttgctaaaataatcacaaggacttagaactaaatactttggaattcattctaaaaacttagtttatgaggttttgttatttttttttaattagcgaaatttgctaaaactgagccacccttataatgtgtctcagattgcttccttggatttacattttatttatttgcaacaaataaaatacagttgcatctttaaaccctttttccatctctatgctattaccttggttcatttctactgctagattgatgtaacatctttcttttctgaaggatagttgagaaactaatgagaatctttccattgaaattcttgctgctacactgaggccttcaattagcctctttactatatggctgcttatggttttgaagtaaggtattcttaatttgatatctttaagcctgaatcaggtgtgcatcatcatgcacgagaattctgtaataacatacaaagaactggaaaactgacagatgttcacagcggaaaatgtataaaatacaacaggcagaaaaagaatatcatcattcctaaacactgcattccaaaatagctaccatctggagacatatctttccaaatcttttcctgtatctgtgcatttgagtgtgtatgttaaaaaaaaaaaaggtataaaacttccctactatacatgcttttttcacttaaaggtattgtgataatttttttcaagacctgaacattttcactcttctgcaatttaggacattaacccatatgtcaaggtcaattgcatgcaattcccaagtgtatttgcattgttaaagacgtagatgatcatagatacagattgtaaccatgaagtggggaaaaggaatttgttgagcaaagagattgttgtctatgtatgtgcccaccattagtgtaactactgaagaattacacacatagcaaaacttcagaggctatattggcaggcatttattttccattttttcacaactaaacactgtgcataaggaacttaagaataaaggcatgctggttaaaaaaaaagatataggattgaattctggctgtattctttactagctatggcatttggcagtgtactgatctcttcatagaagacaaatcacagtggctgcacagatcactattcctccagcagcccagtctgccatcccaccaggtcagcctacgcccagccttgctaatatcttgctaatcttggaggaaaatttcttttcctctttgatccacatagtctgaagttgggataccattctcctacttgacctcactgctctgggcagaatgaacagccaagaggtgaacacctgacctaagcccatgtggggactgcacctcgctgaccactgtctttggaattggcatgtgatctaagccagaacaatcagaacctagtcctacaattgttttcaaactggcaatggcaggggaggtgaaagaatattttcctttccagttgtggagctaaggcatgagcttggacagtgtcctcaaccataaaactgactcaagaagaaacgttttgtaggaagaaatattttatagcagaaaagaagccagcaggaatagtagagacttcagcaagactatcattcattgcaggaagatgatctcattcctcagactccagtgagtcactccacaggcacttagaaaaattacaaatttactaaaattcaactccatcataaccaagcaggcataatagtgatacttgggatccttatgtaaactgaatcagagtgattatgtaatttatcataccaaccggaacacttccgagagtgaagggatccttatgccaggacagaagacgcaaatcagcctgttctgggaaaaccgtgatggatggttacctcttcctgaaaacacaaacaaacacgttttgtgcagtatgcagtcactagttcctcgcccatctcactcatccatgaaaatctctgctctaagatgaactaaccatagaaaaggaattgcaattatcttaaatcaaaaactaaaacctgtacacacatattcctagaaacttcctactagcccagaactgagaataaccaaaatgtccttcaacaagtaaaaagtttaaaaactgtggtgcatccataccatataatattattcagcaatgaaaaggaatgaaccattgatacacatagccacttaaatgaacttcaggaaaataatgctgagtggaaaaagtccatctcaaaaggtctcattctgtatgattccattatataacattatgatgaaggaaagtttcatggttgccaaagactagggattaggggaatggggaatagctgcatgtggctaaaaggggctaacatgaggaagccttgaaataatgaaacagttatatatcttgattgtggtggtaattacataaagttatacatgtgataaatttgtaagatctggacatacactcacaaatgagcacatatgtaactggtgaaatctgtatatgctctatgagatgtactaatatcaatttcaccttttggatttttcttgttttaatatgtaagatatcaacattgggggaggcaggatcaaaagtacctggaactttcctgtatatttccttgcaacttcgtataaatctgtagttatctccaggaaaaatgtttttaaaaactttattaggtttttcaaagcttgctttgttttgttttttgtatgtgtgtgtggcactctgctatgtattttaacagtggatagatatagtctttgtcctacagggactgtttcagaaaaacaataactacaattgcagggaaagtaagttatcgaagcaaatttgaagcacctaggaacatacacaaaatacacaaagacctcaataaaacaccattagctgcaaactcaaatttattatgaagcacgttgtatattggactatattcttaccaggtttatctagaaagttcttgaaaggaccaatcattaaggcattccccttcataattcccacaacattgttaaaggcaacattttaatgactcttcagagaatcagataaaaaaggaaattaccactgtaagaggtaagggcaaaatattaattgataaagtaatattcttccattcttttagtaattattaagtagcatatctggaaatggtataaataagtctgaacaaaatagaaagtataagataagcttacaaggtttgagtaaaacaggagcggagtagaggaaaagaatggatgaagtattaatgtgaagatgaatacatgttcagatatttccaccagtcaatcatcaaacatgtattaaggtaaacatgtaaggaaggcactgtgttcctcattttaagagtacaaaacaaagttattttgctaagaagtctgtaatacaagtgaaaataacaaacatgtaagaagctaaagggcaatatatgagttaatactataatagaagctttgaagtattaacgtattagtttataaatgaatgagaaagagaactgtattgaaataaatgtccttgcattcagataaaggaaaaagctcttgggctggagggagcactgatttcatgaaggaagacaaaaatttaatataagtccaatagagtttaaacagttaagagcaggttaaggaaaacatttcacattggagaaagagaagaacagaagtagaaacacgagaaaatgtaagttatgtttaggaggcttgaataaaacagtggggacagattcaggtcctgaggaggatgagtagttggaaatgaggttgaaaaggtggttttgcccagccatgaacttctattcataataatctattcaataatgctgcaaagggaaacattaaaatgagctttagttcagcagtggtgtgcaggaaaaaaattatcatacctcattttagctttaattgattttataattccaaatttgctgttaaatgcaaatgcttaattctaaatacgtgtgctctgtcttaattagataaaataatcctctgttgcttgggtagttcagtaaattagtccctagacttaaactcccctggatcatgttgtttatgcattaatcggtatgcactcttagagataaatgaaaaataaatggattttttcagagacaagttgtaactgtcagcatactttcaaatttatatcctctgcatgtgactaaaaatttgccatcgtttactgtagtaattacaattcatatatatatgctcccatacttgtagaatttcttctacatgtttgtattttatttaaaactacatgttgctagccaaagctaagtagagaatctaaacctcaccattatgtacataaccatgccaccaactcaacaatgtaggttctatctgcatttgtatataagatatgtcccaaaggaactaatcaatgtaggtaactgaagcagaaattaaatgatttagttcttccaagcctcactgccttattgataatgatggagatgatactgatgatccctaccattgactgagtgactgctgtttattggggacattcctaggaactttatgtacattatctcatcgaatccttatacactcctatatattataatcatttcagtaatgggcaaactgagtttcagggagaaactaaaggagttaggagtgaaaccttggtccatttgaccacagaactctacacacactgtaacataccatactactttgtgtgaaaactatgacacggcttgtatttcccctttattggtctaccacttcttcctcttcctcttactacggaaatatctcgagacacaggtgactgaatcagtccttggttgggactgccttttggacagaaatggggtagggatcactcctggagacagctgattcctgcccatccaaaatcattcttgcggtttcttttttctgtccgtcaatctgtcaggcacatgttcccagaaaaaagtctgtatatcagtggattcctatatattcgtaaacgtcaggcttattcttttgttttttatcttcttcagtgtaatagatttgatgcttctgtactctgtaagataattacacagagctgaatgtaatgttacgtgctgatggggagaactggtgttttaaattcttttaaatctggagcttttatggtcaacgttagaagcaccatggcagacttatgccctggctttagaagcctgtatgagattttgtgacttgctggctttatgagacttttacacctcagattggcctttccctccaagaaagataccaccagacaacaacaattttaacactaatgtcttccttttgattacattagatttgcaaattaaacagattaatagtagtgttctgtgttcctctcagctcttctgtttaatactcttatctgacaaagtgtaaatagaagacataattaattactcattacttgcatgtcaagttgcataaaaaattacatccccaggaggcctattattacatatctgactgttcagtgaaattagttttgcaaagaaaaagcataccttaaggtaagggttttgtttgtttttcttttctttttatttaatttattagagtatctgcaaaaaattgtggaagaacaacattaactcttaatacacaattaaagagattaattcatttgcccaaggatatgttatttttccttttttattttttagtttgtccatgagatattaaactttgcatttgaaagttataagctaatgatgcttctacaaaaggaagaccccagaatatgcctattgtctctttagtatatatcccacagagaaagttattagttaagcaggctatgtcataccccctcctctgtaaattgtctcaaccttgagctgggaagtgtactgccatgactgaaaaaaatagaataattttccagccatttcttgtcttatctgtctagagttgatctgaatgaaatgaggtctctgcttcaactggagagctcagcatttcatatttagctctcaatctgtttcatgataatttttgaaggaacagactgcttatgacaaaatgtgctgtactattattaaaggcatactgcctttatagagttccatcacttgaaacaaagtgctggctgggaagaattcttgaatgtgcatatcttctgaggttttttaacagctattaaataaaatatagtatgtgcctcaggtaagagaaaaccaagtacctgattaaaaacaaaacaaaacaaaaaggtcgtagcattgtcaatagagcaaagcagcataaagcaaagattacctgcctgcaatcacttagtcacttcacctctctgtaaaaatgacaatcataatcacctctacctcgcaggattactgtgaggtctaaatgagctaatctgtgaaagcactttgtaaactgtaaagcacaatttaaatacatattatcttattaaaaatgtctgcatcacctgtttcattgactctgggagagagatgttttcttttccacatttatgtgtatttgtgcatgtgtgtagtgtgtttcgtggaagcctttaattaacacggtagtactttctttttctttttataaactaaagtttgccatacccaagtgcactttctgtcacctgaagtcacagcttaattatgtgtctggaatgacttaatatataaaagtcataaaaatttctgtctaatggcaactatttttatgttagccctgtcttttatatactgaccagatcattctcattaaaaattgttgtttatctaatttcatacccataccacccagcattctatttgtacagtgttttatgtctatgatcaccaatcatctttcatatgttatatttgagcataatttattctttctttctatgaacatttatagagcatcaattgtgtgccaaatactgtgctaatcattcagtgtctccttggatttcacttatctgtaggtaaaagtgattacatatttatagtaataactccaattacagtgcagttggctcaaccagtacacacccaatatcagcctttttcctatgaagagccctcacaggtgttgctcagtgcccagtggggctttgctgtggaaccctagttctctgcccttccagcctcgaagttttcctgttagacatctgccctgctcgaccaggtgctaccactgccaatcccagcaccttccttgatgtacccaaaatcttcccatgccttgaaaactaagcctttcttagtatgtcaagctgttgctttggggttttctttgttagtttggttttcccattgcagtttgtcagctgtgggccgataggtttctggaatttcagtgtcaccaattattcaggtatgtgtacctattcaggtatgtgtaccagaataattgtgtgtgaaggtgtgtgaagtccatttaggcacaagctgggatctccactcccgaccccatcacattaaaaatagcaaaaattacttatctaattttatcttcctctcatttgccttgtccatcttctagttgagttgaataaactagtggacagtgaaataatcaaatgcaggatagcatacaggaagatgaaaaacataaatataatctaattttttaaagcctgtgttaaatttcttctgcttgtaaacgttttgaaatcttaattgaatatgaaaatagatacaaggtaaaaagtttatttttgtttgatactgtgctccatgtatttatttctaatttccacagtggatggaatattagaaattattgaaagtcctaattatctcaaacatttgcattttacgttaaatgtcctaaataagcaaccatttaatatgaatttaaaattaaaatttaaaggctggacgcggtggtccatgtctataatctcagcattttgggaggccaaggcgggaggatcacttaagtccaggaattccagaatagtttgggcagtatggcgagacccctatctctacaaaaaatttcaaaattacctgggcatggtggctcgcacctgtagttccagctacttcagaggctgagatgggagaatcgcttgagcacaggaagtcggggttgcagtgaacatgattgtgccagtgcactccagacaagatgaaacagcaagaccctgtctcaaaaataaatatatatatattttttgagacagagtctggagtctcgctctgtcgcccaggctggagtgcagtggcgccatctccgcttactggaagctccgcctcccgggttcgcgccattctcctgcctcagaccagaggcgcctgccaccacgcccagctaattttttgtattttttagtagagacggggtttcactgtgtgagccaggatggtctcgatctcctgacctcgtgatccgcccgcctcggcctcccaaagtgctgggattacaggcgtgagccaccgcgcccggccataaataaacaatctttttaagaaaagtttcattctttatagaaacatatcctacgttgaacgagagttttaatgtgagtctacataatcattgtcaggttctaactaaaaagaaggcaaatataaaaaccggctttgtcacttgaagaacacaagaaataataatgagaactatgcaccatttcacaattctcacacttgaacattgttaatgttgaagccccaggattatggaaacactggaaatatgccacactgtgatcacattcatttttagaattaatagtaggtatcatccaaatggttctaaaatacattttttaagtgtgaaatgtctttcacaaatatggccatgacttttcagagcactcttttgcaaataaataattctggatagccaaattctactagacctccctatacagaaatctcataaaactcagataaatgcaaataagtcaatgaaaagaatagctctctatcttcctcctaactcagccacttaagactaatattgcctctattaaagagatgaaagcagatgtggtatacattattgatattgctccacattgaaagttaaaacttttatatatgttctctcagattatataaaactcatataaaatttacttaatgaagttttcaaaatagtgtatgggaaaaagggtaagtttgtgatttcatggctgttttcatatgctgatctgaattcaatgtcgtctctctcttttcacaaaccatctgggagattgacaagttgcatctcaccagatggcctaccataccaacctcacacttccatggcaccatccctccatgataaatcctgaaatgctttaatacaatgttcctgctcgggaagaactccacagctcatgccttacgaaccagttcatcgtcacccacttcatttcccaaggttgaaatgggatatgatttccactgggtgctaaattattctatggctcagaggaattaagtgatcccagctgaatacaccaccaagctcctatcatcctatctttctacaatctcttttcttattctctgtttcccttactactccctggcctattcttttataacttacactttacagagagattccattcttttttcctctccttttccatatacataaatcactggaatgtatactttaaagtgtcagaaagcaatgacagttttgagctgtggttcatgtcttcctgaacctagcatgcagatagttgatactatacaatacaaaactgaattgtctgtgtcaattattttatagtatcactacatatttaaaagatactataaagacacatgcacacgtgtgtttattgtggcactgctcacaacagcaaagacttggaaccaacctaaatgcccatcaatgatagactggatgaagaaaatgtggcacatatgcaccatggtatactatgcagccataaaaaaggatgaattcatgtcctttgcagggacatggatgaagctggaaaccatcattctcaacaaactgacacaagaacagaaaaccaaacaccacatgtttgcgttcataagtgggagtggaacaatgagaacatatggacacaaggagggaaacatcacacaccggggcctgtcggggggtggggggttagcattaggagaaatacctaatgttgatgattggttgatggatgcagcaaaccaccatggcacgtttatacctatgtaacaaacctgcatgttctgcacatgtatcccagaacttaaagtataataataataataaaagatactgtctgggaagagattcttaagaccactcattcttccttttgcctttacaaatgtcagagaggcactaaagaacaaactgtgaaggaaaaagacctgaaaaaatatcttttttcccctagcttacagatcaaatctgacctcaatatcttcccccactccctcccctacttttcccctctgagcctctctcataagttttataaattcttccagtcatttagtgttcaagaagagagtccaaatcagaaactttgcttaatatgataggtctcatttctctggtgccttgatcatctttctttaaatagagtgaattttagcttccaagttattttttcttctctttcttgacttttagactttactgtgtctgtattctctgacaaacatataaactgcttatatcttcaccctcatgttttgcatatcaaatccaactatctgctaaatttttcttttcatttagcagtaactgactaccataaatatactatcactgtaagaacaaaccatgtcatagagaagtttgcctccaggaactttatttcaaatctttttacttaagttttcaaaatgctactttatatgttattttatttctcccattgcatccccaggttgggtcagatgacagtatacctgcatcatctttatatgtggatatcagtttccatttcctattctcccacatgcagagctgcaagaagttgtctgcagcttgttgggcacataaagatctttatggaacaggctctgcacaatccaacataatattgacctcagagaagtttggtgctttccttgggtgtgactttgtcgactagaagattagccagtgtttctcaagaataccgaatggtctatttggtgtagataaaaagagaaattgtgatgattaatgaaagaggaatttttgatacggaaagaataagattagttctgtcatgaggatagggagaccaacagctaactcagttagttaaaggataatggaatagagtaacatgaaaatctgtcatcttacttccctgcttaaaacatacaaatagattttcatggttcttcagataatgcccacacttcttcaggggtttaaagtctttcatgatctgatttattatcactttgttagtgtcatctcttgtcaattcctcacctttttatgctgtaatctttctgaatttttctctgttcctcacacttgatactcattctcaccttcctctaatcctttgcatataccattctctctgcctggaaaattcctaactctacactctccccttaacccaacaagtggctcctcatcctccaggtctcagctaagatgatactccattcacaaatgcattcctgacctcctctcctttaaaaatgggaggagtactcagttttttcctcctcctcagaaaccttccatactccatccttaattggctatctggaaaagtcctgtttatttatcaagacacaacttaaaacagttttctattctttgaaaccatcccagcctcactcaagtgtagttgattcttttccttcttaatacatcactataacttgaagatatgtctattattaattaaattacactgctatgacaagatttccctgtatatttatattcccaaccaggcaataaatatgatctccttaaagaaagagactgtcttatattcactattatcattttacccccaaatatactctttcctcacctgcttatcttacagatgtaattaatttttagttacctatctgttactctgtaagccttctaagggagggaccatgtttaattcaccactctttacctaccacgtttcacaaaccttggcacatacagacactcagatagttttagaatgaatgtatgagcttgtatttgtatacaaaagataaatttttctgcaagtattaacaaaaaaggactgaaccagagactcttagtagttttctgtagcctttactaatgttgataatatatgataaattggaggtcatagaaaattcatctggtctatttagttacaattcatttgcatggccccatgcagggcagagatctagaaaaaataacacttatgaaaagttatgacaaataaatcagatgagaataccagattatacaatttacctatggccctaaacatagtctaatatacttaaaagacagacatacttaatatcatctgcatacattttttttcaacaagcattatttatagatcatctaaaatatgctaggctctgctgataggaaaaataatgcatcccaaaagatgaccataccctaaccctaaccgtaactgtggaagctgtaaatgtgttttcttatatgacaaaagagactttgctgatcggattaagattaaggaccttacaacagcaagattattctggaatttctagctgggctctccaatcacctagttccttaaaactagaagaggaaggtaaaagactaggtcagggaaacggccacagagagactcaccctaccattgctggcttggaagatgcaggagaaagggcataagccaaggtatgcaggcagtggaaggtgataagccaaggtatgcaggcagtctctagaatctgggaacagtcctcaggtgactaccagcaaggaaatggcgacctcaatccttgtaacaggaagaaactaaattctgccaacaacagtgaaggagttaaaaaaaaaaattataggccgggcgcggtggctgacgcctgtaatcccagcactttgggaggccgaggcgggcggatcacgaggtcaggagatcgagaccatcctggctaacacagtgaaaccccgtctctactaaaaacacagtgaaaccccgtctctactaaaaatacaaaaaaattaaccgggcgtggtggcgggcgcccgtagtcccagatactcgggaggctgacgcaggagaatgacgtgaaccccggggggcggagcctgccgtgagccgagctcgcgccactgcattccaccctgggcgacagcgagactccgtctcaaaaaaaaaaaaaaattatagagcccctagaaaggaacacaactcttcttctgacaccttgattttagcccagtgagacccatgccagacttctgacctatagaattgtaggataatacatctgtttcaagtcattatatttgtataaatttgttggagcagcagtagaaaactaatgcagcactgggctaaatgcttgggagagaacaataaagagctattcttaattaatgtctcttttttatggcatttttaaagaccatagaatagtctgacctgcaaaacagatttatggaacaagtaataccgatacagtataataaaacttatagtagatgtatataagttttatacttcaagaaatagtgatggaattaaggaaggtgttaaatctatttggagtgggatcagggaaaatttcagagaacaaaccattttaagatgggtccttaagtaataaatactagttttccaattggctagatgggggtacgatttagtaccatgttaagctaagaaggagtgcaattggagatggatgagtgatagaagaatgagtgacatgaggacttgtttgtcccacaaaatgtatttggatgtataatatggaataatttgcatctagaaagtttgctccagctgcaaatggggaatggaagaggggcaacactgtatgcagagactactaccataggctgagtaagaaaggatgaggtctctgttttataatagcccccatttattggaacttggctatgtgtcagcaactataacaacactttacatatataattccatttagtctctgttagttagctctgcaaagcagatgccattccatctcacaaagaaaccaaagtttacacaaatgtgcccttaaaaaagaaataccccacaaaaagctaacaaaagtaggattcaaacccagttgttaatcacattaaagcctgtgctttaattcactctaccatggcaggaacagggaatcaatataagaagacagaaagagagagatttaataggtaaaattaactaagcttattattgattacacgtaggacaagggaaagagaggaattgtagcttactgatagtttttggatttgagttctaggggaaaggagttccagctaagatagggaccaaagtagaagacactttctgagtcaggaataaaagttaagcttcggatgaatttaaggtgtgtattggatagccaggtagagatgcccagaagccagtctggaatttagaattgggacatggactgaagagaaggatttgaaaatcatctacctgtaggtaactttcatggtctggaacccttcatatataaatgttggagaaatctcctgtttctaatgaatagtgaaagaatctatccttatctgtgctctgaaagaaactttcatctgagactccctgaaaagatggctcagcctaacaccaacgctgactaccagactgggggtgctggcaaaatggcaaactgacagtgccaagggctttgtctgtgtcctgcttgatgaggtcagaaccttgttcccgtggaagacctactatgtcatacagctctgctgcattaacagccagtctgaaagtaaatactttgctttagacactgtttttaactgcttaatgagcatactgacttcccaccctaccccccaattagctgcatatcaatcagtcaattagcagatagacagctcagccaaggaacagtgaaggctggtgttgcaactgattgttaaatctgtcttgaatttgctattggaaaatgagagaagtttagggcaaatactgctccctgtacccctgactgaaatcttctagacaaaataattgctatcaaatattctgatacaggaattcttgaaactgcctggttactttactagaaagggaagcagccactaactgcaaaagactacctctgttgtaccagatgcacaagaagagattttcaccattgcagagctatttatacacagccaacttctgtcctcagttcacatatacacacaactcccattgatatcagtggaagctgcggacatgtggctgagaacagaatttggcccactgagctgcaaggcttggcattcttttgctcactatgacaacttcagaactggatctcttagcacatgtgcttttagaagaagagttcttgatttattttcttttttttccctcccctctttatcttggccttgaaaaacaaaatggaaacttgagaaactactggcagcaatgggtttttcttgcatagaatcaactgtatggcggacttggagaaacagagaccatacaagtttttggattcaaaaacttgacaaaatagttttctgtaagtgtgctgccgttcccaggatgccgactaacagcttggcttcacagtcgtccttgaaataaaagcaaaagatgccatgaaacaacttttacacacgtaaaattattaagtccaatatttaatttacagatgacatattccagagaatatttgaaacctgtcattaatatgtacttttattcttcttataggaattgctctttctctagtttaagtgattttagtggggctgtcagcaagactcctgcctccctgtaagtgtacatgtcaggctaggcaatcagtgtatccagtcctcttgaaaacaaaaggcctattaaccaaggagagacaaccagcatatgatatttcaaagattatatggaacagggaaacagactctccttccgaggtcaggagattaaaggatacaaagtcttttagctttgggggccagttttgtaccacttagagaaaaactgcaggtaatgaagccaacagggaggaaagtaaagaaggtagaggagaaaacatttttataatatttaaatccctggatctagccatgccttactgaattttcccactatgaacaaaaaattaatccctttattcttaaactggttggagttgaatctctaataactggtaacctatagggatttaacaaaaaaacattgctccttcattcactctagagattttctctgccaaaatgtatttttttattgcgtgcaaacactcagatttcaccatctttgtatatactgaaactttcctaaataaataacctcaggaaaaacatgtgatttgcaataactgtggatgctcttcacaccaagaagataggcaggaagattatactagacaatgcaaacacataatgtctccatgtctctgctctgttgggaaagaggaagccagtggaggaccctctttgtggatgcactttgaggaagcacctcattatcttgactcttggctgttgcccagtgtggtgccctgatggagtctgcgcccagcatgtagctctggtaatggatccagtgacaggcagactgtgttacaaggtgcattacacttgaccagccatcattacatcggttctgcccaaattatttgattgacatttttagagaaagtcaggaactgttcataattggtagccaggaaggcactattttcaaataagtgaataccaagaatgaaagtgtaaaggaagagacttaaagaaatgggaaggttttcagccaggcgtggtggctcaagcctgtaaccccagtactttgggaggccaaggtgggcggatcacgaggtcaggagatctagaccatcttggctaacacggtgaaaccccatctctactaaaaaatacaaagaattagccgggtgtggtggcaggcgcctgtagtcccagctactcaggaggctgaggcaggagaatggtgtgaactcgggaggcgagcttgcagtgagccgggatcgcaccactgcactccagcctgggcgacagagcaagactctgtctcaaaaaaaaaaaaaaaaaaagaaagaaagaaagaaatgggaaagttctagggaaatgggtcttctgccattgtgaaatttggatttcacaatttaggatgtgtgggccatcctaaaattaggagaatgtgattcagccttgatacacacgaattggaagaatagcttacataaacagcctttagttacatctatttggcatagcaatgaatctatgcaaaaccttaacagtttattgtacagtacattcccatcaattacccagaaaatacatgtcttatatgtcaatatatcatgcagtagattcccattaatcatccggaaaatatgtcttaggaataagttatctactgcctgaggaatttaatttaattgttgaagaaattgccttcagcagggactgatttcttgcatcattaccagtgagtgtttcctcacatgtaataactgattttccagacattcaccttataactcccatttatgtgcaggttacaatatccattagacatagaagtcccccttaccacacatgaaaacacatacacccacctacccactcatctaccccaccctacccaccacacacacgtaagaggacttcaaaaagttcaaggacaaatggaattaaagataaaaattaaaaagatgaacttgtttttcaacatatcatcaagttcaagacacttattataaattatgataccagccatttagtctgtccctaaagaactgaggctcctaagaatttaaccatgttgatgcagtttttttttttacattattaagtgaggaacaatggataccctttacagatttttttaacattcagaaacaaaaagaagtcagaatgagccaaatcaggacgataagttggatgtctaacgaattcccactgatattctcacaatattgcccttgtttgatgagaggcatgagcagaagcattgttgtggtggagaagcattgtcatgatgaagctttcctgggcatttttcctcaaaggctttggttaactctcaaaacactcataataggcagatgctattgttctttggctatctggtatgtcaacaagcaacatgctctgagcattccaaaaaattgttgccatgaccattgcctttgactagtccacttttgctttgattgtaccatttccacctcttggtagccattactttgattctgctttgttttcaggatcatactagtaaagccatgtttcatctccggttacaattcttcaaaggaatgcttcagggtcttcatcccactcgtttccataaaagctatgctcttgtctgcagctgatctgggctcactggttttggcatccatcaagtggaaagtttgttcaatttttttcagtcagagctgtgtaagctgaacaaactaagatgtctatggtgttggctattgtttgtgctgttaactgttggtcctcctcaaatagggcactaaatttttttttaaaaaagggcattaacaaggttaaatttttctacacaaattgatgtagatggtctgccacaatgggctgcatcttaaacattgtctcattccttcttaaaatgagtcatccatttgtaaactgatttctttgtggcattgtccccataaactttttataaagcatcagtgatttcaccgttcttccactgaagcttcaccataaatgtgatgtttgttcttgccttaattttagcagaattcatgttgctttcacagggggtcttttcaaatggatgccttatctttcttagtgcttcaaactagattgtatttatacacattataataagttagtaagagtttattttggtgcaaaaagtttttgaaatccatctatagttttctcataaatgcattttccatgaacttttcaaagacctcttttccatcataaatctaaaaaatgttaagatttaagtagcttcactcatctaagagaatcactaagcatttatttgactgcttgtttttcttctactttaaggtgtgcatttgtttcttactgcatgtaataaaaggagccatataaaaaaggtttgttatatggtataataagcaccgtatatacatggtctttctggatactcacaacagccttgtgagacaaagacaaccccgttttacaaatgacaaaaacaaggcttagggctatgaaataaccaagcaaatgagtttgattccaaagctcattctaataaccactaagtaaatgtcagtgcactgttgtatatttttaccgtattttataaaaggtccctaaagacccaaatcctctgtgcatttagttacaagcaccattctgcatttccccccaatacattttcccctggtttatacctatcttctttgttctattatttttgaaattttgagtagtaaaggaatttgggagagggaggatgaagagagagagaaaggaagacagaatcacaccgattaagatgaatttagaaagtaagaccactacggctcacattggtggcatttccctatgtgtctttgcaatgctcttatctgacacaggtctcttaaaggttgggttgaatatctgttcctcagttattgctcttttactccccaaaatcttcccctacaaaggactaaaaatagtgatcagaaatgacctttccctccttagtcccaggtttgtttgggatttcatgtaataaactagagcatgggtgtcctcttccactgattgccatgttcatttcatggccttagtcaggtgccttggctgcaaattttccctctctacactgaaaaacccagttttgctgggcaattttagttcccactatgaagaaaacccttccagcatgtaaatgcaatgcttggtgaggcctttcctgaaaagcagtgttggccttcacacacaagatgagacatgtggagattaactttaatatctaatctattgcagaggtgaaactaaattctatttctttctcctcatctgaaatgaaaaggaaatgcttgaaattttgccccccaaaatagagcactttaatcaaaccattttaatgtgatattcctgtgtcttcattaagtttccagacagttttaatgtttattgaactaaattgatagggttaaacatctttgtaagtataaactaaagtttttatggctatttctattattgtgtaaaagaaaaataacaaaaaagtatctattcgtttgaggaggtagctggtatttgctagcaaaggagaacagccatataattaactgtgtcaaaatgttttctttgttcacagttaatctaactgcagctgctaggaggcagaatgcataaatatgactgtgtacttttaattacagaaaatgacaggcgtaagttgtgactggagtgttgcctgagattgttgtgggcaaaaatgttgctcagagactcattgaattaataagtagccttttattttttggtgtccaaattgtatagatgttactagcaactaaaataaaattaaatttcagaattttaatcagccaaagaaaatttaaatataatcctgcaacatatttagagaaatcatggcacataataaccatttgatattgaacattatatacaataatacttcatacatgtgatttttgtcttggagcaagaaatgctctacataagtgaattttctagagatacctttaagaattaaattatttctcccaattttcctctccattctgtgcaaagaagtcactcccaattctgatttttttccctagatgctctaataataatgaagacaaaatatctcatatttgctgatttttctgttttgataacacatagtaatgcctataaatggaggggtgggtagctctgagtcctggggttcattcccctctaggtgttgatacttatgacatagtatgaaagagaaatggagcagcacttcattatttgggacattgttctcttcttcttccccttttctcttctacctttaatggctgaatagtatagcagaatgttcattgggctttccatcaaacatattttatattcattgtaactctgagcagagaacttaacctttctgaaaatcagttcatttctttatatggatgaaataggatcatcaatgtttaaattttaaatatagtgattgctcagaaatgttattccttttctttttatttttctcctctataactattttttaatcacctttttattatacatcttttctcctttctgtgctatggtagacaggtagggggtgtggtattggctagggaggcttaaggggtcacggtcaatgctgtagataattgctgttttcagctgccttgttgccttcattctattgtctatccctgcacgcagccactgtgggggtggctgtcaccttggtgacagcagttttgtgccatgcatgtggtgtgaacactggcttagagcagggtataaacaggtcctgctgcttcaagtaattcggtataagcagacagactattgcctttgttctcttagcagctctgctgctgaaatacactaataatagaacatgttagttgaaattatgcctctccatctctaattactgcatgccaaagtattctgactgctactgtcatttcccagcaactgatggctgcaggtgattgtttcagattgtgctcaagggacttcttccactcattctactcattctccctttgccccactacgtcatgtgttcaataacttgactgattcatttcagtatgctgaatggtttgaatgaaatagaaatgaactttaagaaaatattttcaaatcagcagatgttcattgtgggttttctctgtgtaaaggaaagtggaacagtcatagaaattgtttagttatatccagaatctacaatgaactcaaacaaatttacaagaaaaaaacaaacaaccccatcaaaaagtgggcaaaggacatgaacagacacttctcaaaagaagacatttatgcagccaaaaaacacatgaaaaaatgctcaccatcactggccatcagagaaatgcaaatcaaaaccacagtgagataccatctcacaccacttagaatggcaatcattaaaaagtcaggaaacaacaggtgctggagaggatgtggagaaataggaacacttttacactgttggtgggactgtaaactagttcaaccattgtggaagtcagtgtggtgattcctcagggatctagaactagaaataccatttgacccagccatcccattactgggtatatacccaaaggactataaatcatgctgctataaagacacatgcacacgtatgtttattgcgtcactattcacaatagcaaagacttggaaccaacccaaatgtccaacaatgatagactggattaagaaaatgtggcacatatacaccatggaatactatgctggcataaaaaatgatgagttcatttcctttgtagggacatggatgaaattggaaatcatcattctcagtaaactatcgcaaggacaaaaaaccaaacactctcatgttctcataggtgggaattgaccaatgagaacacatggacacaggaaggagaacatcacactctggggcctgtcatggggtggggggaggggggagggatagcattaggagatatacctaatgctaaatgacgagttaatgggtgcagcacaccagcatggcacatgtatacatatgtaactaacctgcacattgtgcacatgtaccctaaaacttaaagtatgataataataataaaaaagatgatctatgcattcctgagcctaattttccggattttgatgaagacaactattcaattccatccctactcctacctaactcccccacgtctctatgcatttcaggcagaccttcaaccacgacctgatattcttcctgctgcagacagccagctctgttcagtcaggctttggatcctggagactctctaatctagtttctaagttttacagatgaagaaattctgtgttacatgaagtgtccaagatctcacagtagcttaagcaaagatagaagacaaacccagcattcccaactgttgatattgtatgctctgtgcctcacttcattgtatgttttacctgttatttaatgtaacagatgttgctgataaaatgtgaacagaagttgtcagtggcaggtacaaatcccaggccaacatcgaaagtttgtcactgtcagaacttctgttcagttttagttacatctgctaaggattctaagcacagtgtacatgaaccttccaaaagatccttggcatttttacatcacttttgtttcctcctgctttttatattttatggaatgagtccaaaatgatcaaggcatgtacagtttacataattgtgcactcaaacttgaattttacatgcatccagaatttggtctaattctgtaaaataaaacctcagttggaactgggctatgctgaaaagcaagtttgatataagtgacattcaagatcaccttgtattttccagatgatcagacctgctgtttctaaaagagtacctcactttgtagaccactaaatgcaaattgtattttaaactatagatttgggggaggaggggtaattaagagttatagtaatattgattcttacccatgtatgagtacagatgatatccccatttattcagacattgttttatacctttcattattgttttattgattttaatgcccttattagattcattttcagatattataaaggtttgtttactcttgtgcattggtctacttttctttctctttccttttttttttttttttttttgagatggagtctcactctgtcggcagggctggagtgcagtggcgtgatctcctgggatcaagtgattctcctaccttggcctcccaagtagctggaactacaggcacccaccaccacgcctagctaattttatttatttatttatttagtatttttagtagagatggagtttcaccatattggccaggctggtcttgaacaaactcttgtgtgcggatcaagtgatccacctgcctgggcctcccaaagtgctggaattacaggcaagagccaccgcaccaggccattggatctatttttctgtcatgtttttcaagtttgtttttgttgacttactaaagaaaaattggttttttaatgttaattatgtgttcagcatctctctaggactttcttctcagttcatgtagtttgtctttctatctttctaatcttatcttgaacagcccactcagctttgttccaacaacagggaccttcagatagttcctaaaattccccaagcattttcctcacccagagcctttgcttttcctatgtctcaagtgttcttcagcccaagtggttagctctattttctttatctttcaagccaccatttaaaaatcaacttatcgcagagattattcctaattataccatcaaatgtgggcccttccctctattgtgcttttcaaattccccagcatcacgtttttacccttcttaaaatgtatcgcaagctggaattgttttacttacttgcatttttacattaaaatatgagtttcatcaggaaaggagcttatcagtgtggctcactattatcttcttagcacctaaagctgtgtctgacaaattgtaggtgttcagaaaatataagaacacaagaagagtgacctgagactaatgatctaacatctctgattataagtagaaaatacattttcaaagcatatagtgatacactctgtctccgctgtaaaagaataaaaataaaatataatcataatgaatatccatgacaataaaacatagtgaaattttctggtctaagtcctgtccccaagtgccatgcaggaacaacaacaaaaagccaagaataatgcatagggactcagcacccaagtacggtttgagccacctgaatttaaacagtctgtgattgatttagtatctctctttctctctctctctctatatatatatgtgtgtgtgtatatatatacatatagagatactaaatcaaatatacaaattttctcttatatttatatgtgtttaaacatatacctatatgtttataagttaaaacacacacactatgtgtgtgtatatgtgtgtatatatacgtgtgtatatatgtgtgtatatgtgtgtatatatacgtgtgtatatatgtgtgtgtatatatatacgtgtgtatatatgtgtgtgtatatatgtgtgtatatacacacatacacatgtgtatatacacacacatatatacacacatgtatatacacacacatatatacacacgtgtatatacacacacatatatacacacgtatatatacacacacatagtgtgtgtgtgttttaacttataaacatataggtatatgtttaaacatatacaaatataagagaaaatttgtatatattgaaacatataccagtataagagaaattatgataaatatttaataaatagctcaagaatcacttgctgcagaaattcagaacatgggtcgggcgtggtggctcacgtctgtaatcccagcactttgggaggccaaggcaggcagatcacgaggttaggagatcaagaccagcctggccagcatggtgaaaacccatctttactaaaaatacaacaaaaattagcctggcgtagtggctcatgcctgtaatctcaactactcgggaagctgagacaggagaatcgcttgaacctgggaggcgaaggttgcagtgagccgagatttcactactgcactccagcctgggcgacagagtgagactcagtctcaaaaaaaaaaaaaaaaaaaagaaagaaaaagaaaaaacaaagaaattcagaacatgtatccaacacctagtgtatcaatagaagaatagggcttatttgaccaagggtcattaacagtgttctgttaatgaaccttgaattggccacagaaaacaatatcctgatctgtcaaataaatgttaccaagtgcttactacattcagcagtgcgtttagtttgcggaagagcagaatgactaaatgaatgaatgaattttaaaattgagttagttatgtggacgtttggcaaatgtacaaaaagaatcagcaaagttttattacaatgcaaatgttatgctgcattttaatttctatttagcctctaatatgcaacattaaatcaaactattgtgtacaagaaccttaaagttcatttaatgtgattttaattcatgttataaattaaattatttgcaatggaaatggagaaatgtcttatatcttagtttagacttgtcagctttccaggctaattttgtgcacagtaatactaactgtagacagacactgtacatgaactacagtgtccaaatcatagatcggacctacaataaatttctgtgtggaggagaataaattctcctccttctctccattctcatatcaaactcctccggtattgcattgctggttagcacaaactaacccataaacagcatttaaggggatgttgccattgctgaagcacatactgctattgaatcccattcttcaagcttctcatgcatcactgaaagtcattcaggactctggattcaccaggaactataaaagccaccagcaactactgagaaggcaatgcaattgaagtgtaactctggttggaaaataagtagggaattgggtgttgagtccctgcgtgttattcctggccaaatacatcagagctacatgtcaggttttgtccaaaagtgttgtatttgctttgattttcagaagttcaatataattccattattacaagttcatctatttcttaatgttttaaatacattttatctaagtattgttttgtattggatttactctgaatatgtcaggtctttatagagaaaacagtaaataggaaatatgatacaatatttacagaaaatattctccagttaatgtatcttattattatatgctcttccttatatggtagagtttatgaagttattgagttcattagaaagtgaattaagaacatgaaataggtccagtaaaatatgaacccacacatcaaaaaaaaagatctaatctccaagtggcttgaagtgtagtgtaaatccagtaaagctccaaaataaataaaataaaataaaacgatattatagtatgcatattcaaatgtattaataaaattgtgtgaaacctttttttaaagaaatgtaaatctaagttaagtgttcttgctgttacagattaatagatccacaactttctaatttcaaatttgaaaagctaaacttgtgcaccaaaatattttcagctgaaatatttttaaacattatattttttctattattacttgagctttttaaacttagtaattcaaactaatcttggaacacttgcaaaatgtgatggaaatgaagaagaaataagctgtaaattcaagatggctgaagtttaatttctgtgccgaccttgggtatgtctagggaggaaaattggcactctcttaacaaaacaaaccagagcttagtttctacatagaacaaggtttgaaatgaatatggaatgaaggtaaatatttagaagattaattctttgagcttcctcaataccttagttttgcaagactttgaaaccatcttctccagggacaaaagaaagtaattacctctcctccacatgacgtttaatcatgctctatttttcgaagaacagctgtgcaacactggctgggctacaaattaaacatacctccttcaacttgcttagatttaaaagataatgaatatgttgggtgacagaatctgaattcaaaaagactttaataggccagagctataagctgaaaacaagatgaaagtaatcaaggataaatgtaaggtcctatacttgagtccaagaaaccaagtgagtaaatacagggtggggaagataggacttaatggcaacagactgaattaagcaccagagaatttagaagctatatttgataagaagctaaatatgagttggtggtttcatctaactaaaaaaaaaaatagaatgtggcacatggtacataagtaaaagcattcatcattgaagacctaacctagtttgatacaacataatatgaattcgagggacttacagctctttgcaaaaaaacgctatcactgttattttaatatttgttcaagcagagatcaaaggatctacgctgacataatcttccttttactagttgtactaaaactccaacagtttctgttattatagaatttgtaaaagcttagatactagctggcatcagaatattatgtatattaaaaattagcatatataccacacatgaataagtgaaacaagatgtagcttaatgaaattatgttgtggaactatccatttaacttatgtcacatttgttaaatctagattactttcataattctgacaaagattaacaactgaccattgtgtaatagagaaagaaaataggacctatgtaaaaatcacagagggtctaggaatatgatgtataaaatattttgaggcttcagtctaggaatatgatgtacgagacattttgaggcttcagttcaaagcataaagagtgaaacatgatacatttaccagaaaataaactaaacttctaaacacatgtaaaggagagaggtcattattatctttgtgaatattcattattacagaattggtaaatttcccaggttttcttggcttctctctctacaaataaatcactgtagtaaaaactctcacaggactgtcaggtgggttttctggaaatatttactgtaattgatttttgtggtttcctaaatgctgtaatccaaaacctcatttatcaactttctgtctgctttattgtaattgcagagttttctattcctatatcatgacaggtcagagcagcgctgtgacaagcagcctctgtattagtaaagatgtgcattccacacaccagcccagcaatccagattattgactgtaattaaactcacaggggagttaaacttgtttgacaagaaagggggtgggatgatttgcaggatttaagtcatagcaacagtgacacatgcctgccccaaaactttctctgaattttgcagggcctgtacacatttagaaaagatcaaataattttgttctgcaagagagtagtacatatttataaagcactgaatcccggaatcactggtcccattaattgaacaacacaagcatgcttcttgaagaaattcatataccaaattttgttattctaatatcagttcattacagtcagacttctggcctgggtccagaaacaatgccatttttaatgggttgattgctaaatctcttgctttctttagtttgactcattctttatcgtttcttcttctgattttgactcatttttcttttcacaattaggctttgtcccccttctgcatcacttctccagctttgaccatgttcttctaatttttgccaagaatgcggaatctaattttgatgacactgattttgctatgctggacatatcccctgaccattcagtggaggtccttaggaaccctacattctgggtgtctggatctcttcccacttcttccacctaccttcctgcctctttctcccatatttggccagtccacatgatcgtccaatgtatgtaagtgagactcaaacaaaagcatagaaaactttgttttcaaaaagtaaaaaccattcactcttttgaatattactgtttgaaatgtgtttaggtcctttgggggaatggctatatatgtttatatatatatatatctccacagtagtagcaaagaaaatcaataaagggtatattttatgactcccttttattacaggataagaccaagaaacattagaatcatttaaacctacaacacagagattgaaatacttgttttatgtaggcccagtctctattgtctgaatttttcattagctatagaaactttactggatattggatatggatatagataatcctctctggatatataaaacatctttttatttatctgacataatgtatttaaaaactagttcttctttcttcattctgtctacaaggaaaatccttttcactccccattagttttcttgcaagttcatgcttgtgataaaagaaaggcagaatcagagtctaaagatgggtcagtgaacacccatccctgcactaaagggctatgaagggcagtgcttgctgttattgggtaggcaatataaaaaatatgtaaggaataatattaattctgaatcctggcccattagagattggagcaatcattgctagcaaacatattttctgccttcaagtaatttatagctaattgacagagtgtagaatatcacaattaggtacatcagaaaaatgactttagtaacttggcaggaccaaaaccagccaggtgcaatataacacaagataataatgagtaggtcatgctcatcttcaaagcagaagtcacagctcctaggcgacaaatatcacaaaaaaacttattcatgtttttctgttttgttccttgtgatatttccatatggtatccctgaagataagttgtatctaattagagtgtagaaatactttcggttgctagttgttagcctaatctttactatagaagctgttgtttgtctttttctgaacttttacaatgacatttaatacttaagttaccagtggtatatggtgccctagctgagtgagggggggaaaattgtaatggcagattctaagttaggattttgattcataatgtttaaactttgacactttttaataatgaattctaaatttaaagttttgattgcttgttgaaaagcatagttcaaacttgcaaattccatttttcttaatgcataccaacatttagtaaaatacctgtaggaatttcaatgaagattttagttagacaaaagctgtaaataaatattgttaaaaagaaatgggtagtatagttgagataatatctaatccatattaatacttatttttgagtttgaggtgtacttgtttttattaatacttagagaaaaaataattgtttgttggctgaaatgtttcatcttcacctgttggaatgtgtgtttgtgtgtaggttctgtaaataactatgcagtgaccaataaactgatgaaggagatggtataaacaaataaatgtcaaatctacatcaggtataagactacatgctgaattcaggtagtgtcatttgactattttaattaatcaattaactatttatttcaagtcaaccaaggattttgcaattaaaaaatacaggtactcaagggaaaaaaatgaaaggtcactcattagtaacaaaatttaatgaaggagacaataaaataactctggaacacaaacaagataaacactattgcagtaaacagaaggaagttatgatcatttattaaagtatagtacaatgtcatcacagctacagttaatacatatttttgagcatctactttagacaaagcaatgttccaagctcctgaaagatgaaaatacatacaatctttagtctcatccttcaaagtaagaaaatttataggcaaacgtttctgaagcaagaatcaaatagcagtgcaagataataagaagcactacaaaaaggtacaaacaaatccccagtctaggatgactgagggaacccttacataaaggaaagagtttaaaaattggcatgagcctgatgaatggaaaaaagagggaagaagatttcagaacaatgtgagcaaaatttcagatgcagcaaaatagaatcttgagaagaataaataaagcaaattagctagtagagtcatggactttagctaaggctaaagtgggaccacagtgagggtaatatctatttttttcagactcctaaattaatatcttcaacctgagcttcccatggaactccagattcacatatacaactgtatacttatgttctccacttaaatgtctaatagatgtctcaaatgtaacagacctgaaactgggcttctcaaattctcttgccaagcctgttctccagtagtcttccccatctcagttggtaacaactccaccctcccagttgatcaggtcaaaaagtgtgaatcatctttgacatctctctttctgtcacaccccacaatgcccaccccaaaggaaatgaagtggacagactgctccatggacctgacgggctgttgttgggataaccaccatgctcgtaactttcatcctgcaccaagcctcacctggagtgaagggagtcatagctctactctgccctgggcaatagtgccttctcttcatgcctttctgggtctcagagtgactaaagaggccataaagactgcttactttactcatttaatcaattcatggatcaatcatctaaacatttctcaataaaaccgtttagtagcttcgcttcccattcaggggaaatgtcactacaataagctgcaaaactcgccagggtctggactcctccgtgttctcctacttaacacctggttcactccattcctgccaagcctttagctgttcccccaacatgccaggcttgctctggcccatggctttgccctggctcttccctctatctggcattcccatcctcaccaccaccacaccatgctccatattgtttccttaccatatatggcaattgacgcaaattcaatattaggaagccttgtctagccactttatataaaggtgtaattaaaccatctccatatcacctgcagcaacttctagcaccattcctgtatttattttccttgttagcacttttgccactgaatcactgcataattgattgattgattgatttttattgattgtcttcctttctacaatgtaggcaagggttttttcctgttcccagaatggctacatccacagcagttagaacattcacagtcccaagtagaactcaaaaaatggagttgaatgaatgttgcatttgaaaggaatgaatccatgttaagaatatagataaatatgaagtttattcatgagctctggatttatcctctagataaatttctccaaactgtttattctctgcccatcatatttgtttcttttaaaatatatctccttaattgttatattagatttcacattgagaatgttatatcacataattcctgtttacggctgaaactttaattgttggaagtgcttaagtggacctgttatatttttaagatgacatagagggttgtcccttagttgaaaataaaggatgcttgctgcaggggctggaaagcatagagataacaacttctcattctatgagcaactcccgtgggggctgtgaaatcttagggcagagaaccactgaggtggcaaatcctgctctcactgaggaagcctgttagatggatggtgcttagtttgccaatgtgctgcttcattaattctctaaccatcgtgagggtgtgagggagactgctgaatgttttgaaaggagttttaattggaccttcagtcgatacagttttctaaaactaaaatttaaaaaaaacgtccccagtggatagggtcagtgacacataatctggaacaagaaggaacgatttctttgagttagtgtgttttagggaaacataccctatgattaaaagcaattctaaacttaaaaggtgaagcaggaaaggaaagcagccatttttttctcttgaccttagggtcttcaaccagtttctcattcacctgctcttacagatgcatcaacaatcaaaggtacagagctcagtctgaacctagcaggtaggatgcgaaaccttctcagtcatatcgtcatggtttgtttaagctaaacaatccatccaattttactttctttgtaagtctgcctaaattcaaaataattgatgggccattaattcaaatatgcaattggaattactagattctcaatttgatacctaacgtaaactacaagtttgtcattgcattaactcatgtctctttcctcatatgctcaagctttttatggaactaaaaatgattttcagcctctaaattctcccttcatatatattgattatatatcctagaatacggaaaattcttaaaaatgaaaactgaggcatatcaatcaacaacaaaaaacgtatttctggctgggcatggtggctcatgcctgtaattccaacactttgagaggccaaggagggtggatcacctgaggtcaggagtgcaagaccagcctaaccaacaaagtgaaaccccatctctactacaaatacaaaacttagccaggcgtggtggcaggcacctgtagtcccagctactcaggaggctgagacaggagaattgcttgaacccgggaagtggaggttgcagtgagacgagatcgccccactccactccagcctgggcaacagagcaagactccatctcaaaaaaaattttaaaaatgtgtttcctcctcaaggaagtgtatgttatctcaattatatgacacatattttaacagaaggtttttgagtaaaattcttgcagacagtctttgtatgaactctagatattcacagaaactagtacgtgcctttagaatttttaaagaaaaaattataatgctttcctccctgttgctctgcattcttaaaatcccagcctcctttatgtctgaattaatcagtgaaatataccaaaaaaaggtagtaaatacagctgttaataccaatttcacatctgtcataaccaattcagtgaaaacaaatctgtaacccccaaataaattccaaagtgattaaagtcataattgcaaattaaaactgtaaaataattaaaaggaactatgtgtgaatattaatttaattatagcatatagaaaacttctcaaagcataagtctaaaggcatagaattttaatctcctgtatgtcaaatttcattataaatatctaggaaggctaaaacaattcaggcaaggggacgatggtaatatatgtatgagaggtgtcataatttttgtattgttgatattcttaatccataaaacatttttgcaaatcaatagagaagaggaatatttcaataaaaaaacacaaacaatttgttaaaaatcaaaagccttgaaaatatgcatatatttaatctaataattccactaaggaatctaacctgaagaactaatcaaagataatacaaagcttttgttaaaagcaaatgcaattgtacctatgaaaaaaagttcattgaaacactacttaggatatcaaaagactaaaacagcttaaatttccaacaatcagagattgtaagttatggcatattcatactttgcaaagcagaacagtaaccctgcataaaatatccaacaacatggataatgtacataatgtattgctaaacaaaaaaaatggattatgtaatactataatgcaagttataatctggatcttcagcaaactattcagatcagctttttctagttagtgagttaatgattttccaagttttccacaataagcaagtattgtatttacaattagaaaagatgatatcttgtaaaacttgtagtactttataaccagcaaatattcttctaatgttaaataaagaacataacctcaagctcactattttttttttttttagaccgagtctcgctctgtcgcccaggctggagtgcagtggtgcaatctcggctcattgcaacctctgcttcctgggttcaagcaattctctgcttcagcctcctgagtaactgagattacaggcacccgccaccacgccaggctaatattttgtatttttagtagcaacggggtttcactatcttggccaggttggtcttgaactcctgacctcaggtgatccacctgcctcggcctcccaaaatgctgggattacaggcatgagccaccacacccagcaagctcacattgttattttaagcactgattacaataagatgatcagccctacccattcactaaggctgacataatattgtatgtgtgtgtgtgtttgtgattttattacgtgtatatacaatcttttttatttcttattaatataattaggctttgttccccacccaaatctcatcttgaattgtaatccccataatccccatgtgttaagagagagaccaggtggaggtaattgaatcatgggggtggtttcccccatgctgttctgacagtgaatgagttctcatgaaatctgatggttttataaggggctcttcccccttcactcggcacttctcctcctggccgccttgtgaagaaggtgccttatttccacttcaccttctgctgtgatcgtaagtttcctgaggcctctccagtcatgctgaactgtgagtcaactaaacctctttcctatataaattgcccagtctcaggcagttatttctagcagtgtaaaaccaaactaatacacttatattttgcaaattgaaattgtctttgaaggcaattttactttgcaaaattctttaaattgtgaacttctctaaaagaaaatgtgggtcaagaattcttatatgtgtcaagcgtttgtggcatattagtgattgtatatacccctaatgaatcatttatataccctgaaaatattttctgccctcttagcatgtaggggtgcagttcaaaacttgagatatttgattaccatgaatcttggtgcctgaggagaataagctagaaagagctttcctctttactgtctatagcaggaaccacttatatggtatctctctctaattccataattcctttcatcaaaaagatccctaaagtccattatgaagctaattaggagactcacttattttcaaaacccagtccctcttgtttgcccacagctaatatgtggcagcgaaaatgcaatttgatagtttcttgtttcagaaaggagtgaaagaataacttctctaattaaaaccactatgattttgtgggattttttctttaagtgggaggacagtgtaattacacagattggaatgcagccaaaacagtaaagtaaagttaactgcctgcaagtgaaataccacgcaagacattgcctatattagtaaattgttgtgggtggagtggaggtacatgaggatacacaggacactctctattggcctgtgaattgaatctaccactaaaaataagctaaataattattattatgaaatgtgataatcatactcatttttcccctatagtagactgagaataaatagactatcttagtcagtgtccataatttatgtaggcaatgctgcagaggatattattttgtgctggatttggactaaaactggtgtaggcaggtggaccatctatttttgtcagttgattaattggaagttggttctgagtcagtcaacggcatgactgtcacaagggcaaattggagtgtaagtttataggacaggcagcaattagtgtttccagatgttttacatggaatcaagtgaaaatacatggaaaaattaaagtagaagtaattacagtaccgatgagatgctgttaccatatttagagccataactaaaatgctaggtaaagtggtataggggctttacagaaacaaacataaatatgagatcaccaagttgattgtaggctttgctgctctgtaccattaatgctagcatgatggtgacagcaaattgtcttgtgagcagcatactataggacaggaaaacaaagcaatttgggtgctaagattggcatcataactgaaggccctgagaacaaatcttcgtcagttgttttatggagtttcatactgaaagattttttgaagaagcagatcctaggtgtggtggagatggagagatttcttaagttttcagaagtctatatgaatctattattaatttcaccagtactttttcatctttcctccccacccactctgctgtttcttgaatgtaagatatcatcaagctattccagttttttatggacggaagtgtttaactggcaaaagctgaggaaacaggaaagctgaaggaatatattttgagtagcatttattcaaaatataattattaaacacctactatgtgcaaatcattttatataacatagaaattgacaatgaacactcaataaatattgacttcatccttcttgtttactagcaaggatacattttctcagatacaaagatggtagaatatataagaacaaagattatcaaaaaatgtaatacaaaattctaagacaggaattcataacctgtgttccagaggcttgtttgggatttgggcctatgaccttattttaaaatgggtcattttgtactcacaaatgtatattttgcgtggtatgggtctctatcttggaggtaagttcatcatattttttcaagactcggtcacctcaaaaattcaaagaacaattggtttaagaaaaggaatgaacatgcctaataagtagagagcatgatgattagtacagacatttgctaacaacggctttgaaaatgtttaaacataacatatttattacctagttttagaatggcacagaaaaatttcaaggcaagagtaatatccataggaagcacttaacttctctaaaacggaaactgggtcactgaaatactgggaaggaaagaaggaaggtaaaaataacagttaagattcagtcaaggggcttgaaacttctgagacttcagagtgaggatttccataaatccacttcttcatgaaaacactgaaaaaattttcaaattaactttttcagaactctgaaaattagccaaatacatgtaacaatttgaggagtgttttatttattaaaaaaactgctgaacttgagtaagaacaagaaagtttatggctttttaacttgaccttaaacccttgcccctctccccagttttgagtagccttaaaaaacaacagtcttggagcactggagggggcagtccaattttggaactcctcaaatagtagcatccccagagtagcaccactatttaatctgtcttgaagctctctggaaaagctgtattcacagggcattgtcactatttgacctgattcagaaaccaaaagccctatctgcagggcattgttgaaagcaattacaacagcaattgtttaacatcacagatgacacagtaccagttggggtgaacaagagcctgaacaaaaacataaaaggaagacctgccaatgagatatccatagaggtctttgtaaagccctgacatattgtgagggatttagaagccacatgtataagtagggctgtgtgcatgctgaagaaagaccaaagagtgccccagtccctcatctctgactgatgttgagcccctgtaccaggaggaagtgaaggcaaaggcagaatttaaaacttcctgagcattactgaagttccccaacacacacaaagcctcttggcaaagggttgacttactggttcacagtattctaaaaaatatctgagcaatcactagctgaccacttagctaatcagagacttcagttgttgcccaatagagtaagtacagactttacagaattagccctagaaaatctctaaacaacaaacagcaacaataacaaaaatcaacaacaaaccctggggaaaacatctgactttcagatttgccacattttatgatttgcaatgtccaatttttaagagaaaaattgtggtgcatacacaggggaaaagaaattgtcaatagaaaatctgttacctgaggggacccagattttagacttactagacagactttaattaagctattataaatgtgtttaaagaactaacaggaatccttttcaaagaattaaaggacagtatgacaataattcacccaataaagattatcagtaaagaaacagaaattaggtcagttgctgtgactcacgcctgtaatcccagcactctgggaggccaaggtgggtggatcacgaggtcagcagtttgagaccagcctggccaagatggtgaaaccccatctttactaaaaatacaaaaattagccaggcacggtggtgggtgcctgtaatcccagctacttgggaagctgaggtaggagaatcacttgaacctgggaggcagaggttgcaatgagctgagatcatgccactgcattccagcctgggcaacagagcaagactctgtcccccaccaaaaaaaaaaaaaaaaaaaggaaacagaaattattttaaaaacacaaacagatattctggagctttaaagcataataactaaaacagaatatttgagtttactcaacagcatatttgagttggcaaaagaaagatcaaaagaaagaaaggttagtgaactttaagacaggtcaactgagattacctagtcagaagaatagaaagaaaaatgtatgaagacaaatgaatacagtctcagggacctgtgggacaccatcaagcatatcaacatacacattatgtgagctccagaaatagaaaatggagtgaacagggcagaaaaaatatttgaagaaaatcatagccataaactccccaaatttgatgaaacacataagataaagtcaaggagacccacacctagtcagactgtcaaaagacaaaggaaaactgttgtaatcaacaagagagaaaaaagactcatcctgaaaaaaaatttaatgagattaatggctgatttctcatcagaaatcagggaggcaaaaatacagtggaactaacattcaatatgttgaaagaacaatactgtcaaccaagaattctatattcagcaaaactatctttcaaaaatgaaggagagattgagatattttcaggtaaacagaaactgagagaatttgttactagcaaatcttccctgcaagatttactaaagggagattttcaaactgaaatgaaaatacactagacagtagctcagattcacgtgatgaaatacagagcctccagaaagataagtatacagtagtcttagttcattcagaatgctataataaaaataccacaaactgggtggcttaaacaacaagtatttgtttctcacagttctggagtctgggaattccaagatcaaggtgccaacaggttcagcatctggtagggtcccacttactagtttatagacagctatcttcttgctgtgtccttacatgacagaatggggtcagagagttgtctagggttcttttaaataaaggcattaataccattaatgtgggctccactctcataacctaatcacctcccaaaagccccacaccctaattctatcacattgggggtatttcaatatataaatgttaagaagacacaaacatttagtccagtgtaataggtaaatagaaaaagtttaactgtaattttatgtaactcttttcttctttcatatgatttaaaagacagttgcagcaattgttaaactgtgttgatgggtttataatgtacaaagatgtaatttctatgaaaataataatacaaagagatggggagagagtagagctatactggagtaaagtctcagtatattattaacttagcgttaatatgaactagattattttaaattaagttgttaagtatagttccagagcaaccactaagaaaatagctaaaaaattatagtaaaagaaacaacaaaataattaaaacggtacactagaaaatatctactgaatacaaaagagagtagttttggaagcatatagaaacaaagacataaaaactgtagagaagagctactataatggcaaatgtaaatcccaccttaaactctctaataaaaaggcaaatgatgtcagaaaagattttaaaagtgattcaactctacactgtctacaagagacacattttagattcaaagaaataaataggttgaaagtagaaaagatgaaaaatacactatacaaacagtaaccaaaattaaaaactgtgagaattaaaggaaaaatataaataatttaaaaattatagttggagaattcagtatctcactatcaaaaatagatagaacacctaagcaaaaggtcaacaaggaactagaagacttgagcaacactacaccaaccagccttaaacatctataagatactccattcaatgacagcagaatacacatttttctcaggtagacacagactattttacaagatagacaatatgctaagtcattagacaagcctcagtaaacttaaaagaatttaaatcatacaaaatatgttctctgaccacaagaaaataaaatcggaaaccaataacagagggaaatttgtggaattcacaaatatgtgaaaattaaaaaacacacttctaaataaccaatgggtcaaaggataaataacaagtgaaattttaaaatactttgaaatgaatgaaaatgagaatgtaacatactaaaacttacaagatatagctaaaatagtgcttagagagaaatttacatctgtgaatgtctattattacaaaacaaagatcttaaaacaatagcctaatcttccaccttaagaacctagaaaaaggagagcaaactaaacctaaagcaagcaaaaagaaggaaattatttcaaaagttagagtaaatgtaaatgaaatggagaattaaaaaaacagagaaaaatcaaagaaaccaaacttggtttttttgaaaagatcaacaaaatgtataaactgaagctagactgaccaagaaatagagcatactcagattactgaaatcaggaatgaaaaaggagacagccctattgtccttataaaagcaaggataagaaaatacactattatagtatatattcttaaaagaaaatacactattatattcttataagaaaatacactattaacaaccccataccaacaaagtggataacttagatgaaaccgataaatttctagaaaaacacaaaataccgaaggtaactaaacaataatggaaactgaatagacctatagcaagtaaaacaattaaattagtaatttaagatattccagtaattaaaaatttccaggcccaatggctttatgatgaattctaccaaacatttatgggagaaataaaaccagttctacacactttacacacacacttctgaaaaatagaagctaagagaacactttctaaatcattccatgaagccagtaataccataataccaaaaccaaataaagatactacaagagtaagaagctacagaaggggagaaaatatgcacaaatcatatatctgagaaagaatctgtatcttgaatatgtaaaagacttaataactcagtaacaaaaagacaaccgtagacaatggattttgatagacatttttcgaaagaagatataaattattaataagcaaataaaaagatactcaaaagcatttgtcagtggagaaatgcaaatcaaaattacaatgagatacaactttatacccactggggacagctatgataaagaaaaatagacaattaaaagccctggtaataaagtagagaatttagaaccctcatacattgctggtgagaaggtaaaatagtatggccacttcagaaaatagtctggcattatctctattcaaaagaaataaaatcatatgacccacacaaaaattgtacagaatattcacagcatatttttcaaaatggtcaaaatcgggaccaatcaaagatgaatggagaggaccaggtgcgctggctcatgcctgtaatcccagcactttggaggcagagatgagtggatcaccttaggtcaggagttcaagaccagccttgccaacatggtgaaacccctgtctctactaaaaatacaaaaaaaaaaaaaaaattacctgggcatgggggcgcacacctgtaattccagctgctagggaagctgaagcaggagaacggcttgaacacaggaggtggagattgcagtgagcccagatcgtgccattgcactccagcctaggtgacagagaaaagctccatctcaaaaaaaaaaaaaaaaaaaaaagatgaatggagagacaaatatgatttggtatatataatggaatatcatttggcaataaaaaatgaattactgatgcatgctcaacatgtatcaaccttgaaaatacaatgtgtcaaggatgccaatcacaaaagtacttatgttatataattcaatttatatgaaataggcaaatttatacaaaccaaaaataaattaatggttgcctagatctgagaggctgaaagaaatgggggatgactggtaatgtaggtaaggtttctttttggggtgatgaaaatattctaaaattaggttgtagtggtggttgcacaacccaggtaatatcctaaaatccactttagtatgtcatttaaagtaattgtgcacttaaaatgaataaatttcatgtaatgtggattatatcttaaaacaactggttttaatttttttaagccaatgaagaaatgaagtgctagtttttatgtttattgcttccatgagaatattatcatctagaataacatgtaatgtattgagtatcaaactccagcatatcacctaataatcacttggccttaaacaagttacttgaatgttctcagatcctggaattttcacttaaaaatggaggaaataatacatcacaggggttttgagagaatgtattaagtaatggcacactttagatccctaatgaatattaatttccttcattccttccatcaggggccatacactcaagagaaaaataatagtcagggacaattcttaaattacgaatagggaattcaataaatacaacaaaccaaagattatatataaattttatgtttttgccaatggaggggaaagataactaaatgaggcaaggagaagaagaaaaggtggatagggaaactgcacgaaaagagagagagaagtcagatgaacaagcacaatgaaatagactcaaagaataacaacttatgtaattttaaaagacatattgggccaaattaaatggtatttggatcattctaattaaaattaaaaccaggctacatttgcttgttcagaaaaattcatctaaaggtggaattttgctagtggcccacagggctttatatctcaatttggtttggaatctgatgaggtgattaagtagaaaaccatagaaacataaatgtcaccaatagaactaagcaaatacgtaacctctactgcactatcaaattttttcttgcactaaaaatttaaagcttttttattgacttttcattgtattaattgtatgctaaagaaacttagaccaaaatatactttcatttgaatgagtttcaatcactggtcttagaaagaacattcaataatatttgataggattttaccgctgtgaatggattttttaaagaaggagacatactatatagaatagcagtataaaagaatataatcactgaaagactaatttgtagttttgaagacatagcataataaagttcttacaatataataacctagtacatcataggctgataccatactagacagtacatcgcaggctgaatactgttctttcatgagatttatctttgaaaataaaagtcatctagtttctacaattaattaatcgtgtatccttacagtttatattagctaaatattctcagaatacaatttttaagattcttgttttatctacatcgcaaagtttattcttcagtttttgcattttcagttgcattaatattatttgaatgtgggatagataggatatgttttaaattcttgctattaagcattgatattggggcttaataatggtttctctcaatgtcctactcagagcaatttaagtcacataatcccgaccagaagcgtatctccatggttgttttctatatccctagtacagcagtgataaagccatgaatgctgaatgtgccgtgttttttcagccaacaatgggcaaatgacatttctaaagctatgtatcagttcctacttctcatcattaatcccctgtcccttccaaacctcaactgttgctttaaaaaaaattaagaagacaacaataatctcttaatgacaccctgcagcagctttatggtggaaagggaaaggggtcatgtttactggcacatattttctttgagtgttttctccctttcgcagctcccatggaaaatttgctaacatatgtacttgcttttgttaatggcaatagtagatttaatgtgtttaattccctgctcccttttcttcctctaagtggaaaagacctctcaagcagtgtttatgtttcaccttcaaagttttagctggaaaaatgtttttccgtatttaatgaaagtttggtgactttctaaatttaagcaatttttaaactctgagtttaaaattcccccatctctaaaatagagatatacctaacaataatagccttttgtggaagattatctgagcaaaataaattagaaacatctaacaatatttcttattatttttataatcttcattctgagcccagattctctagcaaacagagaccaagataaaagcttattggccattattttattcaagagtataatttcagggaagtaggaggaaggaaaaagagagatggcatccaaaaagtgagaaatatatatatatatatatttatatttatatatatgggattgcaaagcctgacgcatcttggtaccaagcaaactgcagacatttttgacaatcttaagctaaagcctagatgaatcactgcatctcagggcaatccatttggggaaataaacagaaggattgatctgctagttcccatctccttaagttcaaagattcacctcgagggacattaacttccccacacttccaggtggcaagtgcctggattctgagatccctggaatctgacatctcaataccaacagggaggccctggaacaggagggaagaatttcaaagcacaggctgtggagacagaatttctgtcagaattgtccatctcgacttctcagagcccatgctggtcacaccgcagtaacagggccctccaagacaggtgaggctgaaagaatggggcaggcacagagaattatctgattcactctcctttaaaacaaaaggcaatatattcatttgtcaagtgacaggaagtcttttgaatcaatgtattcttgttctgtttgggagttaaaggcagtataaagaagcttgattataatcacttacaaaaacctatgaaaaccagattttttaagatgttgcaactaagtacaacttctggcttttattataagtctttttagaattgtatttttaattgacaaataattgtacatatttatggggtacagcgttatggtttgatacacatatacattgtagaatagtcaaatcaggctatttaatgcattcatcactgcacacacttatcatttctttgtggtgagaacattaaaattcactcttttagcaattttaaaatatacaatacaatattattaacaataatcaccacactgtgcaatagatcagcagatcttattcctcctgcctaactgaagcttcgtgttctttgaccaacatctcccctttccttgtccactccaaccatatcccacagcacctgggaaccactactctgctctacttctgagtttgacttctttttgattccacatgtaagtgtgatcacatagtaattgtttatctgtacctggcttacttcactaaaaataaagtcctccatatctatccatgttgtcacaaatggcagaactttcttcttttttaagaccaaatagtattccattgcatatatataccatgttttaaaaaatctatttgtctattgatggatgcactctgttcccctttcttggctatcatgactaatgctgcagggaacatgggaattttacagcgttggcttttttatcaacataaatgacttaatgttgatgataaaaaacaatgctgtaaaatatttgaagaggttgattctaagccaaatatgagaaccagggcttatgatacagcctcgggacatcttgagaacatgtgcccaaggtgattgggttacaccttaattttaaacatgttaggggcacagaagctacaggcaaagacataaatcaacatatgcaaaacatgcattgttttggcctagaaaagtgggacatctcaaagcaagagcttccaggtcataggtggattcaaagattttccgagtggcaattagttcaaagagttaaggtttgctggtaaatatctcttattagatcttaaaaggtgtcagactctctggaaaagacctaataagggaaagagatgctctatagaatgtaaatttcccctacaagagatggctttgcaaaatcacttcaaaatacgtcaaagaaatctattttggggtaaaatactttgatttccttcagagtctgctgtcatgtgatgctatgccaaagtcagggtagaattgggcatcttatttccacacagagtctgtttttcagtcttatgatctctattttaatattaatgctagtcagttgtccctaaacacaaaagataggagagtataataaggcatgtaagacttcccttccagtcatggcctgaactagattttaagttttctttgggatcctcttggccaagggggaggaggtccattcagttggttgggggccagggagctagaattttatttttgatttacaatgctgatttcaattcctttgaatatgtacctagtagtgggattgctggattattataaatttttatgtgtattacaattttgttaattaggtcactgtcttagttagtttgaactgccataacaaaataccatagactgggtggcttaaacaacagaaatgtgttttctcatagttctggaggatggaaaagctaagatcgaggttctggctgatttgattgctagccagagctctcatcctagctggtagtcagccaccttctctctgaattctcacatggcagagatagagacttctctctctcttccttttcttataaggccaccaattttatcaaattaggaaccctccactttataacccttttgactttaattatctccttaaagtcctgtctccaaatgccgttacattgggggttagggcttcaacatatgaatttgagaggaacacaatttagtccacagcatttgcatatcacagaaaacaaatccatagaaatgttaatacaataaagaatttgagtggtttaaaacctttttatttttgtgaatgctacaattaaaatatttctgcgtgcaaaaaattgtgagtttttcttgtatagagtaaaattttctgatcttaaaagcaagacctatgacaagtagaaaatattaatgaacgctgaaagcattatatccttgtcattttcagataagaaaactgtagttagtgatgcttttcaaaattgttacatttgtgaaccagcaaatgtatgcacacaggattatctgagcctaaacatagtgtcataaccttaaattgaataagttagattaaattatttttaccagaaaatttatggctgatttccatacaataatccatttagtcaattcaacaatttacagggctgaaaatatttattgtaacttgaaattcattttatttcaagcaattaaatcacccagaatcctccagatacaaagtgtgttaaatgtaacctttaaaatgaatgaatgagctgaagacaataagggaagtccagggagcagaggaaaaggcaagagcagggtaccaaggagaagtataacgttgatgcttcctcacaacttgagggcaactacggattcagacacctggagtttgatgccagcacaaagcaggaaatcggactggagatcaagtcatacacagctgggacccagaaaggtatacacttggccttggagaggaaggaggttaggagagagtgacttacaagaaaacatgacctgcagtgataaagagtatagaaggatagatgcagccgggcatgttggctcacacctgtaatcccagcactttgggaggccaaggtgggcagatctgaggtcaggagatcgagaccatcctggctaacatggtgaaaccccatctctactaaaaatacaaaaagtagtcagccatggtggcatgtgcctgttgtcccagctactcaggaggctgaggcaggtgaatcccttgaacctgggaggtggaggttgcagtgagcagagatcgcactactgcactccagcctgggtgacagagcaagactccatctcaaaaaaaaaaaaaaaaaaaaaagaagaagaagaaggacagatgctagatagatagatagatgatagatagattaaaaaagagatatagagataaaggtatatttctcagccttggttctgggtggaggtttaaaaataatatttccttgagattttgtaaatgtaaactaagtcatatttagggttatggagccagaaatcacactaacagtagagttcacaaagctgcagagaatattttgtttgtgatgaatctagatctttctagcacccaaagagatatatcccccactcaagtcatccagaactcacaaatatgaactcaagctcaaagacacacaaaaaaataaggaaacaagcctcaaagtgctggagtctacagaaacaacaaggaacataaccagttgcatgagatttcagatatttgccttatcagatgcataattaaaataagaataaatgaatagatgttgtatttaaataaagaagaaataaagaggctaccaaaactgatcactcatatttgaaaaagaacaaaaaataacttctacttctgagaaattttaatgaataatattaaatggagcagttaaccagtagaatacaactgacaaaaagattatgaaataaatataaacaaatatgcatatacatatacatatatctgataacctgaagtatatttattgatatatatattaccttatatgtatgcatgtgtgtatcatgttgaactatatgaaattgccatgttgtatggcaaaaacagtcacatataggcaatttcatatggttaagcctatatatgcatattggattgaagatgcactgtataatataggttttccatataaaggtgaaaaaatattcttttgctctaagaattctcagagttctgtcccacagcagatagcctacatgagagtaatttttttatcagaattgtggaattcacacacaggtcatatgcttagttctgctcatgataatgatgctcaatagttaattggctttgtcaggcactcgtctatatcttcccaccttcctctccaacagtcaagtttctagacccaaggctcttgtttctccaaaactgcttgcagaaatagctatgccttctttgccatttattttaggtcaccacttattagtgacatctgatattagattcttgtgagatgaagattggagactggcttaagtatctgtcaggaagcttctctattttcagattatattgcatacaaaaaccttgcaagccaaatctgtttcagaattaaaataacatgagcaacctcaagaaaaattattccatgtgtgcacacgtatcaagaaaaacactgcttccatcatgccaccccacttcattgcttgcagggatcattgaaattcatttactcagtgatcagaatctcctgaaccctgcctccagacctcatttccaaacatacaccctaacctccaaaacaaatttggtctttagccttgtccaataaaaatagttattgttaaaagtccaaactctttaacatgctattttttaaaagcccggggttggggaggggggtgggtaagggatctccttactccacagaacttctaatttcccagacaatcagttgttcaagaacacaatgccattcctcatgctttctttgcctataagctgttctcacccacttggtgaaatctacttcccccttcataggtcaacccctcagtgaagtcctccttgatgtcttcagcagcatttaatggtttttcctctatgtccccttagtactttcttcatatctctacttgtctctcccactagactgtaaattcacttttgtcaggaccatgccatctgagtaccccagtgtctaaaacataacctggtactatatatttctgctgaataaatgaattaaaaaacaaatgagtgcaagttatttaaatcagaggaatcatgatagaaacattaatattttaatatgtaacagaccacaagaatgttaaaagagtggtcttcaaactcaaaagtgtatcttcccaatgacaccagccttagaagaacagtttctgtgttactattgtcatgctggaattcaaagggtttttcttggttcttatagagactagagcagtacatctccaaggctaattattcttctgatctcatggtttgatttatgtgaattgtgacaccctataaggaaagtaaaaagagatccacctagttataaacaatgctcattatagaacaacctccagccgagccaatgcagaaggcctcagggaatactaaaaaaaagatagtggattttttttccttgcaagcacaaaatattttttaaccataaaaagcaatgtgcaggtttgtcatcctggtgaaaggatgattaatttccatcgtgttagaatataacatacggattaccctagaaagttttaaattttaccaaaaaaaaatcaaggaaaaaatgtaaattgcagaatgattattgcatataaattttatatacttcttttagataatatagaagagatagccactcacccaccctgagttttactgtacaattctgtttttttaattgaaactgcactgaagcttttttcttcccgtgttttaaactgtgctgaaattataagatttgaaaagcctttgttaatagctagagagtcctgccattaccgaatgccaagagaataatgaaacacctaaaatgataaggcactagtgtctgagcagaatagacctttaattggaaaaagttcatgcattaatattcaacattaagtggtgattaatagatacaccatgtgggtattttttattttaggaggatagataacagcatgtccaattttaatgtaaatctagtgacaatttcagtgtgttattctaaaatgctctatctgattagtttcagaggcgtaaaaagaaaatcttttctagtgagcacatcctccgtaagtgttaacagcaaagctccttaaaataattttgttctctgaaattgttgccatagctagctggaagagtttcatgtttaataaccacatgtgatatctggttttttttaaatgaaatccgcataaagtgttcattttttctccattctagaaaaaaaaaatctactcttattgacctctttccttactctcactgactgatcaaggaaaaaggttttattttctctgtctttttatctattttgatggtatttttttttccaacgtgattgtgccagtgcactccagactggatgacagagcaagaccctgtctcgaaaataaataaagaatttttttttttttttttgagacagagtctcactctgtcacccaggctggagtgcagtggcgcgatctcggctcactgcaagctctgcctcccaggttcacgccattctcctgcctcagcctcccgagtagctgggactacaggcgcccgccaccatgcctggctaattttgtttttgtatttttagtagagacggggtttcactgtgttagccaggatggtctcgatctccttacctcatgatccgcccgtctcaggctcccaaaatgctgggattacaggcgagagacaccacacctggcctctccagggaatctttaaatagccaggtaataagaattctcagagtgaatagtacactgaatgtgaaagtgaagaatgacatccaggataacttttctctctttgtattcagggggctcagtctattaataaagagattttgtctaaccatgttccccacatattgctgtcaatagagtaaattgctgttatccatttaatgtgataagctcattatttctcacagcttcatctatcacccaatcccatcctttcaccttaaatctagacttctaatgccaaacaccttctggatagaatttgtgtttaactccacatctgaggttaaattttaatctacccaacgaatgtaggtttccttccaacattgcctgtttcttattaacacaatcagttagttaccctggctcaagaaattgagaagaaaattggacttatttgatccttcacttcatgtttctagagtctccaaatgaaagtttccttaaaaaactttttcaagccttgttttaatctagatcccacaccaaagcagaacaagagaccaagtcttatataaagttagtttatttgagaatataattatagagaacatacatgagaggcagcagttttgaccagggaaggagaaaaaaaaattcaaatcatgctattgatgagcttccccaagagcaagtgttgctcaatctcacaggattttctggggagccttatgaaataagtttgagaactaatagcttagggacaacaggggaaagcatttatccattggtccccatccccattacttaaggttggaatttaagtaatgcacttctgcttgtgcatgaatgaaggccaaatgtggtcccatggtgtattagtctgttttcatgctgctgataaagacataccagagactggataatttataaggaaaaagaaatttaataaactcacaattctgtgtggccggggaggcttcacaatcatggaggaaggtgaaaggcacatctcaaatggcggcagagaagagaagacagcttgtgcagggaaagtcccctttataaaaccatcagatctcatgaggcttattcactatcacgagaatagcatgggaaagacctgccacctcccagtgggtccctcccacaacacgcgggaattatgggagctacaattcaagataagatttgggtggagacacagccaaaccatatcacatgggtatcccacaccatggtaccagagaagtctcgtggcagaaaataagaattatatggtctaggcccaaagtgagataccataaggctggactggggcaaagctaattgaaacatttattggaacttattagcacagcagtggctgggtaagagatggtctgagaggataagaaatggccaatataccctgtcttagtctgctcaggctactataacaaaatgccatagactgagtgatttaaacaacagcaatttatttctcacaagcatgaagtctgggaagtccaaggtcaaggtgccagaccattcagttcctggtaagggtccttttgctggttttcagacagctgtcttcttgctatatactcacatggtgggataaaatgagagtaagctatccagtctcttcttatgaggacactaattccatcaacgaaaaccctacccttatgaccttatctaaagtaccttctaaaggccccagttccaataccattacattgggggctagagttcaacaaggaactgtgggaggatgtaaacattcagtctataacacagcccatcccttgcaccattcagatccaaaatgccttttataaagtgcaagcaatcatagagttccccttcaagttcatttaagtcacaatctctgaaaaggtttagtaccagttattattggaacaaattccagtcttcactattgcagccaatttcaaggtcataattcatatttataatctcccttctttactgtttattctattcatttccctcaccatttgtaacactttggctggcctagggttctttgctagttggacccagacttttacacttgagagatcccagctcttagttgagctgcatttgttatatttgtccactcacattttccctagacctggaaacacagatattcacccctcatgaacactgcgattccacacacactccttcatgtccccattgcatctcaccaatcctagcacttcgtagaaattagggtcagtccctctcttagaatagtcattactcaccttggctaccgcaatggcatgggcagcctaaagtgaccaagtggtagctgtagtttcaacttaaagtgagacagagtaaaggttccactttgtcttctggtcaaaacaatctctttctagaaattaacaccatgaatcctgcaaaacctgtttgtggggatggggagcacagatttcacaagtgggtcactgggaatgatagtgagatgagccaattctacttttgccccttggttctgggaccaatgtattttagctactccagacagcaccatataacagccatcgactgagtgcatgtatcacatccaagagaacagcaacccaacccataaggtattatacccaagtttttgtcttcactggggcctctagtaaccattcaattattctggttctaaatgatgagatatagacagacaagtgggctgtgtgtttatatgcccattcttcagtcttctgtatcataaaactagtctcctagactgagaaaatttagtgtaagaaaccatacaaatatatgtatcagatgtcttataagccctaggacaataatgatattagcagtgaccccagaggaagaaaaggcaaatccgtatgagaaggtgtcaattcatgagaggattaatttctgctcctccagggaaactgagtctaatataatcaacctgccaccaactggctatagccatattcttgaagaatggtgttacaatgagggcttagcatcattttgtgtgctggctagttggcagtagttagataagctttaaagaaggggagcccaggccaggcatggtggctcatccctataatcccagcactttgggaggccaagatgggtggatgatttgagatgaagagttcgagaccagactgaccaatatggtgaaactccatctctactaaaaatacaaaaattagccgggcatagtggcgcacacctgtaatcccagctacttgggaggctgaggtgggagaattgcttgaacctcggaggcggaggtttccatgtgctaagatggagccactgcactccagcttgggtgacagagtgagaccctgtctcaaaaaaaaaaaaaaaaaaaaaagaagaaaaaagaaggggagccctgctgtagaacctgcatagatatctccctattattgtagtcactctgttcatggccccatcctgctagcactggggttgttaaaggaagaggcttgctgacatccacaggacaaatcttatgtatctggttaatgagtgcctcttgtgaggtagatgctccctgatgggcattaaaatgagacacaaatgaacactttgtggtcactttcatagatccaattgcatgtatctttctatgattttgttgtttatttctaattgtctttctttggagtcttaaccaactagccaaaccattaactgcccagaagcccaaaactcagatcatgttttcttgcatgcagagcgaactccctattgttatctttgaagttctgccttccacatgttttcttggagccatccttggatgaacctatagtgtaatgattaaccagtaaaactaacatgaaaaaaaaaatcacaccaacatgtctatgaatcaggctcaaatttctgattcctttgtcatttagtcacagggaagcaaatgatgccatagctatgagtggtgggtaagagactggtacctcacagataccttaggagttttcccacctgtttgtataatttactacatcttctggaacttctcaggcccaatattgaatagcacattcataatggatcattgctcttcctgctcaactttatgacatagtagattcgataatatccagctcagtcccatagtcaatttgtgttccaagattgtgcatgcagcctctaccagaattcagtatcatgtcaggtcaggaattatttttcaaatgttccataattctctgttatagaatgaatggccttgctctagtacactaggattttttttttttttttctgagagtcttctgtttaagtttgtcttctgcaacatacaggcaacttgccaggacatctaaaatcctacccagttcttcctaatcatgtcaaattaccatttatgtcactgtcttagtcagctttctgttgctatgactgaatacctgggactgggttatatatgaagaaaagaaatctatttcttacaattttagaagctaggaagtccaatatcaagagatcccatcttgtgaaggccttcttgcaggtgaagggggactctgcagagcccagaggctatgcagggcatcacatggcaaggaggcttaagaaagagggcctatctggctttttataacagatccgctcttgtgacaaccaaccaactcctgtgataacccaatgatctattaattcattaatatattaagccatgaatggactaatacattcatgaggccagagccctgatgacccaatcatctcttaaaagccccacctcccaatactgttacattggagattatgtttcaatatgagtttcagagggcacaaacactcaaaccacagccaacatagtgagccaacaggatgtgtttcagaatattaaaatgatgaaagtcccaaagactgtttagtgacagaaagcaggagatttaacatagctctgagataaagcaataaatgtatattattcttcatctgtgtaagagtaatctgctttatttctcttactgagagggactgagggatcacatccaccaaaccagtagtgccaagcagcggcataccaagtgccagaggctgagttgatccattcttgaaaagatactaccttcaacttgtaatttgtataatcatttagttactttttagagttcattgtcatatgccccgatctattggttttattcataggctgaacaagaattaattagtgttatgaggggactaataacttatgcaagtcttaagtatttaatagctgtgttaacctctgaaattccttttgccatgcagtacgatttctgattaccatctttgctgaaatgggacaaggtggggatgcagattaaggagattttacttggcctttccaaatataatggctgctgcttcataatcaggtagtcagtgtaaggttcttccgtctatagagtatatttatccaaattatatatttaggtacctagggaattaactacagggcttgtctagtttctgtaagatttatttgagatagacttcaacccaaactctacttatcaactgaagacaacacaggaatgaaagaaatcccacctaacagaacagatgagaactctagtaacactactatttaaaaaggcggcaaagaaaaacactcagcaaaagggacagaggaagagagatcagaacagagaatgaatgagagtaatatgcaacaaacctaggaaagaaaatattttaaagagaaagaagtgctcaccaatgtgaaataccactgagtatcacaatgggataaagaatgaaatgaggcaaatagttgtggaaaacaggaagacattattttcctttgctagagcagttgaagcagaagagcaggagcagatgtaggatcacggcagggtgagaagtgtctggaaactgaggaaatgtaggcaatcgagtttaaatatttcagtaatttggcccttggaaagaggaagggtgaggggatgatggcttgaagaggaggaagaaacaaagcaaggtttttgtggttgttcctgctgctgttgtttaggattgggatggtattaatatgtcttaatcagatcacaaacataagtcaaaatataagagagttcacagagattcttctttatcccaaaagtctccattcttctaattagaagaatgttaatgataaaaaaaaaatcttcctatagtctctttcttgtattagaatcattggtctcttatattggctgttttcatgtcctatatcttaattttattttcttattgctggtggcttaatgtagtaaattttgcaaaactattaaattctagactacagcatgagagaagaaaggaatagtcacaattacctggcctaaattgaagctgttcaaatttgaattattattgcttttgaggagacagcagcctatttcagtttattgttccttaatatatgacagcactggacaattaaagatcacacacacacacacacacacacacacacactgatgatggaaactcttgtattgcaaaatgggatattctggtgtgccagaaaagattgattaagcaatgaacctcagacaaagtgtatggttgtttccaaataatcaggcctttgggattattaaggttataaatgaaagtaggtgtctaatttctgatgaatgcatttaccactgtgaacacagatcaccagtgtgcacaagcatacatctgtgtgtgtagtacactgtttttagaagatcccatattctatagaagttaatttcctttattgctttttattcatagagtgactctgaatgtgttctcatagaaataaatctgaatatatgtgatgtgtgttgtgaagatgtgtgtgaattcatacagaaatacgtaggttcaggtataaatgaacatatttgggcatatatatttgtgtttgcatgtgaaaattaaggtttagtgacaagtgctgaactcaattgtgttgcacttgtgtctttaaatataataaaacattttcttttaaatgttggaaaataattattaggcatgtatcattaactgataaaaacataaatttcttaagaaatgctatagccttaaaagttactaaattacaaaaaaaattaaattggagttattgaaaaaaaattgctctaactcagccctcttttatagtaaagtattaactataaaacatgtgaatccaaaatattattcttaaattgatgtgatattaatgtatgtttaggaaaaatcaaaagggaattcttcattgaacaaggaatctagtaacagcacttcatagagccacatcaggcacctacaggctcattctctattaagtttttcatctaacataggctcgctcttcaacactgtatggacttttatgattctatagaggaagaaaataaaatggaagtcaaggaagcatttttattaggccatttactcctcttaatatagtctttccctttgagcatttacaataaaaatggacttaatcttttgccttcccatgggaagtctaacaaaaaatggaattgtagaaagaccacatatatcaaagtatttttagaaactgctctttcaggaagtggctaagttctatggctgatataattaagtcaatctcagggagcttcaccattttttgacacccagaagcttagctttagcatgagttggaattttttttcttttcttataatgcgccactaaattctaagaccattagataattgtcctcaatagaaagttcctgtaatacattgaaatcatataatattttagccactggcatatcataaaaatttataacccaaagactacatttatttctaattatatttgctttccttagccaccaagatctaagtaacagataatatttatatttctaacaactgtgttttatttatgcaagcgaagaacagaaataagctttcattaagaaacaactatgtgcctgccactgtgaaatatgctttcacatatatttctgactccttgcaataaccctaaaagattaatatcattaactcattttatagacaatacaaccgagaagttagattcagatccagatctttctgattgaaaagcccctactttggactgacagagagaatgaagacttacttcagtttgattgtcttgaatgggcttcagttattcactgttctccaagccagccacacttgcctgaaattggatttcacaggttcattttacctccaactgagaatatggacatccacaaccctcagtgctggcccgtggaagtctcaatgacccacaaggcatagggtttgtggctttggtcctggttcatgtatccatcaaccaaccattattgagcacctagtattttaggggctaggaagaaaacagaaaaagtttcagcctttgtggatcttacattctatcagttctatgtgtttaggtgtagggagatatagataaatgcataaataagtctctgaatactctttgaccaacatcaccaaaaccatacctgcttaaggacttaaatctttttaaggtaggccttatggaagttggggatatgcattattatagcaatggattaccatctgccttgacccatctacaaaccaccccagtttgtagttaccctgaataatttaagagtcaaaggaataaaccccaagtcaaaaccagtgtccccaaaacaggggcatgaggcgaggcaagggttaattgttgctcccaacacagtgctgctcccatctttaatgtgaagataaatatgagagcgaaaaggagaaatctaaagtggtcgtgatgggtctgatttaagtgaatgggagccacttcaaatgctaacaacatcattaggagcacataaataggctgctcattgtgtcggtaaaagcggttgttcacagcagcacaatattgtttgaatgttcgaaacaatctcttaatataactccccaccaatttttgttttggtttagtgtttttaaatcatagttctttggcaccctgaagaaagtcttgttcccatgtgcatttttactttctctcgttatgttttgtctttgaccttctgagcgcagtggagaaaacagacgtgttccaattccagggctactatttatatgctagctatagctatactttttccaaaaaaaaaaaaaacaactctccgaatcttggcttttaggaagttcatttttactatatgaacaataacgcctaccacagagtgttttgagaatcaaatgaaacttaacttgcctaaatgcctaagtaggcatctggtaaatttagctaaatccctggaatatctgttcggtttcaacaccatatgaatgtaatattttacagaaactctttttttttttattttgcgcctgattcaagtagatcttcaatgaatatttatgaattaaatattttcaacataatgcacataatgaaagtaactatgtacaacttgatggttgtcatatttggggcatatcaaatcattgtaccatgagtgtattaattcaggatcaaaacccagttttcttagtactttttctctttagagtgcggctcaacactagaagagctctttaaacatcagagctgctccacaatggaatgaattggatagttaggggtaaactccacatttctgcacatattaacaaaaaggctgaatgaacacctatcaagaaggtggtcggacaggatttccaaattagttgaaattggccccaaatgacttccaagttgtcccctctcaatgatctcataatactaaatacatagtgtttcatttagatgcaagtaagaaaaaagaagctttgatttcctattgcatatttcacaggggtactttgagcactactccattccaaattccctttatagaaaataataatccctcacaataaaattccctgccaaggcactattctgagctttttacatatattaacatatgtagttctcacaaaaaccctaagaggtatgtactggtggtattgctctgtcacacataaagaaagtgaggcacagaaaagctaaattacttgccccaggtaaagtaaaaaagtaattgttggagctaggagttgaatccaggcagtccagctctgaagcccactagcatgcagtaccaagggcctcacataataaaatctggcttctcatagatccagactttgtcccactaatctagaagcactttgaaggcaggggccatttctgttttcatttactactgcacctacagtacctgacatataatcgttaattaatgaataattttgtttcatgtataaagattatcacttatttttcatatcttgtgtcatagaaaaacatattgcttagctttcataccaaggtattatttactatttagaggtaagaagtgtttcagaaatatttgtactgcattcagaatcaaaagacctttggcccggcacagtggctctcacctgtaatcccagcactttgggaggctgagacaggtggatcacttgaggtcaggggttcgagaccaacctggccaacatggtgaaacctcatctctactaaaaatacaaaaattagacgggcgtgttggcgcatacctgtaatcccagttactcaggaggctgaggcaggagaatcgcttgaacccaggaggtggaggttgcagtgagcccagattgcactagtgcactccagcctgggtgacagagcaagactcttgtctcaaaaaaaaaaaaaaaaaaagagccaggttcgagggttcaagcgattctcctgcctcagcctcctgagtagctgggattacagacatgcgccaccacgcccagctagttttgtatttttagtagagacagggtttcaccatgttggccatggctattcttgaactcctgacctcaggtgatccacccgccttggcctcccaacgtgctgagattacaggtgtgagccactgtgccaatgtgccccattttcttaggctaaagcctgaagtcctaaacaagacctacaaaaccctgtgtgatgaaacccccagcagcctcacctgctgcaccttgtaccgctgtgcctattgttccctgcctttagtcaatctcaccgtcatttcttcttcatgcctgtgtcattcccatgtcagtggctctgcatgccattccgttggcctagaacatgctctcctttccccactgccatccttacctagttcattcctactccacaaaagctactctctgacaaagacacagtctccaactcctccaactgaggcaccttgcatcatgacaggctttcatcatattctatacatttccattgtgcaaagtaccaatattttaattagcttattcagtttcttattcatttgttcaacagattcttgtaaatgagcacctattttacactgggtacttttctagtcacaaaatatagccatgaacaaaatataccaaaactcctaccttcatgtatcttccattctagtgagtaacactaagtatcctcactaaaatataagttacatatagtctgtgactatttctgtcttattcactgatgcatcccctagcacctagcacgaattgttgcttatggtatatttcagcaaaaatagcttgggtaatgatagggaaacaaagaatcttaacattttagtggcttaaagcaatgaagtgttttcgcttttttgttttgtaagtcattctatatgcccatcaggttgactgggaatgcttcctatatgcccatcaggttgactgggaatgcttcctatcttgccacagtcattcagaaacatgggccagtggtacagacattatctcaaatattgccagtcatgacagaagagagagaaaactattcagagatttaaccagtagttaaatgactccccagggttttagccagaagttaaatactccagcttagacatgtgcaagacacttccacttacgaatcactgctaaaaactagtcatctccccatatgcaactataagtgactgcaaggaaaagccatattttaattgacagctgtactactggctatctcagatggaaaacaagaaatatttgaggaaaagaagactgaataacaatgaacagtagttgtgatatagataaaagccctacctctttgtctaaaatatacctgttcataggatgtgcatagcatggatagattaggctaatgataacataagtttgcattctttcagcttacaaagtctactgatagtttgattaaacacaaccaagaatgacaaatttgctatccacaacatatggagtagacatcctacagacaaataactgagaattcacagtatattaaaaattgtttattcatatgaactacaccatatttcataggtcaatttcattagactggctcacatggctggtctggcttagacacagtctacagagttgattaaaaagtaagattgattgcacatcttgttcttcttgctgactataattttgtattttgcctgaacattcaattttctatgtttaattaaaaattaattaaaatttgttagagtataaattgcatctcatcatttcattgaatcctaactataggtcatgcctcttaaacgcagaaatggtctaacattttatttcaatatgaagtagaagaattgtcaggattattttggtgcccagatggggatttggtattcgtttaactaaattctgctttaatgtagggcatgaaaggaggctttgggacttaatttagaaggtttagcaagagtgataagaaaacccaataggaagccgggcacagtggctcatgcctgtaatcccagcactttgggaggctgaggcaggcggatcatgaggccaggagatcgagaccatcttggtcaacatggtgaaacctcatctctattaaaaatacaaaaattagctgggcatggtggtgtgtgcctgtagtcccagctactggggaggttgaggcaggagaatcccttgaacctgggaggcagagattgcagtgagcagagatcatgccactgtactccaggctggagacagagcaagactccatttcaagaaaaaaaaaaaagaaaacccaataggaattcctcctcaaggtataagatttttgtaaaatctgtttgcttctgcctagtggaatcctcaactacaaaattctgatgattataagaccttctgaaggaacaatccacaatactatgtcttagatcagtgcttcccatctggggtccatggacatacactcaggagcctaagaattctctatgtaaattgttaaacgttatgtttctatttgataacaatatatattgttcaaattttataaattctacataatcagggtgacaaatgacaaatgttgtcatttgcctttatgtttgttatttcactgacaccaagcagtactataatgctttagttattctaactatttaatatagtagagaataataagagaatagtggactcaaaccaagtatcatataaatgataagctaagtaaaggatagttttaaaataagaagattaacgtcaacataactacataaaactaaaaagaacctgtactgtcacagtcagtacaaaaatacacccaccaaatgcactgtagagtcagcaaagatcatctgccatgttaaggcaatgctgacaatttaaatcttgagctttttagttttatttgattggtaaattgtgttatattccatatgtaccataaacatttgatttcttattcatctgagagtttatatctgatttgacttcactaagaataaaattcaaaccccttactatgatatataagtccctgaatggcgtggtctcttcctatctggcttgttgccaccttgccacactaccctttgacatcacactccagcttcatcggcatttctggcagttctttttctactggtgtgtcttctgcctggacaactcttcagactctcaataaaaatacttcttggccaggtgcgatggctcacacctgtaattccaacactttgggaggccgaggcggatggatcacctgaggtcaggagttcgagaccagcctggccaacatggtgaaactccgtctctagtaaaaatacaaaaattagccgggcgtggtggcacacacctgtagtcccagatactctggaggctgagtcaggagaatggcgtgaacccggcaggcggaggttgcagtgagccaagatggcgccactgcactccagcctgggtgagagagcgagactccgtctcaaaaacatacaaacaaaaaatacttctcatttctccaatttcagcttaattatcccctgtttggtgtggccctacttggcttccctatttaaagggaagtccatttactgccctacaatcacttcttaccagtgtcccttgttcatttccttcatggtacttagctcaatttataattttttattttgtttacctgattattgcttgactccccacctaatcaccgaacatagaatagacacacacacacacaccagaatgtgagtttcatgagtacagagatcccatggtcttattatttattttataccaattccttaaaagagtgtttagggccaggcactgtggctcacacctgtaattccagcactttgggaggccaaggcgggcagatcagaggtcaggagatcgagaccatcctggctaacacggtgaaaccccgtctctactaaaaatacaaaaaaatagccgggcgtggtggcgggtgcctgtagtcccagctactcaggaggctgaggcaggagaatgcctgggagatggagcttgcagtgagccgagatctcgccactgcactctagcctgggcaacaaagcaagaccccatctcaaaaaaaaaaaaaaaaaaaaaaaagagtgtttggttgtttggtacataaaataaatagtatttgactaaataacaaaatccatctctcactatgtccagaactatatttcttaaagtctttgctaatttttatgagaggaaaatggcatgttattattttaatttgcctctgtgattactcatggcattggacatttaaatatgtttattggctatacataatttgtcaggcaatttcacatactgtactttgcctagttttctgttgggaatttttttatttatttgtgttatttgtataatcagaggaataatattataatcaacttgtgtattaaaaatgtctccactttgctctttggctttcaatatgttgtgatttctttgggtacccaatgctctccttttacggcatgaaggctgttcagtgtttttccagtggaagttattaatcatacttcatcagtgaataatctgagactaagagaaaaaaaaccttacaaatgactcatgtttggtagaatctgtctaactctaaaatgcatattcttttcactctatgtgtcaactgacttccatacagttggagaagcaccttatctcaacatttggcaacagatagttgtcttagtcaatttgagcttctattccaaaaataccatagactaagtggcagaaattggtttctcacagttttagaggctggaaagtccaagatcaaggtgctggccagtttggttcttggtgagggctgtcttcctgatttgaagatggatgcctccttgctgtgtctcacatgtgcagagagagatcatctctctcatgtctcttcttataaaggtgctaatcccatgcatgagggtttcaccttcatttcctaattaccttccaaaagctccacctccaaatatcatcacatgggggattaaggcttcaacatatgaatttggggtgacataaacatttagtccatagcagatagttaagtaaatctatatttctatgcatatgtttaagggaggaaataagtttcattgctttattgtcatattcacatgaatatgtcatgaatatcatctaacaaaagggatccagggatcctgagttttagaaagcctatcttgatggtttctaatggaaattgcttatttgcctgcattaagtttgtgccagccaactgaaacttttatgtttctgagctttggaccaaacttttatcatttcagtgtggtgacagtgtatctcatattaatcagaaactctaattgatcagaaactctaattgatatgagttctaatcagaactcatagttccatatgcctttggttaatacaaatgggaaaaggcattattttctaattacctattaggtagacaaaaatattttctaacctagaatccatgaggggagaagataacaatattactctttgcacaaaaaattttaagtcattatctaggaccatctttattcccatctgactgtacaaagtattggccgttaagagaatgaaggactttaaaatgactgtttatcatttttaatttattagaagtcagttaattattacatactgaaccacaagcttatttaatactagaagatgagttaataataaactgctccatttcatcgagagtgatggaccaatacagttaccaatgaagcagaaccaagggagaaagacatgaggtacagtgacaaagaagtgggagagagttgtaatacaatattttcaattgtggaatcaagtgcacatttaaatatttttgtgctattgctaaaggaaatgctatttttgattaagttattaaagtcattaaatttaattttttattctttaactaaattattttatattaatctgtggtttggtcaagttgtctttggcctaccatcccacaagaagtcagtgacaatgttgggaccagaattcaggagtcatcagagtccattgttgtattcttataaccatacttcactatctcagaggatgatttgatttgtaattaccacaattacacatgcaatctatcttctgctggccacttctgtgtatgcggccattgcacagggatattgttaaaataaattgcataacacatgtagggatacatgcagagataaatgatttctgtaagcccagaaaagatataaagagccatgaaactttaaatgaaattcgtgtttctggagcagccaaatcaatcatgatccccagcaagaacatgctttgatcagcatcaatttttcttacagtcttacatacaatagtcatcttgaaatactgtcatttaaaaaattaatttccatagtgatttttatccttgttttggtgttatagcccctttatttattcaatttctgattaggctgattatatgcatttttttctctaatggacctccttagttgaacaggcaataatgccataatatgcgattaaatacaattatgactttcttctcaagggcttgaaatagtcacagtaaaaaataaatgctataaatgcaaagtgccctggtagaattgtgcttatagagggaaacagcacaaaatgtcagataaatgatgaggctcagaaaggatccttataacattttgttaactttctgtcagttttcattttacataacaagataaactaaaaaacaacaatacgagaacaattttgggtcaatacgaagtgaaacagaagaacattttgtctttccagattggtttatctcatcactaaagtagcatagacttagcgattaaatagtataatgctgatgaaaataggagctaaaacaaagacatggaagtagtccatggtttggtacataaagtgtgtttctgtcatttgttctttgcaatatttaattcagtcacaatctcagtgatttccttgagcttttggatcacagaaatgagaatgctgctgttcctccactgcagggctctggacccctcgttgtttacctgaagataagcttcatctctcagttaatggcaaaattatattctgacctccaatctagtgcttttgttaactcagcattatttagaaaagtctaaggacaagtgtcagtctggaccctggtgtggctgctatgtgaaattcagtttatctgaaggctcattgaaattcattttgtgcataaacaaaaaactaccaggttccccccacccccaattcatttgatcaccagatctgaaagtattgaataaatccgtaaaacctagtgcagtgtctaattctgaagacacttcaaaatattagtcttggggcaattctgggtactgtgagagaaacagaaaaatcagaagatgtatttcttccttcaggtactttaccatctacttggagtgccaaagcagcagaacaactagagaataaaagctatgtgtgtattgtgtaaccagcttatgtactatataacccacaaccaacatccaacctgcaattacagctagggtttctaacttttctctaaaataacccaaaacatttttactcctcttcttcttcattattctgaaaattgagcaatataaaatttttaaaaagaaggggaaaatgaaaactagaaaggaaaagcatacagatgactatttcttcaaatttttctctgatctttgtgtgagagacttgaaacgaattgtttatttatcaagctcattcactttaccttcctagcaatttcaaagttgactgctcctacaagatgaggaaattaaatgatgagagagaagtaggcactgatgggatgggatgagggatttgatgataaggactgatttgatctccttaaaatcctagactctagcccaagattattgtcttaagtattctcttctgttatcatccaattcagtctctaggattgagatactattgttctaagaaagaatgtatattttatatctactatatgaatctttccctccttcagatatgcctggatgcttctctgtgggggtgggtgatttttaaagatgttagtcattattggtctctactagaatcacctgttctttttttttattatgccacattggaaaaagaaagataaattcagtcatttttcctttatactctatggaaggctgcattatcaagtatctctccccaaataagatcaatcatatcctgttttgataaactggccatagtgttactttaccttctttctttatgtcgtgttgagaaagttttttaacctcaagggaagtcaaagtttttgttttcgttgttgttgttgttgttgtttgagacagagtctcactttgtcgcccaggctggtgtgcagtggcatgatctccctcactgcaaactccgcctcctgggttcaagtcatccttctgcttcagcctcctgagtagctgggactacaggcgcccaccaccacgcttggctaatttttgtatttttagtagagacagggtttcaccatgttggccaggctggtcttgaactcctgacctcaagtgatctgcccgccttgccctcccaaagtgctgggattacaggcgtgagccaccgtgccctgccagaagtcaaagtttctgtgtcaatgttttcacaaacattatctctgaggtgtggaaatatgtcttatttcccattttaaaagtgatatataacaccgttagcttctcttagcctcggtatctttaaccgtaaaatgaagtatagatataaacatttgtccaatctctccaactagattataaacctcaagagataatgaataataaataatgccactttgtatctctagtacttaacagagtgcctactgactagtagatgctcaataaaagttgagaataattatatttccatttcttcactttcttgaataaggtggatttctgtattatcctataattattatgtttaaaataatatattattttatagtaataactaagtcagatgatctaagttaaaactttcatcggaatctaagaagagaagaatttgatggaagtcagccaacaaatattatgctgcgtcaaaacagtgtagctgtctctcactgtgccaatttattttacccaaggtgttgcaactttgagatacctgacaaaaaaagaggctcaaaggtattgccagtctacatagaccatcatatgttggtcccgtctgctgagaaacgtgggtttatgtggaagtttttcctgacacttagaaaacagcataagccaagataaaatttgctttcatttgtcaatgcaacatcaattcttctacaagcagtagactggagttttaaagtagtgacaacccacaggacgtattcttccatcgtcttatatataacaagctgtttctctccctgtctattaggctattcttacattgctataaagaaatgcctgatactggataattcataaagaaaagaactttaatgggttcctggttctgtagattgtacaggaagtagggcactgtcatctgcttctggggaggccttgggaagcttttacaatcatggtagaaggggaagcagaagcttacatgtcacttggcgagagcaggtgcaagtgagtgcaaggagaaggtgctacacacttttaaatgaccagatctcacaagaactcactcactatctcaaggacagtaccaagggggagggtgctaaacccttcatgagaaatctacccccatgacccaatcacctcgcaccaggcgctatctccagcattggggattacatttcaatatgagtggggatatatgatttggatgggaacacagatgcaaactatgtcaccgtgttaccctcccagtagggacctctagatttaacaaccttagggcaagggagtaggagagcctcatggtaatgattcctgcctgattaaggtataacaaagagttattagttaaagaaaaatgaaaaaaagagagacagacaaacagaaagcaggaataaaaagttttataaatgcaagaaaaaatgtttgcatgaaatgacacaagaagtatcaaatgaataaacacaatttatgaaacgtgcatgtcatagttaattttatatgtcaacttgacttggccatggatgctcagatacctgattaaatattgtttctaggagtgcctgtgaggatgtttccaggagagataagtattggaattgatggaccaagtaaagcaggtggcatactccaatatggatgggcatgattcaatccattgagggctcgaatagagcaaaaagacagaagaatgctgggttcacctgctctctgctggactacttgggttgggacatctatcttcttctgcctttgatgcttctggttctcaggccttgagatttagcctggaatctacaccattgaccctctagctttcaggcctttaaacttcacttgaccttcctgcatgtccagattgcagacagcagattctgggatttcttagcctccataatcatgtgagccaatatgtgataataaatttctttaaaaatatggattagtaaaatttgcatcctaatgaaaatgtaagcattgtgacagagaatgctttagtcagtctcaaatcctaaatttgagattgaaatttaagatagcttaggatgaggaaaccacagtgtccttattgaaggagtgacttactgacttctacatccaatacagctccttatatttgacaataaaattgaaacaataatagtttaaatcttggcacatagaaattatatgtccctgacctactaattttctgtaatcaggatgctagacaattaacttcctaaagaaaacacatggacaattatgcaatgtttttgataatgaagcaatgttagctcactaaatgaagtaaaatctgaggaagctatgagaagtatgaagttgattattatgaaaaagaagtttgagctgtatcttaaagataatgaatgctccttaggtcagtcagtaagttttaaaattacttaactgaaaaaattaagagaatgtttgataatttaacatgtatctttacttccagagtaaattaattatccagatttttatcccactgctctctaaattgttctattcaggcaactatatatggtcaaagttgtatttgcctgtttttctccatgtttgcttccattgtctacacaaaaaacttaggctattattttatgtgaaaataaaaaatagggagttacatgcagttctttttccgctgaccaaagaaagttttcttcagaaagagcagtcccattttttacttatttaaagaatccacattctttgttcttcctggacatatgccttttgcttagaatgggaacagaaaaggtgagactgcctctagagaagctgaaagcaaagtagtgggtctgtaagatctcaacataatcaacagtagctgtgtattcgtagctgtgatacagaatgctgtcatacgtctcactaccactccaaagctttaccatgctgcttagcacattgaagcttcatctcagatcttgccggacttatttgatatttaagatggagagtctaaaggacaaaactaaatacttccatgatgtttaaattgggcgacagaaatacaacctacttagaaagtggtgtcatgttattccatttttcaagagtttaatcctcacattggttatttgctacgaagactcaaggcatcatttcacttgacttagcctagccctatcacagtgatggcaaaataagttatattagcccagcagcatgcatcagacagtctgaaaacattctaaatgattaccactgaataagagaaaagagagccatcaagcctcattgagagaggcatgtccagtcatctaccaagatcatttaccaccctgttcattgttttactcagcagacaccctcacgcagctctcttcagaccctgtgtcagcgaaattacaaaatgtccttgggatcattcacacgcagttgaaactatgaatctttaatctggaaatgccaaattttctgggaagaaaagcatttgaaaaaatgccttacaatgtcattatttcctgccctaagggctactcctccttttgaaaaccaatttttagaaattagacatttttcaatactttgtaagtccttaaaccaatgtacgatgtcagctgcaatattttatgtgtttcaagacaaataaaattcttttttattaacagttatatgtctggcccttaaaatgctgtaaaataaaatgcttcactgtgtgaaaggctatcatggggtcattggataagttaccaaacatatttttcctgtttttaggacattttaagtttagcttttgctgctgttgaaataaagaaaacccttaattaacatttctgcaacttctcatttttttgtcatcctctgtataactagttgagtcattacatgagggtaactctaataaacaaatctagtaattgttctggataacattttattttgtatcttcttataaatgaatatttgatgatctttacattctgcagaaagatttacactttcaaatgctagccattaattagtgaaagcagtacaacattttataaaacacatttagtatttattttttaaaacattccagtgtatagaggctttttgttgttgttgttttgtttttgtttttgtttttgttttttgagatggactctcactctgtctccaaggctggagtgcagtgacgcaatctcgtctcactacaaacttcacctcccgggttcaagttattctcctgcctcagcctcccaagtagacaggattacaggcatgcacaccatgcccagctaatttttgtatttttagtagagatggggtttccccatgttggccaggctggtctcgacctcctgacctgaggtgatccacccgcctcagcctcccaaagtgttgggatcacaggcgtgagccaccatgcccggccttgtttttgtttttttgagacagggtctcgctctgtcacccaggctggaatgcagtggcaccatcttggctcactgcaacctctgccccccaggttcaagcaattcttgtgcctcagcctcccaagcagctgggactacaggcgcctgccaccacgcccagctaatttttttgtgtgtattttttatagatatggggtttcaccatgttgctcaggctggtctcaaactcctggcctcaaatgaacccacccacctgggtttctcaaagcgctgggattataggcttgaacctggcctgattaaagattcttgatacaattaatgattgggtgtgatttatgtagtgaatgattatatgctttaaataagaatacattcatagatttttaaatcacactttaagatcaaaaaaagattttaagatattttaaaagatggaggccaggcacggtggctcactcctgtaatcccagcacttcaggtggccaaggtaggtggaccatttgaagtcaggagctcaagaccagcctagcaaagatgataaaaccctgtctctactaaaaatacgaaaattagccaggcatggtagcgcacacctgtagtcccagctacttgggagactgaggcaggagaattacttgagcctgagaggcggaggttgcagcgagccaagatcgtgctacggcgctccagcctgggcaacagaccaagactctatctcaataaaaacaaataaataaataaataaaaataaaagattgagacttttttaaggggtgaaaatatttcatttgagcaaagcattcctcagctaaaaaaaacaagttttaaaatttctgatttaggaaccagtaatatattgaaaactgaagtttaagtgtcaatatgctaaataaatatttccatttccctaagtacaaatcataaattgcgaagtaactagaaaggaaactattgatcttcagcttatctgcctttgtgcagatatttatccggttcaatatttgactaacttgtctaaccgtaagaaccttgttaaaatactgatacccagaagtaatttaacatgtcacgacatacgtttagaaaggtctcctgtttgcgttagaggagtgttcttcaactttgaatcacatatgaacaacgttcataacatttaaggggtcttgttaaaatgcagatttcgatttatgtattacaagtttctgggtgatactaacactgctgttctgcagaccacatcttgagtagcaaagcattccagaagcattcaagatcccagaacaggacacctcatctagcaggtcctccacaaatgtttattagtcaatcagaatctagctaggtgcagtggcactaaacgtctttttttcttttctccttttttctcccttgccctagcttaaagctgtgcatagaagttattttattttatcctggtaaattgagcacttctgtttgttttatagaggtgtgccctttctgttgagtatctttctaagagccattatggtgtgactcatctttctgacagtatttattttaaattttaatttattcagctgcttcaatcacattcataagttatcttttagaataccttctctccttcacacttaccttggccagaaacctgatcatctgaatacttgtaagagaaccaagaaagtatagactaattgtttattttaaaaagcacaatgaaggaagaaatggatgtgatttttttcttggaaacgggaatttaatcacctaatagagtctcttagaaaagtaccattcccaaatctgttcttgattttgaatactaaattgctctaaatccacctaatggttgtttaaacctatgacaccatggagaatgtgagaacaataccgtctatgaacctcttcaagaataagctcaaaaatgaactccaccaattgatgtggaaagtatttcatgcatgggacgttctaaccagggaaatgggaaagagctggcatagcaaaggtggaggggctaaggaagaacactgagagatgggacagagatggcttgccaattcacgcgtcacatgagaacaccaaaagattttggaaaatccataaataacctaaattctcttttttcctggcccgtccagctacctcccccccaaaaaaagaagccctaaacagcctctttgctatgtctcagctaatcagcttatcagcagctcacataagaaaaggtaaataatattcgctatttcaaattgttcctctctccacttttccttacataaatcagggatttgttaggtgaaatgaattttttttttttttttgagatggagtctcgctctgtcgcccaggctggagtgcagtggtgcagtcttggctcactgcaagctccgcctcccaggttcacgccattctcctgcctcagcctcccgagtagctgggactacaggcacctgccaccacacccggctaattttttgtatttttagtagagacggggtttcactcatgttagccaggatggtctcgatctcccgaccttgtgatccgcccaccctggcctcccaaagtgctgggattacaggcgtgagccactgtgcccggcctatgtgaaatgaatttattacacactccattgattgtataagtaaaatagcctggtaaaaattagctgcatgtctttttatcattctttgaaaaacgagaagtgtttagtttgaagtatctaagtaatgacaaccagcctgaactattaaaaggatgtcaggaagaagagagcaaacatgtcctttttgctacagaatgccaaaattataatcaacaggtaacaatcgcaaggataaaccttgtttgcctaacaagataaaggactttcttaaaatcagaattccaataaagtctctcatttaaattcaggggttagataacttagaatgggacaaatagcacttatattttaatctctaatttatttgtctgtctgcaccacttgaggccaggaactatttcttattcattcttgcctcttctgcacctaggagagtgtctagctcatattcattaaataaattttgttgagcagtactgaaaggcacagatttaagactttggaacctttcccaatactatgcccttgtcgtgttgaatgaacgaatgaatcatgagtttcaagcctaatgtttcccacatgtcatgattaatggtcaaactaaatcttggttcctctttctctctctctctctctttcttttttttttttgagacagagtctcgctctgtcgcccaggctggagtgcagtggcacaatctcggctcactgcaaggtctgactcctgggttcacaccattctcctgcctcagcctcccgagtagctgggactacaggcgcccaccaccatgcctggctaattttttatatttttagtagagacggggtttcaccatgttagccaggatggtctcgatctcctgacctcatgatctgcctgcctcggcctcccaaagtgctgggattacaggcatgagccaccgcgcccagccggttcctctctcttaattcagtttcccagggtctttactgacagccctctgttaagaactgagcagtttcttgtatcctatcagtggttttgccacttccttctttttttttttttttccccaccaacatgctcctctctttctctaagtgaagttgtgcagttttttttctctaagctataaacaactacacttgggatcccaggccttcccttcattacccttatgaatatgcctttgtgtcagtggttggccagagacaaatagtaataatagaaaatcaatatactgtatggggagaagtggaaaagtgcctggatataagttttacattaaggttcggtctatacacaatcatattgattagatgtaattgatagattatcttagtattattcacatgacattatttgtgccttcctgagaggattctaccctcccatgattcgtggaactatctaaacaacttcctaggaatgatcctctcctttactcctacacagtccaactacatgcaaaggtgcccggcacatggttaaaaaacaatactacctgtgcaaatacagacgctactcagcttataatggacatacagcctgataaacccatcataagtcaaaaaatacatttaataccctgataagcccatcataaagtcacaaaagcataagtagaaccattgtaagtcaggaaccgtctgtataaggtatcaagacaaataaaagtgaataccacacatactacttgtgaacttttaataactctgaacacaaacagcttgaaaacaataattggatagatggtctttaattcatgtctttatgaaaatagcaaaagagtatattgagaatgattgaatcaaatttaacaaaaccttgcttctcagtgtgactcctcgaccatcagcattgaaatcacctagaagcttactagaaatgtagaaactggggcccaccccagacttactaaatcagaatctgcatttttaacaaggtccccaagaaaatcagtacacgcattatgtttaagaagctactctaatgagtacgcattaagtattgatcacactccagttccttcttagaaaagaactgacggcacggcttaaccagtgtgactaaaggaatgatctcagtgttggtctgtcctaaattttcctttgtgtctaccctgaactgagattcgccagggcctttaatactaggatttagtcttcctttatgcatgcactcaaattagagcctttgtcatctgagtctttacagatgatatctctcaacagtgctgggagtgtggcctaaagcaatgtaatactaagtgaagtcagaaaactggctacccatctgcaaattgtttgttacttgtctgtcataatatagcaactttggtagaatatgcatgatgacataagaagcttgtgccaaaatgtaaatcacctacatcactaggcacactcttaatttcagctgctatttttttcttagtaaaactttttcaatgaaggaagtagcatgttgatttctactcaagcatagcttgttacctccttgtggacaagaactttgaatagcacaggcaaagtgattaaatgcagaaggctgctctacttgctgcagtgtgaatgtggttaatcacaacaggccctacatattagagcacaaattaattatggctatagattaactgctttgttaactccataatttctctggggttcacagctagattcccagtacctggcacagagatggccttcagtgtctgttgagtgaatgaagtgcctagctcaactctcattgtttacctgttgttgtagttgtttcttctggcttggatttctaaagctcctgaggtatagatactgttgattttacctaaagaggcttcagcagaagagaacaatcacacaagaactagaaaagacaaggaaggttttatgaggaaaatgaacattaatctagaatttgaaggaaaaatgggacccacatcagcatcatagagaaaaggggattcctggcaaggagaacatggaattttgtggaatgcacagaatgtaggaggtaggaatacatatggcatttcaaggaatgagtgtgccatacgtcagccaaaggctgaggcaatggagtactgggaggaagtgttaagaattatggatggaccagattcttactttaacatcttttttttcccctaagcctaatgtgcttccaaacttgcctcttttattaaatgatattcataacaaaagcaatactaaagtccttccttgcctgtttcctctacacacataaaaattaaacatttaaataaaagtagaaaaattgtgacacttttttaaagcttcaagagtaagatttcacatacagatgacacattttctacaatgtaaaatttagagcattactaacgcatattaaatgctagatcagtctttcaagttacagtacacagaagataaaaataggtgcgatttggaaagaacaaaggtgaactcgaagcatacagtgaataggcacaaatcagctacaaattttagcagatattcatgcgcttattgaaataagccaccttttcctgcatttgtgccgacaagtccatttatcctttttaagatgctccagtaacgataggagcattttgggggcgggggaggggggctaattgatgtgatctaatttttcagactcaggagttttggagaaaggtcagtgtaacagaaaagctgcccattagaaataacatctataaactgtcagaaaagagtgcaagccagaagatgaagcaattcagattgcttcccttcttttccaaggttcttgggaaaaaaatttcattacgcataagaagtatagctaaatacttaactgaagttaaaacaaaatcatgttttctaacagttcaggtgaatttcaagccatccaggccacaagataatgatgtcctccaagtctgacctacagggaacttttcttctaattaataaacagactacagcaagaaaattaatttatgcaccgcatttacttgttgatgcccttcgagagcataacatttcagtaggcactgtgtacacgagatacagcagaagaatacgtcaaagctagttctttggtgttttttttttcccagagaaaatagaggtaatccaacattagacagaatttgtcgagattactagatgtacattcaaaacatccattcaacaaaccaattgaattagttgcatataagagtgtcccctctgggccgggtgcagtggctcacgcctgtaatcccagcactttgggaggctgaggtgggtggatcacgaggtcaggagatcgagacaatcgtggctgacacggtgaaaccccgtctctactaaaaatacaaaaaattagctgggcgcggtggcgggcgcccatagtcccagctactcgggaggctgaggcaggagaacggtgtgaaaccgggaggcggagcttgcagtgagcggagatcgcaccactgcactctagcctgggcgaaagagcgagactccgactcagaaaaaaaaaaaaaaaaaaaaaaagagtgtcccctctgaattgtactcttcaggattccctgggtgcctttttaaaatttaagtctgctactgcctctttcataacttatggggcagagccctaattccttagcatgtcatgagaacttccaaatccaggttctgcctgcttattcaatctggttccactctcatgccagccacttcatacctaatcctccaccattgctaccgccagtgtctgaatgcatctcacctgcgtgcattttaccaagattctcccactgcctggaatgagaccacacctttttcaccctgaaacacagccattccaattgtggaaactcaactcaggcacctgttccttcccgtcttaccacatttcctgaccaactcatgccaccattgaatggccccttaagcttaagtcctcttatttttgcagtgattagacgaaatactatatgtaaattatttagcaccatgtctgacagtagtaaataactatcattatatcacatgttattataactacactggagagacaatataacatggtggctaaatgagtaaaacttgacatcatactgcctatctttcagtacttattgttctgtgaatttgtcaagttaatgggccctcccttctgggtcagttttcttacctgcaaaatgggtacaataatagtttctacctcacggggcgtttgtaagagttgaatgagttagcacagaaaaagcacttagtgtctaccacatactaagtatgcaataaatgttaactgtgctgctgctgatgatgtactttttaaacactttaataaaaaatttcaaatatatgcaaaattagagacagtggtatgcatatactgaacacccagctttagcaattatcaaattttgccattattgtttatttatctatttctctttggtctatttttcattaatgtagtattttaaagcaaattccagacattatcatcagtttccctttaaatgcttctctaaacaatgatgactttctacatagaaccacagttccttttacatccctatcttgcaaatacgtctaaataggatatttcatttaacttacttattttcctatctttccttctgggctgtaaatccttgaaaccagtggttgtgatatttaattcatttaagctgtaattcactggctagaacacggtagtagtgcaataaatgtactttttaaagagagagagggaagtaaaaaagagagaagggagagagttaaggagagagggaataggaagggctcacataacaaaataagacattaaacaaatgttgaccttagaataggcatagtacaactagtgcctgaataagcagtaagtaccaaatgctgtgatcctagagaggtgtctcagaaacctatgcatagccaagtttaatttgccagcaggtttttacttcattgactggtcaggtagagaagaagaaagcaaaaataaaagagtgtattattctgtatcacaatggtatcagattgtttattttggagtctgtgtctatttctcatttccaataatttatgatatcatttaccattattaaaggaaccttatttttaaagccctgtgacacctagtgtgaagcagaagagtttgcaaagtttaaacatcatattgttaaattctggagtggctttaactagctgtgtgatcttgggcaagttacttgctttctctgcttcagttcttcatttttaaagtgtgacaggattagcacctatctcataggcatgacatgcttagaacaatacctgatacatgaaaagaatttttaaaattttatttattatctagttataagagaacaatgaaataaaacaaatatgaagctcgcccatttaaagaaaaaaaaaagaatgatttcattgaagatacttcctctgccatggaattgctaaatgaaactttgcagcaattccaaaataacttgccccagggagtaggattggattttgctaaactgaggatttaagatttacaattttttgactgtaattcattcttacctctgccaaatgtgattgcaaagggaaagaagacatcataattgtacgaaagggttttaaccaggttttcttgttttttgtttgtttgtttttactaattgtttcagggcatttgaggcaattgtaagagcttacacatggtaaccactacataaatattaaaatgatggcttggtacaaaaatgactttatgattaataaaatcacaaaaacttggaaaaagagttataaaaattctccataattgagtgccaactttgggcctaatgttttatatagtaggtagaacccaataactgccaattatttggcagttttgatgttagaaaaggccacgggataaagttcggacaaaatacattttttctattcctccagatagtagggttctcatttttcacagaggaaattagggtttagatagataggggacttgtataaaccacatgctacaaagcgaccatgtagaaacgtgagcccaggttttcaggctcatcttattagtggctaattccaatgtcctttgcatatttaggaaatgtttgctataataaagaagctgggcaataagatattaaatattttgaaaagggtaaatatttagtgatttatcaaaggaagcacaaagcactgagtactttagcagaagaaatggattaaagatgtgagacccatgtcacataaaccaaagaccatttctcctccagataataatgagattgtcacatctatcaatttctatgtatgtattccattgtacatcctctctccctaaattttaaaaagttatgatcatgttgatatgcaaagggaatttatgtgtttgtttaactttttgaggagaaagtgagaaagagaaaatattttacattccaggagagaagcactttagagaaattgaagcaaaaactgggaagaagtcagggccaactggtggaaagtcccccaggatgcaagagaggagcactgagccctgacctacttctcactaattgctgcaaacctcccataaattccttgcccttcctggtcttcagattcctcttctataaaacaagatggctggggaaagactctctgaggtttcttggagtttttacaatttaccgatcttgtgaaattagaccattaattatcttttaaatgtatgttttacaaagtgttaagatggaagaaataaactggtaaaatataagatggtttgtaatcataaatattttccatatttaattatagtttatttctcatagaagtgtaaattgaggtgggttacagtgttaaaacaatattagaccagtttgaaaaaaaaaagctagaaagttctatgcacttacatattttgtgataatcagatattagtcaccattctttatataaacccaatgttactaattacttaagctttaagatgaatgccaacattttgatttattcacatccataacataatttggagaacctagaaatttttttgtttttacatttgtgcaatgacatttcaggtttggttttagacttccttcttttctttcaacatgatgctgagaaacacaagtaataggataatcacaggttcattcctagccatcgcttttgcctgtcaatatcctaattacttccctactccacttagatgactcagagtccatgccatgaatactgatgatgagagatgatgcaatggggagaacttattgtagctccatcctgtcctttaactttcattgtttctccagccaagaatttaagggcacaagttagaggagagtctggtcatcaaaataaaattcgttagccttttaaaatatgtcaggctaataggacaagcagcctgcaaggagaagcatccctgactttgctggacagcatttccaattatcagcatcttctggcattttaagttataactgaatattctcaaataaatgttgcaagaatatgaagtgtagcataagtattatcttttcagtgaaatctattcttatttatttacatagagtgtattctattttaaattatatatttatggacataaaattcacatatttgacaagttttttgaagaggcttttccactggagtaaaaagatggaaatttttaaacagcatttgattggtattccattttcctttaatatttgaaaatgttatgttgatcatattttaggtaggaatggatctattaactaccatggaatcaatttgtagttatccatgaaaataaaacaggaagaatttttaaataaatattcactctttatttacaaagatttattaagtctctgctatgtgccagtcctagagaaataaactagtgatggcctggatcgtttaggagcttacaatgttttgggagacatgcacatagaatgattaaacgaatcaggagatggtgagttccacagctgatgtatacacaaacaaataatgggtgcatgaaagagggtcaccttatctcttctgataaggttatgaaggtatcccagaagaaaaacatctgagctgagtcttaaaaatgcaagagaatattcccagatgaagaaaggggagcaggccatctcaagcagaggagacatcagttgattttcagcaagtatgtagagtgtttaaggactgattgacaggtcaacgtggcccaagtgaaaatggtgaaagttagttggacccaactgtgcaggtcgtgaagtcagattgtgaggatggctcccatctcatctgggagaaagagatggcttcctcaggcatcaagtgctttcttcttaaagctgcagttatttcaccgctatttaaatttgtgttttcccgatggtcagagactacagtcagactgcctcttggatttcagtgatctttgatttacctgtttacacctttcacatatttgttgttgtttgcattttgacttgtagaagctctttacaaacatgagtagtcatcctttgtcatttttgttgtgctcatactcccacggtactttgctagttttgttattttgtctatgattttaccccatacacaaggtttattttataagtttagctaacaaatacttattatgtaccaagttttattctaatgtttttttacaaatgttaacacatttaatcttcataacaatcctatggggaaggtattaacatgcctatgttacaggtaagaaaactgagctacatcttgaaggtcacataacttcccaaggccttactgtggtaggtgtgaggccagggaatgctacaaagccctgctttgagcctccactaagctgctttctttcaaatttgtcttctgttcctttatgatacctgtattttatatcttattaaacaaggccttgcccagctcagattataaaataacctcctagacattcttataattttatacttctgtgacttttgggtttagaactttaatcaatctgcaatgtattcttgtgcatgatttgagttagaaaccttctcaaatgttacattatttattgcagtaaccactgtttctctcatttatttgaaatgataaattattgcaaaatagattcatgcattttttgtaacttttttattatatttcactgttcaatttgttcattccttcactaataccatacattgctctaattactgttactttttagcattgaaattgatgtttaagtgttccctttttaaaatatacttgtcactgttctcatttatttataaattcctccaaataaatatatacaattagtgtcttacattttataaagttggtttgttttggtggagtagattaaatattgacttgggatgcaatatacttataaaattaatttgaagaaaactgatattgtcaaaataattaactttttcatactagaatatagggtgtcttttcatttattaaggtctttcttgtatttcactacatttttagtttttttcttaagtcttacacaatgtttggtaagcttatttctaagtattttatcattgttttccacttttaatgagatttcaaattccattaaaatttttaattggatcctgctgatatacagaaaaactattaatgtttgcatgtctttcatgtatataattgctatattaaattatcttattaattctagtagtttttcaattagttatcttggaatttttcttagtcatatccgtgaaaattgttagctttatctcttcttttgcaatgtttacactttttaattatattgtctcattgtggatatgtacttataatgaaaactattcgtgataatattcttaattttctagttcctggttttaattgaaattctttgtatatttcaccagttagattgttcttacacagtagtttgatttttattcctagactagttattccattctcacatttaaatgacactttcgctgctttaggttctcaatcttttgtctcagaactttctagcatcttgtgtttcagggaaggctgaggccaatctgagagttattccattgtgctaccttccttggttttaaaaattatcttcattcttgaaattcaaagattttacccaaatttcacctaaatgtgtatagatttggagttaagttttccagagaaaataccagacactcagttaaattaaagttcagataaataacaaataaaaactatttcccagctgtatgcatttttatttgctcaatctgataatcctaatggggtattgactgttaatatattattatcattattaattatttttgttactgtttggcagtcaaagggatattttaaaataaagtcctttttcagatcagaccaatatttttcaattacttctttgacacagcgtagcaggtcagaaaactggttcttaaaaccattgtgtatattggatgtggtcttacatttaactcccggacaagctgtttataatttggtagtatgtcttaggctcttagatgctcacatgctagaataagacaaaaagaattaggccattcctttttctctttattccctgttctttctatctggaaaaacagatattggaaattcttcatctattccctatgtctcataacttttctattaaatgtatatatttttgtcttttatgcctcatgttttgggagtttatcttcacccacattaattttaatatgtatgcctgatgaatttattaaaaatttctacttttaatgagattgcaaattccaataaaatttctaattgtatcttgctgatatatagaaaaactattaatgtttgcatgtctgtcttgtatataattgctatattaaattattttattaattctagtggttttttaattagttttcttgggaatttttcttagtcatatctatgaaaactgataattttatctcttcttttgcaaagtttatacattttaattatattgtctcattatggatatgtacttataaaacaatttgtgataatattcttaattttaaattaagaatctttttaatatcttaaccttacatgtataaatttattaggtctgataattttattattagaccttcactaaaatgttaaagtttagctatcatggttttaatttcaaaattttttttcttgatcttaggttatttctttttcatagcaatttgttcttgctttatgacttttgagtttttttctgttttagcattatcatggtttcctctaagactgatcaactttctccttttacataagcatatttgttgattttcctcaaatatctggtgaaacttgatttccattcttatgttattaatatttataaatgaagtatcggtttatcaatgtaggtaactacagtggttttaacaattgttatgaaaggctggttttgcagcaggcttcttccctgactaggagagagaaatgtgtgggtctggttttccttttcttgttatgcaagcaggaagaaccagaaaagcaggggcactctcatgattgcaaaagcaagtgctcatctgggtggtacttttaagtgctttggcaaaggatgaggtaaaattcaaagacaacagcatcactgttttcagaacttcattcagagccattacgacaaataatttggttgcaagggtgtttgatacctgaaataacataaggattcttagcactctcgttgtctgttcacaattgtctgcaaaaagcaaggcaaagcatagaggtcatgcatggtgttatttttcatttgtgggaggagaatacatgttcttattttgatattaaaattaggaaagactagtggtcaaaattgaaagtatagagctttactgtgacataattcagtttcttataaggggatcatatataagagtaccccaaagtactttgtattgtgcttgcaacttttctgtaagttaaaattatttaataaaaaaggatttttttataatcaagaaatctaaagatggaaaattatgattagatttaggtttaacttaaagtgacagaaaacacaaaatattactgtttcaaataagatagaatttatatcttgcctacataatgtaagcggtcatccaagcctggaatggtgctccttggtgtcaggaacttgagttcattctgtcttgcagcctctccatgcaggaattccatgttcagggtcatcccgtggtctaagacaaatgctggaatttcagcatttccattcacattccagccagcaggaaggagaagatgattgccaaaaaagtgcactcctttcctctaggaacactttctaaaagttttactttcttcctgcatcccagtgtctaggaactggtcacataaccatatctagctacaaggaaaactaataaatacaaaagctgctaattacttctcagcattcctgtacctactaaaaatcataattattgtagaaattggatattgaagacaacgaagaaaacaatgaagagtatttgccacaccgtttgaacagggcagtgtttgtagaatctcttgaagctcatccattccaaagacatccgtgagtgcttaccatgcacgaagcactgtgctggggcttgagatagaaatgttgagaacaacacacttggtctctgtgctaatggagttttaggctaatgggaaaagtggggattcaaaacataaggaaacatatttgaatattaataaaagctaagagactgttaagagggaaattatcacatgttctgagaatgtgtcacggaaggactttgccaagccagggcaggatgatgatgatctaagaaggctttcctgagggcatgatacatgtgttcaaatccacaggatgaatgggaatatgcaaaggagaggctagagtaggaatatcaaagaaggcagcatatgcacaaatgtcacagggaaaagaataataatccagttaagaaactgaaagttctttatggctggagtacagcaaacaaggaggaaaacaggagaaaatgagactagaaaggttctcaaggttaaaataatgtagaatcaaatgcaggccacatacagttatttgtgtcattaaagggttagaggcagagagcaacatgacctgttttatacattgaaaaatgttctgaatgcaatgtagaaaacaactggatgagtgtaagaggagactatgctaggagttcaggcaaggtgggagagagagcaatgtggacagaatcaagagatattcaagagattaaaaacaatagaacctgatgataatttagatacgaaagagtgaaggtaagagaggagttgaaggtgattcccacatttccagattgtacaaatggatgggtggtggaccatttattttctgaaacagagaaatatcaactaccaattagaggaaagatgttgatttttggtttgatttaagagccttgagtttgcggtgcctttctgacgttcaagtaggcatttcagataggaagttaaacatgcaaatctggaacaccgagaaaatagcaagcctagagatacagatttgagaggtttttgcacataggtagttggtaactaaatcacagtttcagagaggagtccctacagagatagcaggcagagagatgagaaaaaacaagaatctgggacttgaatctaaaaggcaggcagaagaagggtggcagaaggcagcaatggagactgaggagggtgggtgagaaggtagggatctgttgggagtttgtactatgatagaagccgagggattctaaagcactaaacaggcaaattcctccttgacttgacttgacttccttccttaagtcaaggaagaggagggctgaaagaaaaaattgagagtacagaagggttctgaaatgttactgcaaagataagatgtgacaagtatctcttaaagatggtggtagtcatgatggtggtggctgtgtctgtgtatctttgttatgcatcaatatttgaaccacttggggagatgtccgtcaaagaatacaaaatttcagtttggcaggaggaataagttcaagagatctattgtacatcatggatgcttagtaacaatatattatacacttgaaaaatttctaagagtagatcctaagtgttcccaccacacacacaaaaagtgtgtgaggtaatgcaatgttaattagcttgatttaaccattccacaatatacacatatatcaaaaaattatgttgtacggtataaatatatacaattttgtcaattaaaagtaaatgaatgaatgaatgaattaaaatatttggagcactctgaagctgaattcagaaataatgctaaagaagacttgactttgttaaagacagaatttttatagaatatatggaaatagtaattattgcttaaaaactgtattcaatattttgatattgacctcaataaaaaaatgtgtaatcaatttttgaacttctagtcactcaggggacagaatggttaccatttgttgtcctaaagcaagggtagcataggggcttgtcccaggaacaatcagttggtcttcaaccaaaaaagtggatatttccatcagggacatttgcctggacaccaccatgttagattctaaaaatcaaacatgtgtcccaccctaactttgcctttagtccctgaaagaatggacgtaggtttgagagaggagaacagtgagggtcatccctcttcatctcaggagcaattaactagttattttgctcactttgggaagaatttgccttcaaaaattataccttttggaaaactataccatataattatttatcttccttcaaaatatgaattatttgatctttttctcacttcaacttttcaaaaatttcacataaggagccctattcaattatctccttctgtaattaaaacattttagtaggtgtgcaaccaaattgccaaactaagacagatcttgttattttaaaagaacattataatttcaattattctaataattgttattattcgatagagcaaattatgaatgcaattttcaaagcaaatgaaaacataagaaattcatgatttttctatactgctacaaatttggataacttcaaagtgattatcttacatttggcttttactttggaaaatattaatattagaaaaactgcaaaattttggaatctagattaaagaacgatagattatgatgataactgtttatgattcttattttattatttcttttttgaacctgcttttccaatctagataagcatgtctagtctcataccatattcatactgcatattataacatggtgttaataatcttaagtaatattccatggccaatcaaccttttttggacactaatactcattatgagactgagcttaacagctgttttttgtttttgtttttgcttttttagcatttaagtttaggggtatgtgtgcaggttggttatataaatacactcatgtcatgggggtttattgtacagattatttcatcatccaggtattataatcctagtacccatttgttatttttcctgatcctcttcctcctctcacccaccaccctgatgtagggcccagtgtccattgttcccctctatgtgtccatgtgttctcataatttagcccccacttgtaagtgagaacatgcagtatttggttttccattcctgcaatagtttgctaaggataatggcctccagctccatgcatgtccctgcaaaggacatgattgcattattttttactgctgcatagtattctatgatgtatatataacgcattttctttatccagtctactgctgatgggcatttaggttgattgtatgtctttgctactgtcaatagtgctgcaatgaatatatatgtgcatgtgtcttcatgatagaacaatttatattcctttgggtatatacccagtaatgggattgtggagtcaagtggtagttctattttcagctgttttaggaattgccacagtgtcttccacaatgattgaattaatttacacccccaccatcaatgtataagtattcccttttctccgcaaccttgccagtatctgttattttgtgacttttgaatcatagccttctgactggtgtgagacggcatctcattgtggttttgatttgcatttctctaataatcagtgatgctgagcttttttcatatgcttgttggcctaatgcatgtcttctatagaaaagtgtttgctcatgttctttgcccagtttttaatgtggttgtttattttttgcttgtaaatttaagttccttataggtgctggatattagatctttgtcagatacacagtttgcaaaattttcctcccattctgtaggttgtcagtttactctgttgatagttttcatttgtttgtttttgttgttgttgttgttgttattgtttttgctgtgcagacactctttagtttaattagatcccaattgttaatttttgcttttgtcacaattatttttgatgtcttcaccatgaaatctttgcctattccaatatccaggatggtactgcctaggttgtctttcagggtttttacagtttggggctttttttttttttttttttctgaggtggagtctcactctgtcgcccaggctggagtgcagtggtgccgatctcagctcactgcaacctctgcctcctgggttcaaacaattctcctgcctcagcctcctgagtagctggaactacaagtgtgtgccaccatgctcggctaactttttgtatttgtatttttttagtagagacagggtttcaccgtgttagccaggatggtcttgatctcctgacctcatgatccgcccgccttggcctcccaaagtgctgggattacaggcgacagccaccatgcccagccagttttaggctttacatttaagtctttaatccatcttgagttgatttttgtacacagtgaaggaaagggtccagtttcaatcttctgcatatggctagccagttattccaacaccatttattgaatagggagtcttttcctcattgcttgtttttgtcagctttgttgaagatcagatggatgtaggtgtgtgatgttatttctgggctctctattctgttcctttggtttacatatctgtttttgtaccaataccatgctgctttggttattgtagcctgcagtatagtttgaaattgggtagcgtgatgcctccagctttgttctttttgcttaggattgccttggctattcagactctttttttattctatatgaattttaaaatagtttttttctagttctgtgaaaaatgccgttggtagttagcagcttgtttttgtttgttcatttgtttttgaaacagaatgttggtctgtgccttaagtttgaaaatcctccaaaattttctgtcctttcactgaatatgtggtctcttggtcacaatgcagcactgaattccctgttaatatgcatatcttgggttctttttattcagtacacacagaggttgttcccttgaaaatgagtagtccagtaaaatgccctttgcagagttatatcccatatttctagaaataaattctaccaaatattagcactactgaataacacttttaacaatgtttaaacttgcctttttagttgaaagcaaacataaactcagctgtaatatcttaagttcaaatgcactaattttcaatttcatatcaaatttcaaaatacttttaggtttctattcaacactttggttttcatacacaagccacagagtatactaaaactcatttgggtggcatgtttctcatataagtaaaggtaaagactaaggacaagtaagttctttattttctaccagggtgaatggtaaagtagtaaagatcagtatttcctggaaaaggggaaaattgctttcagcaggagtttacaaatccacttggccattaaacatttttcacagatgacatcaaaagtgttattcacataaatgcatgggaatttttttccaatgtatgtaggtgttattatgttaaataaaacacagacccacttaaacatcatttaatttatggtaggcttttcaacaagctggccagatttggttgatgtttctcaaaaactactaaaatttcaataaagtgaatgtctgtgaagtgctttgaaatttaaaagagctgttgaatgtgtgcaaagatttagctatagggatgttcaatgaatcactgattatcacaaagaaaatgtggaacaacctaaatatgcaataataggagtttgattaaatacattatactatatccataataattttgcccttttggttgcaagaatcacagatacagtcagacaatttcagaataataggtgcttttgcaaagaagcattagcatctctgctgcagggcgtagtcctaactcctacccttctcctctcaaggtggtttattggtataatttttaaagacaccagtgccccctgtttttccctaacttagcagagaagatctgacaaacctattcagtcactatcatgtatgaagcatctctcatattcataaagtgtgggcaagaggctggtatagggtaatagactttcccaactataataggataagagtgattgtagctatcaaaaatatgacagatctttcaaaagtatgtgaaattattaatttaatgatgacccgtaagtcatgattttatactatttggcatagcttcacaaaacacaattttcatatgtattgaaaactaaagcaaaggaaaagtataaaaatttttgtgtaactgaactgacatgatatcagtcataaaatctctgcttgacaatctcatctgtcattctttcaaaaataacttatttattaatgtcaacagtgatgctgctttgcactgtattgaatataaatctgttgttcttttggcatttgggctaaggttggctaaattatcttagtaaataaattagcaaagcacctttttttttttctttttggcaatctctctctataattcctctttacctgtatcagtttttctcttttcctcatatttctcaaatatatatcaccattggttcttctttctcttgattgagaatttctgagaaatgttggtccatagtaaccagtattccaaggttagatgaaataaccaggacttagtgagaaatgattgttcagtaccatggatagcagaacacttatttccccaaatactaacacatactcctccaaattttagctgcaccattgaaaacatttctttcaacatgtctttggctcaggctattattttcaggccaagaagttctagtcagactagccaggctggctatactttttaaactatctgtggcaaaggatcaagatttttcccaccactcgatctaccgtgtaccaatatgttcatcatggaaactgaacaacctgctcctgaatgactactggatacataacgaaatgaaggcagaaataaagatgttctttgaaaccaacaagaacaaagacacaacataccagaatctttgggacacattcaaagcagtgtgtagagggaaatttatagcactacatgcccacaagagaaagcaggaaagatctaaaactgacaccctaacatcacaattaaaagaactagagaagcaagagcaaacacattcaaaagctagcagaaggcaagaaataactaagatcagagcataactgaaggaaatagagacacagaaaaacctccaaaaaataaatttataaaaagttaaagcaaacacacaaaatacaagtagtaatttcttttttattattacataaaaaacaaacataatatagtctgccaaaattgctgtgacagttttaaacagccctgtgatggcatccagttgataaaagtgagtagagccccagtatgtgagagaggcagagagtttccctctgtgacttacctttccactggagatccaagcaacccaggccaagagagagcactttgcttctcctaatccctggagttagcttagggagagtcttggagaaactgtgaaggaaagacaccaggaaaagtggcagaagttttctcagaccctggatgagagtaggatgccattttaaatctgggtgcatacaaagtcagccatgctttggtgccctagcaccatggctacagaggcactttagtcttgtgccagagattgaagcatcttatctggagtggggtgggggcctccacagccagaactgtaaaaaagtgtctcagcagtagtctctggaattgtgctctctcccatcacaggcaggaggagagctgctacagttgcggtttcttctgagcagcaagacttgcagccagggccagcttggcaatctggaactgatctgtgtgtgccattgctgagtgccccatcctcctcccctgagatcgtggtgcaacagagccctccctgctccattcctaggcagaaatctgggtatttggaacacctgcttgcctggaccggtggtctgagccacaccacccttccttgatgtatatggtggtacagagagggtctctgtgctccatgcccaagcagatttctaggcattcagagcgctcattcacctggttcagcagcctgagccacctaccctccttgtgcaaagactggtacagagggaccctctctgctacatgcccaggaagatctccaggcattcagagcgcctgcttgcttagttcagcagccagagtcaccccacccctcatgtgcagagatctttgtgcagcggggctctctctgctccacacccaagaagatctctagacttttggggcattgctcaccaggaccaccaagactgtccaaagatcttggtgcaaggaatccctctctgttcacactcaggcagatcaccagacattctgagcatacagtcatctggttcagcagcctgagctgccccaccatttatggacatagatcatggtatagtaagaccctttctgctccatgctcaggcaaatctccaggcatttagaatacctgcttgcctggtgtggcaacctgggttgcacaaccccttctgttcgtagatattggtgcaggaaggccctctctgctccacacccaggaagatctgcaggcatctgaagcacccactctcctggattaggaacctggaacacagaacttggagcaaaggtggtttcctgactccacatttagacacacttctgggtgcctggtagccacccactggattctcacttgatactggtgcttgtgcttgcatcaggggacctccaggcagacctgcccaactggtcccaccctttatggctcctacccccacagtgctgagcagggacctcagaccaatgtgtattctatgaatcaacccattgcctgggcaacagagaacttccacttctaaatacagataccagccactttgaccacagctggctgttatctacaggcttgtaggacaaacttcacagcccaatataaaacctgttgaaagaagtgcatactgctatagaagaaaaactgaaagaccctcctcagcattcttcacagtcacaccccataaagcacgtaagggaaagagaataatagtaatgacattataaggaaagaaagataaaggaaaagtcctacctgtatgaaaaaaaatacaaaaattagaagtgccagtgtctccaggtgagaagcaaccagcacaagaattctagcaccatgaaaaaacctgaatgtagtgaaaccaccaaaagattgagctacctctccagcaatggtccctagccaaaatggaaactcagaaataataaataaaaattcaaagcgtggattgcaaggaagctcattcagatccaagacaaggttgaaaatcaacaaaaggaaatttctaaagcaacccaggaaatgaacaaaaagataaacatcttaaaaagaaatcaatcagagcttctggaattgaaaaactcacgtaaagaattccaaaatacaaatgaaatctttatcaatagactgaaccaagcagaagaaagaatttcagagattgaagagtggtcttttgaactaacccaatatggcaaaaataaatatgaagaattttaaaaatgagcagtcctcatgaaatatgggattatgtaagaggactaaatgtatgaattattggcattcctgagagagaaggaaaaaaacaaacaacctggaaaatatagttgaaagaataattcaagtaacatgcctaatctagctaggaagatagatgtccagatacaagacattcagagaatacctgtgagatactatgcaaaacaaatatcaagccatgtagactacaaaccatgtagtcaccagattgagcaaggtcaacgctaaagaaaaaatcttaaagactgctagaggttttccttaggcaaagatcttaagatctttccttaggtaaagatcttaaagatctgctagaggacagatcatgtacaaagagaaccccatcaggctaatagaggacttatcaccagaaaccttacaagccaggagagactgggggcctattttcagcattcttaaagaaaagaaattccaaccaagaattctatatctcaacaaaggtttataagtgaaagataaataaaatattttccagacaaacaagtcctaggggaattcattaccactagaccagccttaagagagatccttaagggagttctaaacatggaaatgaaagaacgatacctgtaaccgcaaaaacacacttaagtacatagcctgcagaccatataaagcaactacacaatagaaactacaaagcaaccagctaacaacctcatggtaggatcaaagcctcacttatcaatattaaccttaaattttaatggtctcaatgcacgacctaaaagacacagagctgcaaggttgataaaaatacaagactcacttcttatccaagaaaacaccaaatagcagatgacgctggtggagcgagggggcccggaggactcgggggccctgggatggggaaccacagtggctttcgtggaggttttggcagtggcatctgggctgtggtcacagccatggacagagctggggctgaggccacggagctcactgaggcaaggccgaggatgagtggatgcccgtcaccgagctggacctcctagtcaaggacatgaagatcaagtccctggaggagatctacctcttctccctgcccatcaaagaatcagatatcattgactttttcttgggggcctctctcaagaacaaggatttgaagattatgatggtgcagaagcagacccacgtcggccagcacaccaagttcaaggtgtttgttgccattggggactacaatggccacatcggtctgggtgttaagtgctccaaggaggtggccactgccatctgcggggccatcatcctggccaagctctccattgtccctgtgtgcagaggctacaggggtaacaagatctgcaagccccacactgtcccttgcaaggtgacagaccgctgcagctctgtgctggtgcacctcatccctgagtccaggaacattggcatcatctcagcccctgtgcccaagaagctgctcatgatggctggtatcaatgactgctacaccttagccaggggctgcactgccaccctgggcaacttttccaaggccacctttgatgccatctctaagacctacagctacctgacccccaacctccggaaggagactgtattcaccatgtctccctatcaggaattcactgagcacttcttcaagacccacaccagagtctccatgcagaggactgaggctccagctgtggctacaacataggatttttatacaagaaaaataaagtgaattaagcctgaaaaaaaaatacaaggctcatcagtctgctgtgttcatgaaacccatcttacgtgtaaagacacccacaggctcaaagtacagggttggagaaagatctaccatgcaaacagagaagaaataaaagcagcggtcacagcccaggtgctgtggctcacacctctaatcccagcactttgggaggccaaggcaggcagatcacttgagcccaagatttcaaaacaagcctggacaacataggaaggccccatcctttaaataataaacaaaaaagcaggggtcactattcttctatctgataaaacatactttaagccaacaacagtaaaaaaaagacaaagaaggccattacgtaatgataaagggttcaattcaacaagaagtcttgactctcataaatatgtatgcatcaactttggagcaaccagatttataagcctgctaaaagacttagacagccacacaataatggtaggggtcttcaacccccaactgacagcagtagacaggtcatgaaggcagcaaactaacaaagaaactctgaacttaaactcaacacttgaccaactagacctaatgaaggtctagaaaacactcaacccacaaaccacagagtatgcattcttcttatctgcacatggaacatactccaagattgaccacatgctctaccataaagtaagtctcaatgaaataaatatcaaatcaaccatactctcaaaccacaatagaataaaaatagaaatcaataccaagaaaatctcttaaaactacacaattacatggaaagtaaataatttgatcctgaatgacttttgggtaaacaatgaaatcaaggcagaaatttaaaaattatttgaaataaatgaaaacagagacacaacataccaaaatctctgggattcagcaaaagcagtattaagaggaaagtttatagtgctaaatgcttacctcaaagagttagaaagatctcaaattaacgatctaatatcacatctagaggaactagaaaaacaagaacaaactaaccccaaagttctcagaagaaaagaaagaactaaaattagggcagatattgagaatcaaattgagacccaaaaattcatacaaagtatcaacaaaactaaaagttggttctttgaaaggataaacaagatcaatacactagattaacaaagaaaagaagagagaagatccaaataagcacaatcagaaatgacaaagaatgacattacaactgatcccaccaaaatacagaaaatccttggagaccattatgaacctctctacacacaaaaactagaaaatctagaggaaatgataaattctgggaaacacacaatttcccatgattaaatcaagaagaaattgaaacattgaacagaccaacatcaagttctgaaattgaatcagtaataaaataaaaactaccaaccaataaaagccccagacaagagggatttacagccaaattctaccagatgtacaaaaagctggtaccaattttactgcacctatttcaaaaaatcaagaagggagtcccttctaacacattctacaaagccagcatcaggccaataccaaaacctggcaaagacacaatgaaaaaaagaaaattgcaggccaacattcctgatgaacatagatgcaaaaatgttcaacaaaatgctagcatactgaattcagaaacacatcaaaaagctaattcaccatgatcaagtagacttcattcctggaatgcaaggctgattcaatgtacacaaatcaataaatgtgactcaccacataaagaattaaaaacaaaaacaatatgattatctcagacacagggaaagcttttgataaaatccaacaattttttgtgataaaaaccctcaagaaactaggcatcaaaggaacatacttcaaaataataaaagcaatctatgacaaacccacagtcagcatcatactgaatgggcaaaaattggaatcattccccttgagaaatggaacaaaacaaggatgcccactctcaccactcctattcaacatagtactggaattggtagccagagcaatcaggcaacagaaagaaataaaaggcaaccaaataggaaaagaagtcaaactatctctcttcatggacaatatgattctatacattgacaaccctaaagactccaccaaaagcctcttggaactgataaatgacttcagcgaagtttcaggatacaaaatcaatgtacaaaaattagtagcagttttatacaccaatagcattcaagctgagggccaaaacaaaaatgcaatccgatttacaatagccacacacacaaaaaaatacctggaagtacatctaaacaaaagaagaactacaaaacactgcaaaaagaaatcagatgacacacacaaatgaaaaaacattccatgctcatagattagaagaatcaatatcattaaattggccatgctgcccaaagcaatctacacttttaatactactcctatcaagctaccaacatcatttttcacagagctagaaaaaaaactattctaaaatttatacagaccaaaaaagagcccaaatagtctaagcaatcctaaaaagaaagaacaaagccagaggcatcacattacacaacttcaaactacactatatgctacagtaccaaaacagcatggtactcttacgaaaagagacacgtagaccaatggaacagaatagagaacccataaataaagcctatgccatctgatgtgtagaacacctaaagccatctgatctttgacaaagttgacaaaaataagcaacagggaaataattgcctattcagcaataaataggactgggatagctttccagccatatgcagaagaatgaaactggatcccatatactacaattaactgtatacaaaaattaactgaaaattgattaaaaatttaaacataagacttcaaactataagaattctagaagaaaacctaggaaacaccaatctggacatcggcctggggaaagtattgatgactaaattctcaaaagcaattttaacaaaaacaaaaaatgacaagtggacctaattaaactaaagagcttctgcacaccgaaagaaactatcaacagagtaaacagacaacctaaagacagggagaaaatgttcacaaactgcacctgacaaaggtctaatatctagaattcacatgaaacttaaacaattgaacaagcaaaaaacaaataatcccattaaaaataggcaaaatacatgaacagacacgcctcaaaagaagacacacaagaaacatgaaaagatgctcatcatcactaatcatcagagaaacgcaaaacaaaaccacaatgagatagcatctcacaccagtcagaacggctgtgactaaaacatcagtaaacaacagatgttggcgaggctgtggagaaaagggaatgttcctacactgttggtgggaatgtaaatcagctctgccaatacagaaagtagttttgagatttctcaaagaagttaaaacagaagtgtcatttgaccatgcagtctcattaatgagtatatatcaaaaaaaaaaaaaattctaccaaaaagacacatgtactcacatgttcatcacagcactatttgtgataacaacatcaaggaatcaacctaggggcctatcagcagtggaatggataaagaaaatatggcacatatagactatggaatactatgcagccatagaagagaacaaaattatgtccttttctgcaacatggatgcagctgaaggccattatcctaagcaaattaacacaggaacagaaaaccaagtcctgaccattctcacttataagtggcagataaacatccagtactcacggacataaagatggcaacaacagacaatggggactactcaaggggagagggagagggtggggcaaggtttgaaaaactaactgttggctactgtgattaatacctaggtaatgggatcatttgtatcccaaacctcagcatcacacaatatatccagataacaaacctgtgtatgtacccccaaatcaaaactaaaaattgaaaaagaaaaaaaaagttttaaaggcaaatcctccattgatatacttactttgttacatataacgccatagacaatttattcccctcccccgcccaaatttgtttgccgaaacgtaatccccaatgtgacaatatttgaaggtaaagccttcaggaggttatttgttcccttataaaggaggccccagagagatcctcctcccctcccaccatgtgatgacacagcaaaatgatgaccatctataaaccatcatgcaccaaatctaatagtgccttgatctttgacttcccagctcccagagctgtgaaagataaatttctgttgtttataagctatctagtccatgttttttttatagctggctgaacaaactataatagatgacttataagtagttttcacactggccttattccacagaccagtctttgaatagtaatgactaaaaaaattaggactttttgtctctcaatgggttctataattagcaaccacaataatgtttcaagtacccaaaaaatgtcatataatgcaatcacttaaaatgaatataagcaaagaatatttactgatgtgctgagtttcttccatacattaatgggaaaaagcatattagaaaacagtatgatcccacttttattaaagaacaagagcaggtttaaagagtcagaaagtataatagtggttacttctgggtaatggacttataaggattttttttcctttgttgtttatgtttcattagctatatatgctaattttgtacagtggtcatatatttcttttatctaaatattaggactcattgaaatggattactattttaaaattgattattcattcaatatttttatatttcaatctagggtctgttactgagtccctaagtgcttttataaatggctggataggcacctctgtaaataaagtacgtagccttagaggctgaaacaatgtaagtgcacaggaaacatttattgtaagaaaatgaaaggagtgaagttctttggttcttatttttaaagcattatgtgtcaaaaatgtatttggttgagtgtcatcaatttcatgtggcctaacctaatgttaagtggagttacagctaagtaaaatgttctgtcccgctttgagttaacaatcaatcatgtgcttacactaaatggtggataatcattacttttatttattttataaaaatgtagtttggtatctccatttagaaaaaaaattacttcattaaaatgaatcaacttaaattgacatgggcttgttactctaaatttctacttgatttccttattgtaaattatcttcaataaattaatccttatctccctaggccaggtctttgacatgtctggaacaaaactcagccaaatattaaaatgggaggacagaaacagttcaactgaaacatattagcaaaatctaagttggatgaatttatgctttttaggatgcagagcactcatgaaattgacatttgtaaagcagcatttgtagcatattgattaaaaatattcaatatatggattttttaaacagtgaaccactcattactctaatgcctcattaatatggtgtcaatctattcagaacaatgcataatagcagtgcactttctcagcatgttattctattgttcaatttgaaaaacaacaacaacaacaaataatctcaagccttttccttaaatgttgggggtttgtttttcaaattatatgggttttgtggtactagaagttcaaattttactaatgtaaactacatttctctaactaaagaatcatggtcaatgtagagaaaattattattatagaagaaattgaatcagaaaaacacctttcaaaacctcctaattccctgccctgtccacaaaagagatggaaggcaaggaggtcaccacaagacactcagagcagcatttgctgcagcaactaaaataatgggagactcattccgttcttccttatttacctggaaatataagtaggaaaagatattttattttataattaaaatattttattctaatatttgctagggacaggaagatagaatagggaggaaggcaaatatatgatgcccgatggattctttggaataaaattccatagggaatgttcctagtattaggaaaaatcatttttaacatatagtaagcaagttacttgggatgtcataagtaggatagaagtcatatgaaagttataatagaagtccttttttcttagggtaaataaatataagtaggaaaagatattaatttttttatttattaaaatattttatttatataaaataaaagtaggaaaagataccctcaaaattcatctcactgtgccagcagggagccgttgaggaaaagtctattttcagtagggaagcttggaaagagctggccaagttgcaattctctcaagaaagtaacacctgcagagagcacacattactcatatttgggatactcatgacacatcatctagccccctcctccctgcatgttagcacacggtgagcacacccactttccagtgacttcttggtgttttgcttacagaagcctacattcagcatatgaatcatctagccctccgcaagaggctgcctggaaagaataaggttttagagaaccagccctatggattgatcattggttctgaccacacaactattatgacaagtgaaatagaataacaacaaacggctatgatttttgtctttgtggatggatttcatgggggggagggcagcagtagaaagtataaatgacatgaaagaaagaatattaagctccaaaattgtgcttaagtaaatctggaataaaaaactgcagcaggttcttattgctcaattccagcccatttgcagagaataaaaaggcaaagcaatgtgggtgaaaagcaaggaatttgccaccttagctttgaatactatttcatttatgagtttaactgtttccccaccagccttcactaatttcacttgatctccatcaagaaagatggagaaggttttgatgagcaaggcagcactgacaaaattagatgtaggattaaaaaagaaaaccaatccacaatgtaatgaattactaaatttaaagacaactagtgaattcctgggcaagcatgatggatgcattcaaacatagattcttgaatttgccacaatcctatgccccatagctatgacttttcaccaaaaagcaaatttttaagagccaaatttgccatcgatgtgagtgggttgcatcttatagtctttgaacaaaaaggacaattataggtacattgagttcctggttccttggaaactaatggtttcattctctgcagattgatcacgtcaaattcatcaggttcatttccaaaaataaaaatcccctgtatgagggaaattgtggatttcatgtcagtcttctcaggaaatatttattttatttcaaactataattccagttgatctgcctagcagaaacaagtgaaattgcttctgttatcattgagatagagtgatttccattttcaaatattccaaatggcatttacttgtggtaactgtaataatagagtaatacatttacagcaatgtgatagcaatatagaactactctgaaacacatgctgtatatctcatttctttagcctataagatatcaaaatgccaaacattacatacatatgtaattctcctacttaccacattccaggtaacttgcttacactgtatgttaaaaatgattttttcctaatactaggaactttccctatggaatcttattcaaaagaatccacctggcattatatatttgccttcttctctattctatcttcctgttcctagtaaaaaaaaaaaaaaaaaaaaagcaccgattgagaaggaagtgtggtaaggaacagaaaatagcatcatctgtcttcacttacagaaaggccttgcactgtaagtattcatcagacatttgttggatgttttccataatcacctcatacctgtgaggatggctattatcaaaatgtcaagagaaaacaagtgtgcacaaggttgtggagaaaagagaaaccttgcacactgttgatgggagtgtaaattgctagagccatagggaaaaacagaatggaggcctctcaaaaaattaaaaataaaactaccatataatccagcaatcttttatctgggtatatacccaaaggaaatgaaataagcaactccaagggacgtcagctttccatgttcattgcagcactattcacaatagccaagacataaaaacaatctaagtttctgttgattgaaaaattgattaaaataattagggtactatgtatatatacaatggaacattattcatccttaaataacaacatggatgaacctggagaacaagacattatgctaagtgaaataagccagacacagaaggacaaatactatatggacttacttgtatgtggaatctgaaaaaaaaggtgaatacatatagaatattgataaaagaaaaagttaggcagaattaaatttaaagtttaattgagcaacaaacgattcgcaaatagggcatcccccagaatcacagcagattcacagagactccagcacagccacgtagtgaaagaagatttacagacaaaaaaaaaaaaaggaaatgacatacagaaatcagcagtaaggtacagaaacaactagaatggttacagcttggcatttgccttatttgaacagtttgaacacttagcagtctatgagtggctgaagtatggccactgggattggccaagactcagttattgttacaggtgcatactcctaagcttggttttcagttttgtctgacttttaagctaggttacagttcatccacatggactcatatatagaagtatggagtccttctcagaccatatttagtttgctttaacagtataatggtgcataccatggacagggaagaggaggaaatgaagagacataggtcaaagggagcaaacttgtggttatataggatgaacagaccaagagatctactgtacagtaggaggactatcattaataacattgtattgcaatactgaaaatttactgagagtagatgctcttactatagaaataaaaatatggaaagtgatggatatgttaaattgcttacctatagtaatcatttcattatggctatgtatagcaaaacctcatgttatacaccttacatttatacaatgaaaatagtattgtaccagtgttaatttcttagtttggcaaatgcaccatggtaatctaagatgttacagtagggcaaattgagtaaagaatgtacaggaactctctgtactatctttgctactcttctgtaagtctaaaattatcctaaaataaaatggttctgcccctaacaaacttttgtcatcattttcactgccccagaggatcagactaagttacctccaaggctccttttaattttaaattgacaatttatgattcaagtaaggatcacttcctgtgtgaaacattattttatttatccagctaaatacaatattgctttttcagttcccttctctttttcttgtcatgctctctatgttatacatctatgttcatgtcttatggctcctattatatttgctagttctctaagcgatgctgcatttttaacttgatatttcctacagccctatggcagtggcctgcattcaggaaattccctctaaaattgaatgaattacaaaagcaatattcctgccaatgaaaaggttttgtactatgaggaatttaccagtttttcctctcctgaatattaaagaccctctgccagaagtagcttaaggaaacgactctttcccattctctattcagatcctctccacttttggtttctagcccttcatcctgtgttggccaaaatgatttgactactttatagaaagctgtcgttttaccaagaacacaatttttaagcctttccatccataaatgtttcatttaattcttaaagtttaggccaggcatggtggctcatgcctgtaatcccagcacgttgggaggccaaggcaggcagattgtctgggctcaggatttcaagacctgctagggcaacatggtgaaactctgtctctacaaaaagtacaaaaattagctgggtgtgtcgtgtgtgccaatattcccagcaacttgggaggctggggtgggaggattgcttgagcctgagaggttaaggccatagtgagccatgatcgcactactgcactctagcctgggtaacagagttacatgctgtctcaaaaaaaatttttttttaaataaaaaaactaccaagccagcactacaagaactgctaaaaggagctctaaatcttgaaacaaatcctcaaaatacatcaaaacagaaccccctcaaagcataagtctcacaggacctataaaacaacaataaagaaaaaaaaggtattcaggcaacaaatagcacaatgaatagaatggtacctcccatctcaatactaacattgaatgtaaacagcctaaatgctccacttaaaagatacagaatggcagaatggataagaattcaccaaccaagtatctgctgccttcaagagactcacctaacacataaggactcacataaacttaaggtaaagggatggaaaaagacattccatgcaaatggacacaaaaagcaagcaggagtagctattcttatataagacaaagcaaactttaaagcaacaatgttaaaaaaaataaagagaaacattatataatgataaaaggccttgttccacaggaaagtatcacaatcctatatacatatatatatatatgcacctaacactggagctcccaaatttataaaacaattgctactagacctaagaaatgagatagacagcagcataataatggtgggagacttcaatattccactgacagcactagacaggtcattaagacagaacgtcaacaaagaaacaatggatttaaactataccctggaacaaatggacttaacaaatatttacagaacattctccccatcaaccacagaatatgcattctactcatcagcacatggaacattctccaagatagaccagatgataggccacaaaacaagtctcaataaatttaagaaaattgaaattatatcaagcactctctcagaccacaatggaataaaattggaaatcaactccaaaaggaactttcaaaaccatgcaaatacatagaaattaaataacctgctcctgaatgatcattgggtcaacaatgaaatcaagacaaaattaaacaattatttgaactgaacaataatagtgacacaacctatgaaaacctctggggtacagcaaaggctgtgctgagagaaaacttcatagccttgaatgcctacatcaaagagtctgaaagagcacaaatagacaatctaaggtcacacctcaaggaactagagaaacaagaacaaaccaaactcaaacctagcagaagaaaggaaataactaagataagagtagaactgaatgaagttgaaacaaaaaagcatgcaaaagataaatgaaacaaaaaactggttctttgaaaggataaataaaactgatagaccattagtgagattaaccaagaaaagaagagagaagatccaaataagctcaattagaaacgaaaaaggagatattacaactgacaccacagaaatacaaaaggtcattcaaagttactatgaacacctttatgtgcataaattagaaaacctggaggagatggataaattcctggaaatatacaaccctcctagcttaaagcaggaagaattagaaaccctgaacaggccaataacgagcagtgagattgaaatggtacaaaaaaaaattgccaacaacaaaagtccaggactagacggattcacaggtgaattctatcagtctttcaaagaagaattggtaccaatcctgttgacactattccacaaaatagagaaagaggaaatcctccctaaatcattctatgaagccagcatcaccctaataccaaaacggggaaaggacgtgacagaaaacaagaaaactacagaccagtatccctgatgaatatagatgcaaaaagtccttaacaaaatactagctaactgaatacaacagtatatcaaaaagataattcaccatgatcaaatgggtttcattccagagaagcagggatggtttaacatatacaagtcaataaatgttttacactacataaactgaattagaaacaaaaaaaaatcttaaaagtctaggctttctgcctttactacacagagttgatcaacttcatctgctactttttctagctctaaatctgattcacaatcattacaacccaggaaacataataggtgcaacactcttttctgactctttaatagattgtttccatttggaaaaaaatctcatttatttgttggatatggaagctgtttcataaattttccagatctgagtgagaaaaagaatatttaagtgaagattacccataaaattttgaaacacacatccctttttttttcttggtagaagaataagatttcaaattttattttcaaaaacccatcatagaaaataatttttgttttctgtatgcctagcaaggagaaaatctagatccagatttagaaaatctggaccggctaatttttgtatttgtagtagagatggcatttcaccacgttggccaggctggtctcaaactcctgacctcaggtgatccactatcctcagccttccaaaattctgggatgacaggtatgagccaccacacctacagcatgggtgacagagtgagattcagtctcaaaaaaaagaaaagaaaagaaaatctggaccatagtctgacatacttcctaattgcccggagaatttatgaatttatattgagtcttaacagtgaggccttagacagtgattcagtttcctcagtgctagtaatcaaattctattgcttgtgacaaacacagaagataactttagcagataatataacatagcagataactaagtgaacaaatacacttttctatagcaagcataatctagcaaatactaccttgttttttattgtgtaagaacacttaacatgagatctaccctcttaaaaagttaagtgtatatttgttttgttaactataggcacaatattaaacagcagacctcaagaacttatgatcttgcataactgaaactttatagcctttaaaataggaactcttcattttctcttccccccagcctctggtaaccacaattctgctctctgcttctgtgtttgactgttttagatacctcagataaggggaatcatgcaatatttgtccttctatgactggcttatttcacttagcaaaatatcttcaagtttcattcatgtagttgcatatcgtaggacttcctccttttaaggctgaataataacccattatatgcatataccacattttcttcatttattcatccatcagtggacatttcattgtttccatatcttggctattgtgaataacagctgcagtgaacaagagagtgcaaatatttcttcaagatcctgatttcaataattttggataaatacctagaaataagattgctggatcacatgctatttctatttttaattgtgtaggtacctccacatagttttcatagatgcagcaccatttttcattcccaacaacagggtaaaaaggttccaatttctccacatccccaccaaactattatcttttgtgccatcccaacagttgtgcaatgataagtcactgtggacttgatttgcatttccctgattgtaagtgatgttgagcatttttccataaggttttttggccacgtgtatgtcttctttagaaaaaaatgtctatttaaggactttcccattttttaatctggttatttctatacttttgctaattaagttgaaagagttccttatatattttggttattaaccccttatgagatacatggtttgcaaatattctcttccattacatagatcgtcttctcactataataatcatttcctttgctgtgcagaaactttatagtttgatatagtctgttgtctatatagtctgttgtctatgtttccttgtgttgcctatgtttttggtgtcatatccaacaaatcactaccacaaccagtgtcatgaagcttttctcctatacattcttctaggagttttacaatttcatgtctcgtgtttaagtcttcaatacattttgaaataatttttatgtagggaaagataagggtccaatttcattgttttgcatgcagatgcccagttatctcaacaccattggttgaagagactctcattttcccattgtgtgtagtcttggcatccacatctaggatcaataaaacatatatgctcgtgttaacttctatgctgtctattctcttccatcggtctatatgtctctatgctagttgaattttgattactgtaactttgtaatatattttgaaatcaggaagtgtgatgcctccagctttgttctttttcaagattgctttggctattcagaatcctatgtggttccatattaattttagaattattttatttttctatatcagcctaccttcagatatcaacacttccttctgtcagataatatttgcacatcctgttctctgtagcctggaatgctctcctcctctcttttcactgccaccattataccacttatacctgcttaactgctatccatcagatctctgctgaaaagtaattccttagaatgtttttcagtaacactgttcacctccccactgccccttcccccccacacacacaatacctgaaatctctgcctacctaaggcaggtttttcctgagttttttctcaatggtataacatttgggactttgataggaagtatgataaatttgcagattgcacaataagaagtaaggacatttgaacaatattaagtcttccggtccatggtccatgtacacaggacacctttccaattgtttgtgtctttttctttcattaatgttttgtggtttttagtacaagtcatttaccactataattatgtttattcctaagtattttattctttttaatgttattgtaaatgggactgttgcttaatttccttttcagatattaaaaatgattcattattaatatttagaaatgcagctgattttgtatgttgattttgtatcctgtgactttgctgaactcatttgttacttctaacagtgttttttggtggaaacttcagggttttctatatatcaggtaatgtcatctgcaaacggggacaatttgacgtcctctttttcagtttgaatgccttgtgtttctttttcttgcctaattgctctggctaggacttccagaggagaagtacctaatgtagatgacaggttgatgggtgcagcaaaccaccatggtacgtgtatacctatgtaacaaacttgcacgttctgcacatgtatcccagaacttaaaacataatttaaaaagaagggtggtaaaagtgggcatctttgtcttgttctggattttagagaaaaaactttccattttcagcattgagtataatgttaactttgagcatttcatgtatgtcctttagtatattgagttagtttccttctattcccaacttgtttagaatttttatcataaaagggtattgaattttatcaaatttcttttctacatttattgagatgattgtgtggtttttaccctttattctattaacatggtatatcacattagttgattttcatatgttgaatcatccttgcatcccagggataaatctcacttggtcatggtgtctgatccttttaatatgctgttgtatttggttggctagtattttgttgaggatttttgcatctatgtttatcagggttattggcctgtagtttgcttttcttacagtgtctttgtttggcattggtatcagagccaaggtattttacttggtattttaatatttggcctaataagatgagtttggaagtattctgcttcctagattctttggaagaaattgagaacatctttaaatgtttggtaggagtcaccatttgacttttctttgttgaaaagtatttgatcactgattcaatgtccttactagttataggtcttttcagattttctattgctcagtaattcagtcttggtaggttgtatgttcctaaaaatacagccatgtcttctaggttatccaatgtactggtatataattgttcatagtagcctcatgattctttttatttctatggtatcaattacaatgtctctgcttctgttttcatttatttgtattctctcttttttccacagttatactattggggaaagttatactaatatcttgttaatcttatcttttaaacaaaccaattcttttattaaattttaaattatttttctattatatatttcatttggttctgttctaatctttattattttcttccttctgctaattttgggcttaatgtattctttttctggttctttggggtgtaaaattaggttgtttacttaagatgacctttttcctatgcggatgcttccttccatttctcctgcccttggacatcagactccaggttcttcagccttcggactcttggacttgcatcagtgctttgctcggggctcttgggcctttggccacagactgaaggctgcactgtcggcttccctgcctttaaggcttttagcctctgactgagccaatactggcttcttttctccccagctcacagacagcctattgtgggtatttgccttttgatcatgtgagacaattctccctaataaactccctttcatatattcatgtatcctattagttctgttcctctggagaaccatgaataatacagcacataactggaacttgaggtttttaaaatccatttagctatttctaagtcttcatggagagtttaatccatttacctttaaagtaatcattgctaaggaaggatttactattgccttgttgttaattgttttctgtctgacctgcaattcttttatctctggttatcttcctttgtattttttaaaattttttatattgatattttatattgaaattttatattgatattttatgtaggtattatctttgtggttaccaaaggtttacataacacaacttttattatgttatctattttaagctgataacaacttattttcaatcacatacaaaaatccctgcccccacatactttgttatattattgatgtcacaattcacatgtttttatattatgtatcttttaaaatatttttataggtgtggttatgtcagtacttttctggcttttaacttttatcctgaaagtaaaagtaatttacacagcaccattacagtattacagtgttctgttttgtctatatatttatcttcaccagaaatttttgtacttccctttccttttgttctgtcatttcacatcattttgtttcaacttaaagaactcccttaagcatttcttgtaaagcagttccggtagtggtgaatttcctcagcttgtgtttctttgggaaagtcattatctctccttcatttttgaatgatggtgttggccatatatagtgttcttagttgacagattttttttctttcagcacttttaatatatcatcctgctctctagtgacatgcaaggtttctgctgagaaatctgctgacagccttatgcagattccctgtatgtgataagtcatttttttcttgttgctttcaaaattctatttatctttggtttttgacaatttgattataatgcatctcagtgtggatgtctttggatttatcttatttggagctcttaggcttccttttttcctccagatttgggtaatttccaaccattatttctttgaataagctttctttccacttctgtctctcttcttgtgaaattcccataatgcatatataggccacttgatggtgccctataagtcccttaagtgagcttttatcactctttttcatttttttctttttgttcctctaactgaataatttctaatgttgtgtctccaagtttgctgatcctttcttctgcttgatctagtctgctgttgaatccctctagtgaatttttttagttattgtattcttcagctcattgatttctgagctggtttcttggtagtcttttttaatgttttctatttctttgttgaaattctcactttgttcatgcatgttctattgacctcattgagcatctttctgatggttattttgaattttccatcagagacataatatatctccattgcattaagtttgatttctggagattaatcttgtactttgttttggacatatttacctggttgtttttcccttggttcttcattttagtatatctggatgttatacaaaacagctacctcttccagccttcatggactggcctcaaacaaaagaagaccttcacctatcagcctgaccagagattctgggggcttctcaaatctgtatgctaggcaaaaccatcagctatgttcttagtagctcccagatgtctagaatatgctgggactcatctgcattctaagacaagtgagacagaagccagttcctcaggcaatccctggaaaaattgaaacgttaaatatgtgatccaactcttttcttcctcaggaagtagatgagatctgtcgtttttctcccacttgctctgtgctgagcaagaccctcccaggtctgtgatgggggccggcatgctagttcaaacagccatctttatttttagtagctccaggtgtctggaaaattgctgagtctcatttgcactctgagacaggtgagacagaagtcagatccttgggcaacccccaggaaaatcagaatgttgaacacataatgtagttctttccttccctctccggagagaagctgggaactgggggtttcctcccaagcatatagcaatacactgagggtggggattatggttagaggatgtctcaaagtttcctatcagcttcagtgtggttggttttttgttcacttcagatccaagagcttctaaactggcttctgaatttattgcaaaaggagttgacctgtgtattggttgttgaatcactgggtttatgatgggaacgaagatccaagtcttcctattctgccatcttgctgatgttactgtcctctaattcttgaatgccttctatgtaacagagaattttcatgcacactatctcatttacttttcttaaaattctgaacaccaagttgacaaaaactaaatcgtaaagtataagatttagtaaaaatgtaggctcaaaatttttaatcacaaagctggtaagaggatttgaactcaggtacccaaagcagagtgtagtgctcctctacccagggtgtcaaggagatgtgtcaatgtgtagcacatggtttatgttccttgggtttatttaaagcctctgagcctcatgtgtgtgttgctgtagtagtggaaaccactatcttgctaagaaggcttcacattggatggacagcaaattaccttttccattcattcacctattttcatgctgaaaatacttctcaatatttttgagtcaataaacaagaatgacttgttaaggctaggcttaccctagatggctcaggatcttgctggtggaactatttatgcctgcaaactatgaaataaaacttttgaaaactaaggccttgctaccagcatgtgtcttgtggatcagcagcattagcaccacatagaagcttattagaaatgtggaattgcaggccgtatcccagacctcctgatttcatatgcctttttgtttgaaaaagccctactctaaagcacaatatacattttgatgcttttctcatgatgtaataattttctagtatgtttgtgactaaatgcagtcaagaaagccctcaatttcttatttttctatgttcccttattttaaaataataaataatgaagagagtcttcattgcctgttagaaaacaatcacttatttacaacaatagctttacaagtccagcaattcatctaaatgcccaatttgccctgtagctctacagcatgcccacagagccaacctaggtaagctatattctttatgggaaaaaaagagaaaaataagttgatttggtaagtttttgaagttgaaacattgtaatggaaatatcactggactgggttcaataagacctacgtttaagtaagaattttccttgaaccatcaagatattcttggacaggactctttccttttctgggtcttgggtttcctcatgtatattaagaagttggcataacctgtgctccaaggtcttttcccacgcagaacatttgctaatttttctttaatagatctctccttgttccccttgtaaaccaaaaataaaattctcaggccccaaccatctaaatggacttcctcttcatccagggcactcttaaattttaacttgagacaccagttcttgtcatgacaggaagctggaggtcagacatgcctcactctacctctctggcattaatatgaatacagactttaagcctgataagaaacattttacagcccattctctctgaagcctactaactgaaggtttcctctgcaaataagaactttggtctccacaattctttatcttaacccagacatttctttctattgatcccagatctttacataaactcaaccaattgtcaagcagaaaattttcaaatctacctgtaagctggaagcacaagctccaagttgccctgccattttggaccaaaccaatgtatttcttaaatgtatttgattgaagcctcatgtctccctaaaatgtataaaccaaggtgaaccacaaccaccttggacatatgtgctcagtgtctgccaagggctgcgtcacaggccatggtcactcatttggctcagaataaatctctttgaatattttacagagtgtgactctttttgtcaacatcttcatctcctcccccactgctatttcctagtccaagtccttcatttattgctatagcttttttttttttttttttttttgacagaatctcgctctgtcgccaggctggagtacagtggtgcaatctcggctcactgcaacctccgcctcctgggttcaagcaattctcctgcctcagcctcctgagtagctgagactacaggtgtgcgccaccacatctggctaatttttgtatttttagcagagatggggtttcaccgtgttggccatgatggtctcgacctcctgacctcgtgatccgcccgcctcagcctcccaaagtgctgggtttacaggcgtgagcaaccatgcctggcctgctacagcattttaactagtctcctgattcctgctttcttggtttcctgcttcctcagttcaactagtattcctttgttcccaaaagaaaagctgaccatgttcatctcatgcctggaacactttaacagccccaaggctgtttctgttgcttgaaggtgctatgctcatcttctgtccctaaccacactgctactttccatcccctcttgcctgaaatataccacacacaccagcctctttacttagcttaatgttgctcatcttttttcttttgagacggcatttcacccttgttgcccaggctggaatgcaatggtgcaatcttggctcactgcaacctccacctcctgggttcaagtggttctcctgcctcagtgtcccaagtagctggaattacaggcatgcttcaccatgcccgactaattttgtattttttcagtagagaccgggtttcaccacgttggccaggctggtctcaaactcctgacctcaagtgacccacccgcctcggcctcccaaagtgctgggattgtaggtgtgagccaccacacctgcccttgctcatcttttaagtgtcatcttcaccgtcactggtaaaatactcttgctgccatggtgctctgtgcttttagtcataatatttgttgcttcttactgttattgcttatttgtaacttatctctgtgagggctgagaccagtgttccgtgctcacaatcatgttcttgtagataataccaagtaagcactaaaaataattgcttgaattgcctatatgaattcttgtcttctacttccattgttgattaaataataataagctctaaatattgctttaaggaataggcataattcactcaagacatgtagagaaattcctggcatatattattcacttaatgtatgctagctattacaattgttattattcttttctctctttaattacagcagtcagtatgggcttaattataattacctgataactaaaaatttctttcttactttgaagctaaatggaatacttaaaaatgtagatgcattaatcaattaaacaaatgcatcaggttaatagtatttcttattccaatgaaacaaagaatcatattgttatatactatatatataactcatcatattattataaattatgcaccaatatatttgcaaaataatgcattgaattattattaaattcttctgcaaatggtgtgtgatttgttttctcaaagcttaacttaatgggaaaggcttgagagaaattgtcattgtaaagaaaataaatcctggatacttatgacctaaaaggaaatctggcatgtatctcttaatattcttagaaattactcaaaggttcagcttttattaattcataactcttcaaagttatgaatcaatagatcctaaactccaatctcccatccaatatttgaatctctgtggcaccatcttagcccggtgaatgaacagccactgcatggaaagggagaagattaaagctctattagttcccatagcaacatatgatttattaaagttttatctatgatttttttaagaatgcattctctgcaaatcagaaacaaattataacatagtcatagaagaaaaaatgaagatggatggtggataaggaaacaattgagatatttatattagtttccttctttgtcaggcattaaataattatacaggtaggagttataaccagaaaagatgcaaaatatcagtcttattctatcaccattatatcattcaatattactcttattcccaatttacaagctttcttcattgtctcctagctattctttgttgatattctttctctccatctgattcctccttcctccctttttactttcatgcttctcttcctactagctctctttgtttgtccaggtattctttcatttctataatacaataatatggttttaccttaataacccagaaactgaactataataataaaaataaatactctgacacaggaggggtaggctggacagccacagtgagaatatgtggttaaaggctcaaaacatgtaggctggttatgtggatggatagataaatttaattttacagatatttctcaagttccaaacagtaaagtactatgctgtatactgtgatagatgataggtgaggtctcattttctgtacttcaatggctaaaatctcccagaaattttatatacagaactaactaaacatagcacaaaggagatggtaagaaacaatgcaaagagaggaagaagtgagaaaaaagaggcacagcagaagagagaaggggaatcttatgcagggaggaggaaatagaaataaagtagttaacaaatggaaaattaacatggactacaagaaaggcatgtttcagaacttcaagcacattaacattggttttttcaaatcatgtggatctaacacacagccactggtgaaaatgctgcgtgctatgactttattcagtttttttgttttgttttgggtttttttttggagactgagtctcactctgtcacccaggctggtgtgcagtgacacaatctcggctcactgcaagctccacctcctgggttcaagggattctcctgcctcagcctcctaagtagctgggattacaggcacatgccaccacgcccagctaattttgtttttttttttgtatttttaatagaggggggtttcaccatcttggccaggcaggtctcctgacctcaagtgatctgcccaccttggcctcccaaagtgctgggattacaggtatgagccaccgtgcccagctgactttatttagtctttattataaattgaataaaacctttgtaaatagagatattttgtttgttgtaacctgtgtggattattgtaaattagcatgatatacttgtttcagaccaccaataacagccatcttatgaacagaggctttcaaataataggcaaatgtgtgaaaagagacttaaacatttctgtaaagaattctatgaaaattttcaacattgtcattagaacttgtaccattaaaattttctaataataaaaatcatttttaaaaattattttaatgatgctaaatttctatttttcactttttgaaatacatatggtagcaagcaataagaaaatatttaatgatgacatgccaattaacaagttcaatatgtcaagtaaaagtaataatgtttccttaacaccaaatagcacagcatgatttatataaatgcccatccttccaaagaatggaatcctttcacttggtgcaataagttgaatactgtctttttacagctgttctcaaagacaaagatatttttgagcttcatttataaaacataaatatcatattgttgttccagccttcttgtaattcaaaatagcatcagtgctggctgaacatattactcatgcattggaaagttagaaatggtgacaatttgaagttaacattgtgaaatgaagatgaacgtgcaaaatgttctagctatattctgttttatgtgaataacctgaacatatttcttctttatatattggtttaagaagatgttataaatacctaacttggggacagaagaattttagtaaaggagaagagacatttaaaattacttctacgtcttactctaagaacaatctgccaattagtagagttgtatgtttccaggtacacagccatgtgtcctaagattcagacagaaggttgtgagtttacaggaagaaagaaatcgattctttctggggtatcctaaaggcttctcacagaaagtggcacttgaatagtgtcagatatttgaagcagggacaggatatttcaacaagaaggaatgcataaataggacatagacagggaagcagccggggcatatggagactggggagtttggctatttaatggggttcatggaggttgtgacagagaagtagtgtcagataagatggatggtaaataggggactaattgtggaaggttttgagtgctaagctaagtaattcagtttttatttggtaatgaataagaaaccccatggttttttttcccccaagttttaaaatgctgaatacacacatgatcagagctggctatttattggatacttagaatgcacccagctatgttaggtggtttataaatattatccaatatgatcatcacaaaagtatggttgaaagaagtattaaccccatttttcagatgagagaactgagtctcaggctatataatttgcctgtgtacaacaatctaacaagctgatttttttaatcaaaatctttttgttcattactctacataatcctgttgttttcataattctattgttttaacaaaatcctgttccactataatcctgttatgcttcataatctagtattttgaagaagataaaaatagaaaagattgagaatatgtcagagactattttaatagcgcaagaagtaatcattctgattcagttatgtttgtcactagttcaagtaacggcaaatctgagttaccatggtttctgaaaaaatgcacattgaaaaattgtatgatggttattttagatttttagcatgatgttgaggtttcctatgcaagggaaattttaaatttgttttttgcctgttggatttcttatgttattcagaaagttttgcaatgcctataatgggaactttcctagtaatatgcattaaatgtaatttccacctttttagaccatcaaaattaagcacatagtgtgtgtaacatctaaactatggcaagcaccttaattacatttttcctcttaatctcacaacaaccttgtgatgttggtgtccttctcccattttatagatgaagaacctaaggctgagagaaattctgtctgtatacgatgcaaccaacgttcatattcagccctatttgtctttaaatcactactgtttccactacagccaactgccctgtaactcctcatgtaataaaaacgactgatcttaaagtgataattcatatttcatgattgaaaaagaataaggaatcatccgtggcacaaacctgaaatgcagggagtgtagaatctatgttaatacataggctttgggatcaaaggaatgtgagattaacgctcatatccaccatcttaaagctgtgtggccttggatgtattacttaatctttcagaggctcgactgctaatctgaaaagtgcaaatagtaatatctacttcagggagttgttaagaggattaagtgaaataatgcctaaaaagtacttaacacaaagtaggctctcaataaaagtaagctctaggtgcatagcacactatgctatttccttgattctcatagcttcatctctgagtcaatcacttccaaatattaggtccaaacctctcttctgaattctggatccgtgtatcccatcacctacttggcatctgcacttggatgcccacagtcatctcatactttatatatatcaaactgaactaatgatatatgtcaccctccttccttccctgctagtatgtgctctcctgcttttatggtagtgaggtaggggtgagtgtgtgtgtgtgtgtgtgtgtatgtgtgtgtgtacaaaatcaacactgtaaccagcccacaactaatccattcttaagtcactcagtgctaagggatatgccttctaaattccccccaataccaccctagtcctagtggccatcatttctctcctaactaatgcagtcatatccactgctgcctatactcaccaaccagttagccatactctaaccagagggaccttcctgccccttgagttttaagattggcttaaagtcttattccactttgatggaaatccaaatcccccttggagtttttgttaatttggtgtaaacattcattcttataaattcttcttccctcaggagccaacttccacaaatactgcttctgtgccctaacacctccaggtgaaacccagccctttctacaagttccatggatgatccactcatacaaagcatttgtgaacgttgggactcagggtgacggagaactatttgctattcagaatgtgaactccccaatggtgcattagatatttccagtcttgaatgtcctctgccctcctcaccatctggatgtttccattggcagattgccccttcttcatcccagcatcatatcatcttgggggctctcatcttataccctttttttattccagatttctttattctttattctttattcaaatccgttgtaatttgaatcccagtttggatgtctggtttttgtttgcttgcctaggttcctcaattcaccccatcagtatttccttctatcccaagtggttagttaccaagtatttttccaataaaactttccacccccaataggaattctggagccagcaagtaacatcataaagtttttgcttctattacagaaggtaaatcagatcatcccacacccctgctgaataacccataagtgtcttcccatcgcctttagcataaagcctctaacttttttagaagggtctacaaagtttcccatgatgccacctctactggccattcaaatgttattttggtttctcatccacattgtgctttctccagcacccaggccttcacattcactgtccttaggtcctgttctttctctccaactaatcatcaggtcaactcttaccagcccataggtctctgcctaactagcacttactctaggctgcagccacctgctaggagctccttgatcatcaaatatttcttaacaatgctttttccacttgcaattatctagttatttaaaataatgtatttcctctctctccacagactcaaaacaccactagaacagaaaccagatttcttaactgtcatattctcagcaagaagcatacagcaggcactcaattgttaaaaactatctgaagtaaacattgagtcaagcatctgtgtaaaggattgccctaaatctcccttaacttctgggctttaatttattctgcctatatagggatcagtctttcagaagacccagaaaaccttagtgaaggtggagggcttattaaactatttgctttaaagttctgacaattttgttgttgctgatattaacaacccaacaagaaggggagttaaagggcagtgcttacaaaaggtcacaatatactgcctaaatatgctgtgagcttcgtaagtaggctgcactcttgttagctatcatcaggatttaattaactggtgtcacagctgaattgacatttcatgcctgtggggaaatttgactgaactcatccattccgaaataaatgattagcaccaccatctttcacattatctttcaataagtgggacagctacattttcacaacttgctggggaaaaaccattttcaaactctaaataccagtaagcatggaaaagaaggatggaaaataataaagtcaggcaaaatgatatttgtgggtgcttcattttatgaaaataaaacttgtttcagaggcagaatgaacctgttaggaacccctgtttttcataacaaattatgccagaagaatgttgcatagttttggaatttgcctgatcactgaactgttgagaacaaatgtattttatgggttcctgggttgtgggccgaccccctacccagtcagacaccagccaagcacagcttccaggtctttaaacttctcagcacagtaggccctaaaactgttcccatggtaaccttccatcaaacaggcgagctgtaaaacaggtgagctcaggctgtcatttgcagacaaaacaagaaaaagaaatactgactgctcttgttcgtgatgccacaaagagaagtaatactgattactgaataaatagactgaaagtcagaatagctgttgaactaaataggaatcatggcgttagtgtcctgacaaaaaaaaaaaaaaaaaaatacagcttctaaaatgtgtatgtctcaaagaaaatcaatgagaaaacagatcacaaattttgtagaaacattagttactgtttttggaggatctcctaaatatcggatccttggatggaaaatttgcatgtatggtttcatttgtccctaccccctaaaaaactgtcataataagcttttagtatttccatgatttaccttaaataactgaggttcaaagaataaaagtgagagactgtcacttaagtgggatttgaacccagatctctgtgtctccaaaatttctgtttttttcatgatgctacactttttgaggatttatcaggcatattctagaagaagtcagtcacagtttgtgctgagggaatttgccaccaattaagtacagatatgaaaggtagcatttgggaaatcatcttggctccaggatcttacagtctggggactgtagtacaatagagtcacaaaatctgtagttataagaattgccttgagtactagctcctccacaatataatagggtagccttgagaaatccatttaattctttgaacctcagtttcttcttctgtgaattgagacagtaacttaacggaatgttctgaggatcaaaggagaaaatatatttgaaagtgctttctaaaatataaaatttggtatatgactattattattaccctacatatcacataaaatcttggcacttctttttggcagaacaatttcttttcacttaaaactggcaggttgaattctttcctcaagtgtgttttgtttaatctccaaaattaggagctgtgcagagcttccagcctgagttcattttagaagtcaggaaataattgctgcattattatatatattgaactgtcattttacacatgcacacatggcaacttgatgagaaaatatcatttgtacttattttaaattaatgcttaattggtgacagactttagctatcacctacactctggttgggccaagaaaatagagtatgatctagaaactgaaggacaaaagatgagtaatggtcaaggaaatggcagtgcaaggaattcaagggctataacctggcagcctacaggctggggcagacctgccaatgtattttctttggctagcaggggtttattttgttgtaattgtgctttttaatgatgttcttaaacagtgcatgtaccctccagtctgctaacattccatcatttgtatcctcttacacctggctgcctctcacatgtatattacctgcctgacagtaattgggagatgggagtccctttaccaaacaacaggcaaaagagatgagttttcttcattttgaaaccataaagaatgtatctattgggaagctgaggtgggcagattgcttgagcccaggagtttgagaccagcatgggcaacatggtgaaaccctgtctctacaaaaaatacaaaaaaataagcagatttggtgtcgcatgcctgtggtcccagatacttgggaggctgaggtgggaggatcacttgagcctggggagtggagattgcagtaagccgagatccggccactgcactccagcctgcatctgatcatttaacacaggaaagactgagcatgcaataggctcaggcaccaaatcccacaggagtagagaactggcatactctatctgaaaggatacatttaggatacatattaaaaagtctagtaatccacagcccattgtaaatattctaattcaacaagcatttaagaacctgccatatgatcttcaggaaagtttctggcacagagtaagtatgatgtaagtagatgctctttgttatgtcatcatcatcatctttattatcatcattgctattattattggtcagacacaattctaggaagggcaaaggctcctaactcctgtcttcctctttgctcccaaatagagggtatccccagtgttctgctcagtttctgatgcatgcttgttgcccaaaatatatctgaggaatggctgcataaataatggaagactagagagaggccatctctggcctttgagatcaacagccaaaatctgctctgacaatttctgagagttgtgaataattctagccaggtgtcagaaggaacctggcgagtgtagccccgggactctgattttcctgaagaaactgaaaagaaagaatacccaggtggaaaaggtaccctggtagctggacaggatgtttagtggatgcattatgcaatgtctgcagagaatcatggccataagtgctatgtaagcaccaaacatcattaatattactatttaaaagaactgagcagcctattccttcctaggtggtaacctgagcacagcagaattttaataagtctgatcatttattgggttgccagctggagcactgaccatgctctggatgtacgtcacacagtctgatttggtgcaatcaacactggctctgactcagcatcttacctgcctgaactattgcaacaccctccttactgcctattggccttacatcatcccagtcagcctgttattctgcatactcctaattatataagtcttgctaaactgtaatggaatcatatcacttttctgcattacaagagttcatgatttcctttggcctaaaaaatatccaaactccttagcaaggcgtgtcttggtcttgggtcaccagcactctattctgatcatcctccgttgatctaaacactctagaggtctctggatgctcttcccgcttaacaagtgccttttctgaaccagattcccctggcaaactcacgagcatctttcatacatcacttgctccctgaagccttccctcacacccatctgcaggagcagaattgagggctttcttgtctacatgtccgtggcactgaacagttctcttgtattggccaggatatttggatgcaaatcttggaagtctagatcaaacaaattaaagaatatgttgggctttattcactcgtgtcaccaaactgcacagtggctgagcctttggatgagtgtgaccaggacctcagaccaaatcagggagtctaccactagcaactatcttcatggggcagaaattacaaacacttcagctctgcattcatacatactgaaagccagaaaggaacaagagctccttcccatgaattctagttataaaacttcagaggaaccactctggatggcctggcttagtccacatgagcatcacaggaaggggaccaggtgccatgattcccctagactgcttcaaggtgcctgctcagacccagtgacagggtaacatgatcagcaacccttgtcaggccctcattagatttagagtgggaaagaagcagtgtcccataagaaggtgcaagctcagatagaatttcagacaggcagaagagtaggtgtcatctggactgtcattcaaattcgataactaataacacttcagatcctaactgtgtctgtgagtttgcctctcactacagagtgagctcctagagttccagtacccatcttactcatgtgcctctgctcacacctagcatgatgcctgttgcccggttgccacttagctcatgcttgtgtgttattgaattaacaaatggatagctctccagggccctgtgaacaaaacatccggtgaacgtaattaccgaattctgtagtgtttggaagttagttaaacaaatgtttataaaaccgctataatttaaaagacattgagtggctcatgcctgtaatcccagcactttgagagtctgaggcgcacagaccacctgaggtcaggagtttgagaccagcctggccaacatggtgaaaccccatctctactaaaaagtacaaaaattagccaggcgttgtggtgggcacctgtaatcccagctactcgggaggctgaggcagcagaattgcttgaacccaggagacagaggttgcagtgagccaacacggtgccactgtgctccagcctgggcaacagagtgagagactccatctcaaaaaaaaaaaaaaaaaaaaaagcatcaagtgactcaaaactaaaatataacacaataacctttgaaatacaactagtatttattgagttcatagtgttagcatttttacgaaagacattttatgctcacaaaaattccatgagttttagcaattagccctattttataaattaagaagatgaagttaagagatgcttggacttcccctagttctcacaggtaaaaggctacagaggcggaagagaaacccaggacttctgatctcaaggctattgctttgctcttaagcaagttatttaacctgtctgggtaaaatggagataataactcttgtttctaaggattgctgtgaggagtaaaagaaaaaacatatataaacaaatgagcacatagcctggcccagatgagggcattaatggacaatagtgctaaattttcagtgatggtgggagctttccttcaattctgactagaacatatctctgacccgtttttgtccttgccccgcagcccaggaactcgtcctgtgttattctcctctttagtgccacccactctgtctccagtagcttctctccccgaagactgcttccagaacaggtcacaggctcctgggctccccttcttgctgaagccaagtgcccagaccccttttgctgcctcggttagctggccccactggttatggaaagataagtaccaagaggcataaggatatatggatcctagaccttgtcctgacatcaatttgctgtgtgacatttgtaccgctgttctctcaagcgtaaaatgagaatgctggaccagagaaatcactacattaaatttgttatgtaaaggaaatctcagtaaaaatatttttcctgcagagtcaagcaatattattacttcatctcaaaaaaagttttacatatttttttacattaaccaaataaatcagcattggacttgcctacatttatcagatcagtttctattacttttaactgttccttcctgctctacttctcagcagggattacatgcctgcagcgtacactcagaattttctcctgaacatagattccaggaaaagctaaggtaaagaagacagagtagaaagcaagagcacagatgacacttcttttaggcgcactgcctagatcgcacttggcctgctgtcttcctctcattagtcgcaccaactgaatctgattagcccactctgatttatttttggcaacctggaagtgcatgggccaatgcttattttcatggctgatacaatcatccccaaagctgtcgttagcatttggaagattagtccctttctctggatgattttattgcctatgaagcatcacgacacacattagacatgtatttcttaaacactttacaaaattgagtctatttactcttcttcttattatcacaaccaccttctgttattggctgctaaaacatagagaaagaattcttcataattacatatttgatgcttatgaacttattgttttctgagttagtgaatcatctgctataatcaacaagaactaaaagccagatttcaatgctactggttactcagtgcctgatttgtctacattttgcttaacagactttcccattatgcaccaaacagtactatctaggtgaaaagtgaataataaggaaatataaataaatattttctcctaaaaatgcaactttcagatatgaagcacaatatgtatatgatttctatttatatttgtggacagtaagatttattagtaaggatcattatttttaggtctttgagatacaaaaattctgagattccgaataagtcctaaagtacgtttagtataaaaaatgtatcatgaaaaatgaaacacactttggcaaattttccaataggttaaaagtaaaaggattttccatcagctctcggtgaatttgaaagcatatttataaccaggattccccattcactaagcatttaatgaataaacagccactgaccaccagcaaacttgcagctctggaggcaggactgtgttttggatccccagtacttagcaggctgtgtggttcttagtagattcttaatttgtatcgactagatgagaatatcaattagtaacttctatcatgggtatgattactctttcttttcctcgtacccaagtctcctctatccaatgaggacatctcagctgttccagatcccctcttgtaaagtctgtctacagaggattgtaaggaaagcaaaaagatagaagagaagaaaagataaaatttgcagagagagaagtttaaagagagaagggcgctatgataggggaaaaatgagaagtttaagaagtattgctggagacctcgggtgctctagttgattggggtctaatttgttgttgctgtggtggtggtggtggtgccagaatttaagaagtatttcaatgctgatgaattttccttaagaggaagggaagatgatgaggcaggagatgttgaggccaaccgacatattacttgtgttccctgcttgatcccggcaatgcattcaccgtgagatgaaggagggctctttgttttgcttaggaaggctagagggagggctctttgctttccttaaaaaatgcattgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctcagttctcaaaagaagacatttatgcagccaaaaaacacatgaaaaaatgctcatcatcactggccatcagagaaatgcaaatcaaaagcactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcagcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcacacataggtgggaattgaacaatgagatcacatggacacaggaaggggaatatcacactctggggactgtggtggggaggggggaggggggagggatagcattgggagatatacctaatgctagatgatgagttagtgggcgcagcgcaccagcatggcacatgtatacatatgtaactaacctgcacaatgtgcacatgtaccctaaaacttaaagtataattaaaaaaaaatgcattgtattccccacactaaagtaagctgatgatggtagaggaagaattagtgcccctagtaaagacaggatccaaccccactgggttagctgtagcagcaagggtatgggggcattaaggaggagcaggagttagccttcagagcgtgagtcgggacaaagtggcaagaacaggagcacccttgggcaaagcagcccaccaggacaggggctgatgacttcactagacagtcaagtgctcccgctgcactttgggtctgtccatcataagcacacattgtgctgatatcctccatggcaccatcagagggatgagagggcatcccatctacctttgaggcctggaacctctgggtgcatgggtatctcttgcacagctgtgacccaccaccacactatacactcatcaacaaatgttcctcacctggcacattgcccagggcttgctcttggactgctggcactgccctgctccaccaagcaggggacaaccatgactcagctgctctgtgtttctgatggccaagaaaattgttccctacattctcaattcatttttcacacccactattgattcgacacccccttgggacactgacaaagcaaagttggagggtatgggtacaagagcagactgcacatagggccatgaaccattaacaatgcaatacttctagatttggtgcaggaggctagaatgtctgtgatcaccagccaataggttttaacagaaagtatagtaagggaaaagagatcaagcatctatgatagcaacctagacctttctagtcatattaaggatactgacaattgcttcaattactaatagaagtctattaacttcaaatcctagcttatgaaatgctgtggttgaaaaatgtcaactctctttaaaaatattctacagatgaatgagcctggcttagtcaggtcttaatgtgcattagtgttaatcccaatttatgttatacaggtaacaatctaagatcaatttttctttttaaggattacaaacctttgcgcatgtgtgtttaatttgggtatggggaagggagaagaagcagttagagagttctgtttaccctattggcagaaaagggccaacaggcacaggtcacaaccacaggcaaaaggaggttagagtagcctattattaaattaattttttttttctttgagacagagtctctctctgtcgcccaggctggagtgcagtggcgcgatatcggctcactgcaagctccacctcccaggttcaccccattctcctgcctcagcttcccgagtagctgggactacaggtgcccgccaccacgcccgggtaattttttgtatttttagtagagacagggtttcactgtgttagccaggatggtctcaatctcctgatctcgtgatccgcccgcctcggcctcccaaagtggtgggattacaggcgtgagccaccaggcccggccattaaatttaattttttaaaatacatactcttctcatcttcactcttcaccttcaccttcaccgcactgaatgtgcggaaagactccagggaggaacagaagatccccaacccctctattctagggatttcatatgtaaagcctgagacggtgaggatgaagaataaaaaattgtttatgaaggggaagaaggcatctgttgctaccttaaccgtcagatactatcatccccagcccctttttgcttccttagaaagagcccctgggaatcaatttgactatagaacaagcccttcctctagaggggcactcaaaccccaacatggaattggaagctctggggttaactgaggaagaaggggagaattgatagcacctcagccagcaggggagggggtctgcccttcattaatctgtaatcagccagctggacagacggcagcctgtgtttcaattgctcccatgtgaacaatgactttttccttttatgtgttctgctccccactatttcatagagagcctccctcacctccactggagacactaggtttcttgatcttttcttcaaagagaagggaggggagaggaggttgtaggtggggcaaagcccatctcatctcttcatctaagtcagagcatttgctctcctaaaaggaacctagaagggaagttctccaagttcttgctcagataggagcagatttctctcccccagcacaggtacaagacagtagcagaatacactggtcttgatgagtgatgccatcagtactgagtagcagagaggaagatttcaggaggcagggaggtagggcacatctggcgctggtctcaccctgatgcagaagcctagccctgcactgttctcctcttcagatgagtatgaggatcaccacagtcctgttcactgtagctgaatgtgcggaaagaccaggcacccatgagccaaggggtcttccctcagtcttggtgtgcaggcggcacactacttgagccctagatatttttaaattcctttcggttgtgtgggctgcattctttaggacattggctaggactaaatgactgaggatgaaaccaaatatgcctatattgcaaggattctcttgattttttttaaaaaaggcctttgaataacacagaactatgttcagttctagaattacttgttttgttgtttctatttctctggtgagaatttttaccctttcattcattatgagcatacttttagtttattaagtatagtaataatacctgatttaaagtacttggctacatccaaaacctggattttctcttgaaaattagtcacattttcttggatatttgtatattgactaattttggactatttcttgaatattgtgagtattatgttataaaggctgtaatatttatgtttcaggattaaactaatatttttgtcttagcaagaaattcacttggttggatggaacctacacatgctttctcgtgggtggcagcttgaaccttaggacaattcttttagctttggctgggctacctgcagcctgacctccccatgcatggctcaggaatcagcctgaggtttggacagactttaggaccccctccttttcaggattacctactcactttccattagcagtggttgccaagattctctcatcttttgcctcaggccagaaagactgagattttgtcagagtttcagctatctcacactgactgaagcatctgccctctggctataagctgatgtagaagatggatggatggatggatggatggatggatggatggatggatgcatggatggacggacggacggacagacacacacacagacagagagacagacagatagatagatagacataaaaataactcattctgtgccaattctgtcaagtgtcaactgccctccaaaatctctctgctttgttcatgattcagtctttagtcagttgtttatttggtaatttgtccagagtatatggttatttgctggagaaacagtcagagaggaacttgcatggccataactgaagcagaacttgcagaagcataattcaaaagaaagaaaagagtaatggataagggaaggagctagtatttgttaagctccatgtataggcagcacattaaataccttttctgttctttttctgttttcttgtgttttatccttcttgcccaaacaatgaaatgctcttatgaactttatgctagcctcacaattccacgtggaccactggcaatatagcatggttcatattttgtgtttgatcccagaagtacattgctcaatgttagaaacctgcccatgtgtctggaataactgccttgatacattctcctagaattttcctaggaggccacagcctcactccctcgtattttttcaaaacatgtaatttcaccacatagctgaaaccaagaacttccctagaacttaagtgtcaaaatgactttcattcattaattgactccttcacaagatgtttattttgtttattacatgacatagtccaataaagggatgttttaaaagttcattctcaatgcctatctcatattacagaaatctgcctaggatcaaccacatgaaaagcacttagcatatgccaggtactgatcctagagctggaagtgcagctggaaataacatgcagttcccgaccttagagtacttatggtctagtatgataagaatattaggaacacaatttagtctattcaatgttaagacagaattaaatttgtttatgccagacattctttataagtactagggcctgtaaaaactggatttctgaaaaataaaataacaagaaaaagtcagtacatttttcagtctataaaacctcttggagagtagtgatgtgtattgtgtgctttggttgctgaaaatatgtgagaaacaaaaatcaataagttaaactgttggtggaaatgtaaattagttcagccattatggaaaacagtatggaggttcctcaaaaacctaaaaatagaactaccatatgatccagcaatcccacgactgggtatctatccaaaggaaaggaaatcagtatgttgacgatttctctgcactcccatgtctattgcagtactcttcacaggaggcaagatacagaatcaacttaagtgtccagcagagggtgaatggataaagaaaatatggtgtgtgtgtgtgtgtgtgtgtgtatatatatatatgtgtgtgtgtggaatatcattcagccttaaaataaaaaggtaattctgtcatttgcaaccacatagatgaacctgaaggacattatatcaagtgaaataacccaagcactagaagataaataccacgtttttactcacaatgctaaaaaaaacttgcaagttgctctagcagatgtcgttactagagccaaggaagggagagagagggggacagccaaaggcttgttaagggatgcaaaagtatacctagccaggaggaatacgttctaatgctctatagtactatagggggactatattgacactttatcgtgtattttcaaataactagaagagtggattttgaatgttcccaacacaaagaaatgataaatgtttgatgtggttgatatgttaatcaccctgatttgctcattacacaatgtatatatgtatcaaaatatcacaggtaccccataaagatgtaaagttgttatgtgtcaattaaaaataagaataataaaaccaaaatcaataaattgagtaatttgttagaggcaaatgcccatatatcgtcaatttaatcagccattccttcactgatgtaacagaaacttaacagtcatgtgttatgtgttatatgacagactcagtgttaggacagtaagttaagagatgaagacaaatgaacatgtggaacaataatgagactgattttttgtactggtgaccatgggcaagtgacttaatctttctgagcctcagtttcctcagctacaaagtgagattaaaagtaacgatacgtatctcatgaggttattttcaacattaaatgagatgtttttatatatggagcgcctggcatagtgcctggatccctgtagattcttaacaagtttcagcaatttttccaccctgctattatagaaaagaaatttgaggctcagtgcagtgaataacttactcacccgggacactacatacctagaagataaattaaacccaagcacatggtacaaagtacatgagtcttgtttgagaccagaaagaaagattaattctgcctatggagtctgagacagaatcagggaggaatatttaaaccaattccatggatgacttttcaggtattgtccataaatacatatttggagacttggagcaaagtttttaaaaagtccatcaaccgctgatcccctagacaccagcagatcctccatctggtctcttcctcactagcatagcttccttcatctttaagagattatgctggttaatctttaatgacaaggatcaacaccagtttctcaatcctgacctttttataattttcagagctagcagatgagaggaaatagacgaaataactgccttgatatattctgctagcatcactccctctaaagtaaaaagagtacttctttaaaccatgtaactttgccagcacagttgaaaccaagaacttctctagaacttgagtgtcaaaatgactcattcattatttactcctccacaggatgtttattttgtttattacatgacactgtccacaaactggaagcagattttcagtggaaaaaaatcctcaaagtaaaaccctgagaagattattaatcctaagaaggataatctctttctgattttctttgtgtaactaaaatacctatgtaactctattttaagaaataaggcttaccataaacataactaatgtttatgatacacaacaatatgtaaaaattatcttagcataactttattgccaattatctgaatataacctccatctctttttattctgtttcattcaacagaatgctacagctttccatgtaactgtccaagatgataataacatcgttgtctcattagaagcttcagacgtcatcagtccagcatctgtgtatgttgtgaagataactggtgaatccaaaaattatttcttcgaatttgaggaattcaacagcactttgcctcctcctgttattttcaaggccagttatcatggcctttattatataatcactctggtagtggtaaatggaaatgtggtgaccaagccatccagatcaatcactgtgttaacaagtaagcatcatgtgtaatattgtcccgtttcttcttattgttcccctgtttcttcccgtagggctcgaattgacagactccacccagaatggcaaaatcacttgccttaatgccaagtgacgtagattcaaagttatgagctatattaagaatacagctgaagtttgatgtttactctttaccttgtgataacaaaaatatttttaaacccaaaaaagtaaacctcaatgatgtagtatattttgagactgagtaacaatttcaaattcatgattggaccatgtaattttctgctatgttgcttaataatgtcatcataacttgtttatttttttccagagcatgtattctcatattaagcaattcagtttggggacaatgaactgatactcctatttaacctgctcaaattcaggtataggtctttggctgagagagagaaaaagatatatttatttatcaattgttattccccacctcatcttcaaaatagctttgccttctacttcttaagaaaaaatgccaagaaaaaaaattactggcattttaaccttcattagtccatgtcataaagagttaaggctgacattgggaaatttttaggaatacttttaactccatgtgattttttttcactttactcactgactttaatatctaatctcaaattaagatgtgactctactgtctatgttgacatgtggaagaaaaactgatatctgtaagacagtagagtttatcactagcacaatataatggctcagcaaagtcccttttgcttgtgttctttagtgtaagttttgcaacagctgcaatttgttaaatgccatctatgtgtgattgttctggtgataaatacgtggaaagacagtgatattatctgttgggataaaaggaagcagaaactacaagaagcaaaaactcagaaccaagctagaggacatatttttaacacatctctcaaaaattaattaaagtctccattggcacaatcccaggatcagtagtgagtcctaaaaattaggaatggcatagacccaagaccttcaaagtttatagacataatgaacagatctactagttgaattaaagggagaacttacctggtaaaatactgtcttaaacaagctctagaaaaagatgaattgcaagtcagatttaggcagcagatataggcacataacgcctacaatacaaactccttaatatcaaaagctctgtcttacttatcttcataatttcataaacacctagcccaagccttatgcttgcttaatagatgatccataaatattagtacaatttagttgagcaagtaataggagagacccggggggaaaaattaaggcacaaagaaaaatagatttaggactgtaatgacggtcgctgatccaacatttatgagcatgcactcagccattcctcatcagttgcagctgaatgattcagccctttagctaactgttcatgaagaaatttgataggtaagcaatgctaaaaaatttctagaatatcacttagcatttgcaatgagttccattcaaaatatattctattttcctttgtgatgtttttctttgacctgtagggcttacaagtgtgttgaatatccaaaaatttggaaattttgcagacatcttttttcactgattccttgaggaagtgttgttgtgatcagagaacatattttatatgatttcttttacttgaaaattgttgagatttgttttatgggtccaaatatggtctttcttgctgtgtattctgtgagcacttccagggtgaagtttcaataagtaccgaccaggtcacgttgattgttcaagtcttctatgtccttactgattttctgtctatttgttctaataatgactgatagaggaatctgaaagtctccacttgtaactgtaaatttgtctatttctcctttcacttattttggtttatgctttacatattttgaagctctgttgttattaggtgcaaaagctttcaagattgctatgtcttcttgataaactgacccttttgactatatgtaatgtccctctatattccaagcaatatgccttgtgttaatttcccttttgcctgatattaaaatagccatagttttcttttttaagtgtttgtgtggcatacctaatccacccttttgctttcagcctacttctgtctttacgtgtaaaagggtttcctgcagacagcatagagttgagtcttgctttttttttccaatctaaaaatctttgtcttttaactggagtatttaggacagcactatccaataaaaagagaatgttaaccttatatgtaatagtagattttctggtagacacattaaaatgctttttaaaaaggtgaaattaattttaatatcatggtttacttaatccattatattcaaaatattatttcaacatataatcaatatacatatttacacattttttactttcatacataaatttaaatagaaataaagttgcactagcctaattttaatcgctcaatagccatatgtagctagttgctaccaatttaaatagtgcaggtttagacaatatatatgtaattattaatatttattattataatataatacaattatttctatggttgaatttgaatttaccatattgttaggctgtcaggtagaacagggagtgagtcgatctagtcaatagttgagctgggtttaaggtattagacacctttcgttcatcacagatttccagttcttcccatgataggctgccaggagtggtagtgggtatttctcagtgtttcagtttcaccctcagtatgcagcaagccctgaacaccggcaccacagaagagctcccccagcaatagactgctgttgcttttcactcattgctaactttttggtggggacagaggatgttcttcgttctcgtggtccagcctcaggcttaggcagaccctgtgatgttagatgggacattcttgacatttttacccctcaaactacaccgacactgaaattctacattaaatccatgggtcagagagattcctgcctcttctccagtggtagcagaaccactgatactctactttgtattagtgcaggactctggtcccaaaagagtttctgctcctctcccaggaacaggcgtcttttgtttctattcatccttcaaaagaagggatattttcctgagaactagaaaggaaagatttttctgcccctccacaatacattaaggcttctcctttgtattcaggaaaggtccagggaagtaagttttcttgctgtcctcttagtggtttcaattatcatctgcacacctgtcacccccatacccccatccccagccccccagagggaggctctctctagtcccctatcctgcctctggtagtcctcatgagcatggggtagaggcccaaggggaaagctagagagagacagtagactctgtttgtgtctgtgtctcccagttagtctagaccagtggtgacctagaactttgggatgatggaaatgttctatgtccatattgtccaacatagtagtcactaatttttaattttaattagttttagttcatttaaaatttgatttaaatagctctatgtagctaatagctaccatattggacagagcaattctttgcatccatttagaccatactcagcctttatgaatccattaaactcggagctgctttcttcttatctgcttcgatgttgtatcctcttcctgctgtgctttgccaaaggtgaaatagtgtgtcgcctctctccagaggggctggtcactccttcgaattcacatcacttggttcacttgctacctcacctctcctgtaacctcaagaatagttatgatttcgtgaattatgtggcttttccttgttgaggtggagaagaagtgatgttgtcctggggctttctacatcttaaggggaagagaaaacacgtattgatttccaaagagtaaaattaattcatgatggtctattaaatattatcttgtacctcatttttaaaggttcaattacattatcccaaatttgaggggcaataataggttgggaatatcagaagtgggaattagtgcacaaatatttctgtgacattaggcatgagctggcatttggtgacatttgggtttcagcttccaccttcataaaagagggaattgaagtacatgatgactaagataaattttgagctctgaaactaacattatctgtcagttaatgatgtgtttttgccatctttatttttctaactgaaagctttttaaacaagtttggaaaacatttgtagtatctgctcacagagttgacatatttctcctgagaataaaagagtacctttatagcagtcatttattgtgtgttagatgcttgtcttgatgaaataagcaatgacaaagcaattggccccagggcagtcctttgatatttcactatagttgttctgagtctgtcactcttagagaaagctgaaaaacatggcaaagaataaatttggcacagcagagtcatttggccagttcaaaagaatttcacaacccttaggctgtgacatgtcattaatatttaattgattgagaaccttcagtatattgcctgcccttcagagggaaggggtagtttctcagcacgtaaaaggatgcctggaatcagttccttggaaattgaggaaatgtcacatacacacagctgtgtcatgtgtcagtgaagttctacagatagtggctgtacacattaaagaatacacatagagacactctacaaatataatattctatacagtcctattctaaataaaaataattcatgaatttttattttagttatcaggtacattctctgtgccatgtcctaggtaccaaagaaataaagatagataaaaatactcataatcaaagatgttatactatagtggaagagacaaataaaaaccattacaaataatatgataactgctattgtaaccagaaaggggtcacaatccagacccccaagagggtgcttggatctcacgcaagaaagaattcagggcgagtgcacaccgcaaagcaaaagcaagttcattaagaaagtaaaggaatgaaagaatggctactccataagcagagcagcccaaggactgctggttgcccatttttatgtttatctattgattacatccttaacaagggggtggattattcatgagttttccaaaaagggtggacagttcccggaactgagggtttatgccccttttagaccatatagagtaacttcctgacattgccatggcatttgtaaactgtcatggcactggtgggtgtctcttagcatgctaatgtattataattagtgtatagtgagccagtgaggacaaccagaggtcagtctcatagccatcttggttttggtggggtttggccagcttctttactgaagcctgttttatcaccaaggtccaccccagtaggtctcagccttattttacccagtccctattcatgatggggttgccctgttcaaatgcctctgacactgtgaaagaattatgtgaaagagactgccttgccttcctagggagcactgggaaggcagcacagaagaaacaatcattgaaaaataaaggaaaatttgccacaagaatgaagaaaggaaagtgttacagagtcaaatggaatcgtatatgcaaataatggaggcatacatagcatggcacacttgatgactgcagaaagttaagatggcaagtgttagctgttccagaaaataacaagaaaggtggctagaaatgttgaagaactttaagtaccttgcagaggaatttagactttaacctataagtgatgagggagaaattacataataggatttgaatggagaaagctctctcttgtagcaaagctgcaagccaagagatcctgaatcctgcattggaatagaaaaattatcaagcaagtatttggggtagtagttcaatcatatgtatagccttaggcagatgattactttctctaaatcttagttttcaaatctacaattcattctaggggttagcaaactttttctatgaaggcttagataataagtgtgttatgctttgagggccatacagactatattgcaactacacaactctgccgttgtaaacaacagcagccacacacaatacataaacaaatgataatggctatattataattaaactttatagacaccaaaattttatttttttatacaattttcacgtgccatgaaatactattcttttgtttaggcacaacatctaaaaatgtaaaagcctttcttagctcaaaagtcaaacaaaaacaggtggcagggcagatttggccttgtggactgtagtttgctcacttgatctgtcgtatcattataatatgtaatattgggataattagagtgcctacttggtgggggcattataaaataatataaagtaagcgccttaacaaagcatgcagtataggatcaatcaagataagaagtatcaatggcattaaatagaaagttactcaaggtgtcagaagtgaaggagattgagacagattgggcagggaaatatcagtgagaaggaggtgactggtttaggacaaagattctgactaaagtgagaatatcaagtaccgtacagacattgaaattttgagcagaaatgaataagaatattaaggtgagaatggaggcagggagaataatttagaaagttgttgaaatgttcgaggaaagaaatgatgagaacttgaactaaggtactggatgtgatggtcaccacctcacttggactgtgggcagctggtgttgccagacctacctcgctggcctgctttgatgtagctgagatgccaggtcaggtctcaaatgatcatctatgcaccaaacagcagctctggcctcagtccagtctcttttccctgtgcctgccatcagaagtgagggtctaatcccagatcctctccctcaagagaactgtgccagaagagacacattcttcagctggtcacatcagaggttactgaacatgaacacaattgcttctttagtttgtattctttagtccagctaaacagagcaatctcagaaagaagcaactcagcagttagcatttaataagtaatacatagctacttttgttttctttaaacaatatgtgctccacatttgtttgtatttcttgtctcttctccgagatagtcacatccagaactttcaaaactttcctattcatgatctctcttgaatgattcaaagataattaaggggcataaaatattgttcaatttgaacatgagttttcattatatgagacacctaatgagggaaaaaatgatcacactaaatgtcattttttattaaagaaaaaactaggaacttatgctaggatttcttgtcaaaatatgcagtccattcttcttgtcatccactttttgctcctaccacaaagcaaaaagaaaagcagaagcacatttccagacacaaagccacaatagttctctaagaaccagaaacaagataaaaactcaaagcagggaaatgggctgaagtaatgggccctctgtgctctgggtctggaaaagacactattgagtctgggccccaatatagtcagaaggactgaaatgctccacgctagacagggcacagagccagcctctctgcttacagcaaagattcttcctgtttgacaaacaaacaaacaaacaaacaaacaaaaacatacataaagacctgaggatgcaggagacacatattcatcttactaccgaggtccaaggctagttactctctgactcagtgaatgaatctatagtgataaccactatatcatccacaatattaagaatggcaaaataatgtcatatgtcttgctgtagactgggtgctttggtgggctgagaggatgcaatggcttaattatttttaaaagcaaggcataataagagagaaatggggagatgaaaaagcatcaaatgagcccagagcctgtgtctcaaaacacatgaagaacttatgctaaaaaagatagatatcaaaacaacgataacagttcagattatattttaaatagcaatttaacaaaaatttaattatgtttataatgttcaaggacataaatgtaagaaccacctccagtttttgaaaccagggaattagtgggaaaaaaaattggcagaaatagtgcagtgctgtgcctacagttccacctaatcaggaggctgaggcaggaggatcccttgattccaggagttcaaatcaaggctggacaacatgatgtgaccctatctcaaaaaaaatttgcagaaataaaataaaaacatatagaataaacatgaataaattaaaatttttataaatgaaaacataattatttaaattaatttaaaatttaatgcatcaaactaggtaaaattaatttgattgattaaatttaaagtttactaattgaaaagcttcagtagataggacaaattctatactgataaaagttataaagagctagtaaattggaagataataccatgcaatttgcctcataatatagcacagtgaggcaattcacaggcatggaagtgggagaggctctagctaagaaggcttaagaattcatgaaaaagaaggagggaatggtgggcacaatatttggagagatgattatgagaatttccaagacttgaaaaatgacatgaattcacagactgacagagcattccaactaagtacctaatagagtaattcaaaactaaaactacgcctaaatatataatgctatattattgttattatatatcatcagattactaaggctgaatgaaaatagataaataagcttgaaaggtacaagagaaaaaaagcgaagtatctacaaaggaatgactattctactgacagaagtcttcccttctgcaataactggtgaaagaaaacaaaaaaacaacatcttcaaagtactgaggaaaatacctgtctacctagaattttatacccagatacatcaagaataaaccacattaagaataaagataaaataaagaaatcttctaatatacaaaccctagagaacttaacacctatagctctgagttaaagaactgttaatagatagatttcagcaagaaaaaaggtgaatctagaggaaagtccaggacacaattttaaaaaatgacaatgggaatatggtatatgacaaagattgtgttacaaattagcaggagaagatggaaaaagaaccccaaaacaggcaaaagaatttaacaattctaagaaaaggaaagctgattgaccaaaaaacataagaaaaaatcattaatctccatgagcaggaaattaaaacaaagagataacatttcacacacctcagagtggcaaaaattaaaaagactgatatcagcgaaagttggaaaatgatatggagaaagaggaactatcatacactgctaatagatatgtaaattgccctaatctatttctaatctaattagaaaactttctgaggctagactatctgacacagatgatgtgtagacccttctattcaggattttcaacctaaggcgacatgccgcaaacatttattgcagcattatttgtaagagtgaatgattaaaagcaattactctactaaaagaataacaggtatattgtgtaggttatatagttgcaaaacggacactaaaataaaatttttagacgttcttgtatcaagagtgataaatcttaaaacaatgttaggcaataaaaacaagctgcaggatagttatgataatttacataataatttaaaacatgaaacaatgttggatgcttacaaatatataagtttaaaaaacatgcatgagaagataaataccagattcagagtaataatttacttctggtcatggtgggaaaagaatggggtttgggtaagttacaggggggaatttcaaatatattttctaatactttatttatttgaaaaattaaaacatctgtggacaagaaagtaatgaacaaagatattaagtgattcaccttgtccaacaactccatttctctgtccagtccaggctggtcataagaaaaaaagggaagtacaatggagtgactgacagggcaaggactatcagcttagattaggatttaaccttgtcatcactgaaatacctgttagtaactatagctctagttcataccacaccacttaatttctaaaaagaaagacaatgagagaagtcactggagagatagtaaaatatttttagactatacgtttgagttcttctaaaaacagtaattcttgaattgaatactcctcagtgatgcttagacatcaacaggatttactgctgacctgggtcatttacactgaagctgagggaaacataaaaaaaacatacaagcaagcattttaagacattctcttagtttaaagtttaagtagcttgttgcagaaaaaaaattggaaaataaaatatctgttctctaatcctcctgtctgtcttgaatttcaaagtttgaccgtggctttgatgtgcagacttcgtgcctcagggcatgaaagattgagtgcccttctaacttctcttttcagtagaagaaaccctgatgaggatgtgaaacaggactgcagcagtgaaggagttactgctccgtggctactttttctgtctcctttcattttagttctcttagggtcagagtcaatagctggatctggtagactccatgggttagtaaattaggctgggttgaaaaaaagaacttgaagcagttcaaaacttctttgggagttttgaactcaaaacagagttttcaagggttggttgattggttgacatggtacgtaagtgagttagtgagttcattcagaaatgttaccttcatgtaggaagactagggatgagacaaagataaaattcaaaccttttaaccagactatagcacatagtctacagtgacatgatcataaaatatactggagtctgaaggtcttcctaacttttttgtagatgctgtttttcagaaaactccaggaaaaatcaaagcatgaacatgtagcttcaattatttctgggtttcttaaagtcaaaaacaaagatagattaagaacctgagcaacaaaataaaatacattcagctacagattgagacatactagatcctcaatagttatttattgaatgaactaagtcaaatttggagttctcatgttattgaaattgaaattttttaaatgtaaagtttaaactaaggacatttctttaggtcagcctatagatgatgtccaagaattctctcaattctaaaagtgtgaatcaaaaatttttttttctgtcaacctaaaatcgtcaaaagggtcagaatctcatttaaagagagttttatcaagcacaaagtgtgaggctggaccacctggaaacaccaactccaaaagaattcagtcagtgctctgaagtagtgaaattgggatctcatttctataggcagaaacagagaagattttatcaggattacaaaaaaattattcatataaggatggcacctggttacagaaatttcattgattataagcagtgtttcttttggggaagggtacatttaacatttttttacacagagtgtaatagttatttataggttttctgtcatccagcctaagcaaagcaggacaagaaaggggggaagttaatctacaacatgggtcattaattaagaaggcaggagatttttgtccctgacatcatttaattccctctagtcactgcacagaacaagaaaaatgaagtgagttaatctgtaatttgagaacagaagttataactatatgtgactcagatcacagttacgtcttttggggttccaacagcttttaaattttacttatgttcatttttcttttctttttttgttttttttttttttttttttttgagatttcactcttgttgcccaggctggggtgcaatggcgggatctctgctcttggcaacctctgcctcccaggttcaagtgattctcctgcctcagcctccccagcagctgggattacaggcgtgtgtcaccacacctggctaattttctatttttagtagagacagggtttctccatgttggtcaggctggtctcaaactcccgacctcaggtgatccacccgccttgaccttccacaatgctggaattacaggtgaccccaaaccaaattatttaacatatcttcttaataaaattcatacaggtaaaatctgtttaatagcttctttagaaaggtgcaaaatgcattatttacaagaattttgcaggagagtgggagggggaggagaggcaggcatatatcgatcatggattttaaaaaatgagtatttttaaagttttccagtgaatgaactactcaagcaaaatagaaatgttttctttaaatttctacagaaagagtggtttgataaacaccacaaaacatatgttttacaacattggacagtttaaaattttatacttcatatggaaaaataagtgctatgttcacaggaagaaataaatgatcatataactatcattggtctgagccaaaatttattttctgttactggtctgttactgatatcaaatttcctttgcatgagaaaaagaaaaataaactaggaatctggagatacagactgtcatgtacttgttaaattaccttggacaagtaatttagtctgtgagtcatcattatatttataggtgggatggagatattttatttgctcttcctagatctcaggactgttgcaaaaggaaaaataaatgtaaaagttcttcaaaaagcagaaagcaccatataaaatgtactttattaattactgctaagaacattcaattcatggttactgaggagtttagtgcccacagacagtgaaaattatgcgtgaatttctggtaggtgtaatccttgcttaattcaagtattgatatcggcctttctctctcctctttcttttccctttctccatttacttcacttctgtagaacctctacctgtaaccagtgtttccatatatgactataaaccttctcctgaaacaggagtcctgtttgaaatacattatccagaaaaatataacgttttcacaagagtgaacattagctactgggaaggtaaagacttccggacaatgctatataaaggtaagcagcaaaaggaaagctgaatcaatgatgaccctcactttttacaaagcttttcccaaatgatgttctctcttactgcaaagaggttttataattcactatttgacctataaatgagccattaaaaataattattgatttatgaaaatcgtgttatgaggaagcctagaacatctggttcattacttgagagtcgtgtgtcatgtgttcagcatgagaaatactctcattattgtcacttacatgttactcttccctaaggcagcatgcctggtgcaggaaataaattcagacttaagtttagaagcacaagtaaccgtttctttctgggtatgatagatgggcatttctgggactgggaagtcagagtggtgccttttgcaaagtttcacttggagatgatccaacatcctcaaatgcaatgctgtatgaccagctaaatgcatacattaacatacaaaaattagtttcgctttttcactggcttgatgggaaccttgaggggaagggagagaaaagagcccaggagaagtaatatttcaaattactcaaaggaacaaaatcaacttctctgggtggaaggggctagagggagagggaagagagggcattcagtttcatttgggagtgaatcctagtgaaggaacttgaatacgctcagggcacatcgggtgggggtgggaggtaggtaatgatatcagagttggctgactgtaactggaaacatgtattggtggaaagagaaagtattgaagcacacagagcatgacatccaggaaaatgtcattttcacttgctgcttttacacactcatttcttcaatggatttagtttttctgagacactatttaaaatatatgcagtggggctgggagtggtggctcacgcctgtaatcccagcactttgggaggccgaggtgggcagatcacttgcgttcaggagtttgagaccagcctggctaacatggtgaaacaccgtctctactaaaacatacaaaaaatctagccgggcgtggtggcgggcgcctgtagtcccagatactcaggaggctgaggcaggagaatcccttgaacccaggaggcagaggttgcagtgagcctaaatcacatgactgcactccagcctgggcaacagagcaaggccccatctcaaaatgaatgaatgaatgaatgaatgaaatatatgcagtgaatttggtttttttaaactttgaaaaaatcaaagaaacacaaattccacaaagtattatgttctttatttacaatgaaaacataatctgcaaattaataaatggaaagttatttgtttatagatcacatgcaaatatatttatgaatgattaaaaagcaattactgaaacttttgttaacaatcataaattttaaaataattaatataatcccattcttaagtcaattactttttcaaactatttttagatttcaattcaataagtggtacttttagttttgttctctcatttcttttgagttggattggatttttagtttattgttattctctttaaagttttctaagtggaatccaaacttttattatttctttttttgggcaggttctgtctgcaaactggcaaataaaccagttttaaattaggctagtttttctaaatgaaaacttttcttggaaaattgctctttttttaggtcataaggtggcaaaataccttggatttttatcttaaagtaaatggccagtgtaaacttaacctctacaatttctttatattatctccttcaattaatacataccccaaaagttcctatcacaaaaaggttaactccaattgtgtttgatctgcttaggaattttgtcagaaaaagcccttcaggattgagtctagacattcaacgtttcatctctagccttctactaactctttattactgcccataacagtagttgaaggaaatattattttgtgaatgtttagccataattgtttcaaactttccagaagtgtgtgatgtttagaagaccatatttttcatgtaattgattttctcttcacagatttctttaagggaaaaacagtatttaatcactggctgccaggaatgtgttatagtaatatcacctttcagctggtatctgaggcaacttttaataaaagtacccttgttgagtacagtggtgtcagtcacgaacccaaacagcacagaactggtaagtctcctgaagaatcaaatacagtgaaaaaataattcagttatattttgctgtacatttattttttatcctaagaaatattctgatccagagcaaagaaagaaaatatatatgtttaataacctaaaacagattttctatcaatataaaaagaactgggcaaaatattcaataagaaaaatctaaaatatgtcaatgtaatcatagatttctaatctttgaataaaaagctactatactattaccaaaggttataattaactgacttacccagatctagtagacatcagttattgctgacaagtgaccctatggcagaaaacagagtgaagacattctagtacagattatcagattattaaaggaaaatattgaaattcaaatgtatctaaaacttgcggtgcttgattttagtagcaccactaatatgaagcactattgtaggatggatggatagttgcatggatggatggatagatggatgggtggatggatggatggatggatggatggatggatggatggaataatgaatggataaaataagcatatatctactaagtacccatcaccaatataagcaaaatcgtatgtgcctagtatgcctgaatactcaataggaatgctggagaggccattctgatgagcatcaggaagggattatgatagattacttctaaggtcttgacaatttgaaattctaagatgtcatgattcttattcattagtctaagaccaggaaactatttcagctaaatcactaattcacctaatgtcaacagttaagattctatttatgtttttcattattcaatgtaagtagaaaaacattaattgagcaccttctacctggaagttgttctcagtactgagacatgaagacaaagactgatgagacaggatccttgtgctcaaaaattggtactcataatacacgaatggcactaacacaaggcagaatgagataaatattataacagaggtacaaagttatttaacaacacaaaggaaggagagataaatttttattagaagctcatggggcctagcacggtggctcatgcctgtaatcccagcactttgggaggccgaggcaggtggatcacctgaggtcaggagtttgagaccagcctagccaacgtggtgaaaccccatctctactaagaatacaaatattagctgggcatggtggctggtgcctgtaatcccagctactcgggagactgaggcaggagaactgcttgaacccaggaggcggaggttgcagtgagccgagaccacgtcattgcactctagcctgggcaacagagagagatactgtctcaaaataaaaattaacaaaaaagttcatggaagaggtgataatggaactgctatttgaagaacaagtagaaactgttacaggcagagactacgcagtgcgtcttcataattttctccctgtaagtaaagtgtgcttccataatttgtaaactcattttgagtttatatgtttcattttagggaggtgaggagtgaagctatatttctaacatgtgtgttaacatctctaaaggcaacacatgtatgcaactcttgtaggtgcaactatgtcacatggagtattttcatcttcatagctataagtacactatacttgttttgttttggtttttttgtaataaaaatccaggaacagagatacatttttttgtaagtggaattacgataaactgaaaaatatttatatactctgcttttagaagtggttgaattaccacttcaacaagcataatattgtaagttaatatatttgaagtgtgactagtggtatgttgataggtatacatcatccacaaaatgttagaagtatgtatatggaaaaaaacacagcttatcttgatgtaaatttgtctgtgtatcagaagtaaaattaaattccacttttaaaaatctgcttgtgtacctgactcattaagagattaagtattcactctaattgaattaaaaaatacttgaaaatgaaaattctctctcttacagccccttatccacctcaaaatatttccgttcgtatcgtaaacttgaacaaaaacaactgggaagaacagagtggcaatttcccagaagaatccttcatgagatcacaagatacaataggaaaagaaaaactcttccattttacagaagaaacccctgaaattccctcgggcaacatttcttccggttggcctgattttaatagcagtgactatgaaactacgtctcagccatattggtgggacagtgcatctgcagctcctgaaagtgaagatgaatttgtcagcgtacttcccatggaatacgaaaataacagtacactcagtgagacagagaagtcaacatcaggctctttctcctttttccctgtgcaaatgatattgacctggttaccacccaaaccacccactgcttttgatgggttccatatccatattgaacgagaaggtaaagcagtaggaaatcagaggaaataagaactgatacaaaggaaggggaattgaaatgtttttaaatttgagtttagaaagactgatcatagacagttattagtcaaagaataatggtaatgaaaggggagaatttaattgagtatccaatgcagactgagagcagaaaacccaaatgaatagactggataagaatcagaaggtttgggtgattcacaagttgtaagtactgccaactgtatacatttgactgcccactatttctcatgtctcagaacaatgaggaaaacatcatatttggaaatattttgaattaaagatctaactatcccagaatgttacaacataacctagagaaattttctgttttctcatatgcaaatttttaaacatggcagcaaagtaatacttatgaaaacattactacttcctcaagaatatgaggcatgtgtcctgctaaccagccgctcttgttccctttagggtgcgcccctctagaaaaagcaccacagttttccaaagagaagctgatagtaaaatggaaaatacacagctgctgacatttccatatagctactatattatattttgcattgactaactcagcatctgaggttcattctttatattttagccactaacttaggaaagtagagccatgactttcaacaagtttgggtcatgatacctatctcaattgttgtttggtagatttttatggttatttgttgtttgtttagtttttacagtaatatacttcattttccattttctgatctagtagtttgagtggcagaggttataatttgtaaaaatttgaagttacagtgatagccttatttttagggtgagagtttaaggcccatgtagtctcatatactgacatattgtttactcctattttacttaatagcatgagatacaaaatctgtggattcttctatacaagatgatacagcattcaaccatacccaaatattacataaaatgaaaattcttaattatttgagtcaaaagtcattttcctggaatttcctattttttttaaagtttccttaatctatcatttatttttctgttcctaaatatgttcctacggcaaataggatcttgtcattacaaaaattttttactgcctcttctcatgaaggttctattatgcatttatctgactcagtgtcttcttttgaaggctgttgtagtcaccaactgatgataatgacttcaaatgaagtaataagcagcagaggatggatggactgtgaagcaatgtgaaataattctttctttaagaagatctgaaagcaaatggataaaggaaaaatattaccatgattattatttttttaattttactttaagttcaggggtacatcagaaaatataccttaaaaattagatgtattttaaataaatgttaaagcacttctggatggttaatactaccacaaagaacttacaagatatttgatcctggttattttttagcccttacctcgtgatgagaaagccaacaattgttaacttttcctgattatctacttctattttgtacacataattttgttgggtaggagtacataaagatacacagtgtagacccatccctagttttattgatttgaatgccgtatttgagttttgttatttggaagactgtaaaaatactgaactcttatttattattctttaatggtacctttagtttagaggtgtaattgaacttgacaaaaggagggaacatttaaaacacctaattttttttcattaatcgacttgtctatacccagggcctttccaggtgtctattcatgtatcttctcttttttatatatgatttagagaactttactgaatatttgatggtggatgaagaagcacatgaatttgttgcagaactgaaggaacctgggaaatataagttatctgtgacaacctttagttcctcaggatcttgtgaaactcgaaaaagtcagtcagcaaaatcactcagcttttatatcagtaagtaacaaagagatcattttacacttactggggagctagaacaatggaactggtgggattaatgatgctcagatgtcaattattcacaaaccttagggatgatgagaagtcttcaagatcaggagaggctgagatccacaagctttggatagcagaggaaatgaatgcttgtttaatagtagcaatcctatccaggggtttaacttgaggattttttttttactattgtgataattgaacatttattaaactgacctttcacattagccataacaaagcctccaaggatgtggacatacagtttgggaaatacgacatttgtttgagcccataacgaaatgatattataggactgtgaaaaatctcattagagtattgagcttgtgaggctcaaaagaaagacaaagattcaagtgtgggtacaccccgatggtctcaataaaactggtgggaaaagtcatagctagagcaacctgaaagtcccagtgtcaagtcctagggtggcctctaccattccataagggtaacaggacagcaaaagctagcctctgaaggttgcacaaacagtgcctgcctctataacgtgtttagctaaactgactatgtttactggaagtatagaggtcaaaaatcagtaacctaccctatcaggagttatatgtgcctccgatcagtagaaagaaaaaccagaaggcaaagaataaaaattgctttcagaaaaggataaccaccacatatcctattgccatctggaaaggcaaataccacctttcgttgaaggacggatgagagcagaagaggagctcagcttatgtagcagcttaaaaatgttgaaaatatcccatataatatttttacttaaaagaaaaaccaaaaatgtcacctctggcaaaagaaaggccttaaagatttatcagatgcgtagaaagggtattcccaactgccttgtgtgtctttcaagtgtgagagaccttggacatgtgattacttaagaaagaggacaaagtcgagtatttcattcttcccataagactaaaaatgcctcacttaccaaatagtttctttctgcaccagtacagatccaccgcacatgtgaacagcctccacgaaaactccacaacaattctggtctttctgacttttctcttctctgaattcctattctgtctcatagtagacagcacaaaacacataacttattagtgtgtggtatttttctagatttattttatgtacatcttgcttctcatgtcaagttgtaaaatcccaggctggagttatactgtttgcatatttattcattcttttgtacattcaagaaatatttatggaaccacttatatctttcatgcactctgctctattcttagagtatctaaagcgactagtgccattgagaatatgtcggaattgctcaaaaatgcaattactttaaagagatgcatcttaatatttatctagaaaaatataggctcctagaagttttgttttttctctgttgctaaaagaatgactttttaaggagattctgttctgtggtaatgagctattcagatgtaccatgtatacttctttggtttaaaaaatggataccgcagacataaatacttacacctaactgggtaaatgagcaaaaattagggtggcttacgtttgctcagcataatgtagtcacacaccagcaaaagtatatttgcagcctgtttttcctgaccaaactgtttcacatattctggtgttgagctgttacattacaatttattatatgtttatgtcgttgcattataatttacatttatgtagctttgaatgccttcccagagatgagaattcaggtaggaatttgcactagactgccaatagccttatgaagaaaacacttttattacccccatttttcacattaaaatacatactgaatcgcagaaatttcagtgacttccccaagtgtcaaaattaagattataactcaggaatatttgataacaaaacccattttcatttagcctgccatgacccatgtccttgggttgattatcaagtcagtcataaggtaaaactattaaataattgaatttgttttgcttactccaacctccaccctctgtgcccccactacactagtactcttcagaacagtagtaacacttcacgtttatgtagttctctaacacatattatctcatttgatcccaacaacaaccttatgaggtaaattaatcagattttcaaaagcaatgactcaagagacaggaggtctgggttaggtcacaagcacttactagctctatgacttcaggcagcttgtttatatctctgggcctcagtttcctcatcagcaaatgtgttagtccatatttacactactataaagaactacttgagactgagtaatttacaaaggaaagaggtttaatcgactcacagttctgcatggccagggaggtctcaggaaacttacaatcatggcagaagacgaaggggaagcaagcaccttattcagagggtggcaggacagagagagagagcaggggaaactgccacttttaaaccattagatctcatgagaactcgctcattgtcttgagaacagcataggggaaaccacctccatgatccaattacctcccatcaggtccctccctcgacaagtggggattacaattcgagatgatatttgagtggggacacagagccaaaccatatcagcaaaataaagcagtgggtctctaaagttctcttcaattctaaaattccatgatttatccatttcacagatgcaatgactgagattcagagaggttaactcatttgtccaaagttgcaccactaataatgaccaaactgagtcttagtgcaattatcgtatctccaaatttttactatttcatagtgctccaggaagtctcatgcagggttgagagcatggattttggaatcagacttcctgtgtgtgaatcctagctctacttactctatctctacctcagttttcacatctgaaaagtgagatttaataaaagtacttatttcattggcttgttataaaagttaaaggggccaggcacggtggctcacacctataaccccagcacttagggaggccaaggcgggcggatcacctgaggtcaggagttcaagactagcctggccaacatggtgaaatcttctctctactaaaagtacgaatattagccaggcatagtggtgggcacctgtaatcccagctactcgggaggctgaggcaggagaatcgcttgaactcaggaggtggaggttgcagtgagcctagataaggctgcactccagcctgggtgacagagtgagactccatctcaaaataaataaataaataaataaataaataaataaataaataaggaatgaaatacgtaacacataaaaacttaaagaaggttatatgctaaaaaacagtttacatgctgaaaagcagtttatatgtgagcatccgtgttttaagctcaaccactactgtgatgtcctagacatcttcccaagagaactacggtagcatccttgtgtctgtggtgtcactgacctgccaggaacaaacctataaatatgtaatgggttccatatctctttactataattactatcattttgtattatcatttcccttgcaccatttacaccaaaccttagtctgtcctccccagtagagcgacttgctccttttcctctcctggatctcagcttaggaatacagcatcaaattaaggagctgagaatgcatcctaagcaaataaatggaagtttcacatttgcatttcagcagggaatttctgtagataataatcaccttaacatgtcttgagtccttactaggtgtcaggcactgtgttaagaaccactttaggaacataagagaacaaagctaaggatgggcacttctgtggagacattttatggtaaggatcctgttgtgttcctcaaattatcacccaggttttagccagcttctttaattgagccagcctgttgtgtgtttcttctctaatataatcacagcctgccttttcgttctcactgttgccaaattcaaatgtttgcacagggtagtagtcgaggctgatttgaatctcaaagtaattattcctagagatcaaagatcctagtagcaaaggaataataagccctgatgaaatgccacattgccacgctcactctttgttaaaagagaagtaagttttctcaggtgaagaatttaccagaatactctcacatgcacacgatgattgaagtggcacttttgtttctgctgttattgccgaggctgctgtttagatcaaggtgaggtcaaggagtagagggttgcagctgggcagaggacctgaagagttgccagtccgaccgccaatctttctttgaatctcattgtaagggcaaaaagaaaacatgattttttaaaccagaatcttttatctcaatcagtgtaacgtgcagcctcccctgtgttccaatttgaaatgtgcaggtccttcaggagagtggattgaagaactgaccgagaagccgcagcacgtgagtgtccacgttttaagctcaaccactgccttgatgtcctggacatcttcccaagagaactacaacagcaccattgtgtctgtggtgtcgctgacctgccagaaacaaaaggagagccagaggcttgaaaagcagtactgcactcaggtaaaggagaggaaatgagaatgggctcgccggtccttcctaagcacaaccttacagggcaatgccaaggaggcaattgtaggaagccaggctgaggtctgctgggatgggtgtgttctgtgactgttcccaagagccagaggggccagaaatgactggcaatggctttttgatggcactgtcatctccctttctcttcagaggagggtcatgttctttttcattcattattcaagggaatttgctgagcatctatgatgtgccaggttctaagatagatgttggaaatttttaaacatcctgctcttgcagagcttgtaatctaatgagaacaatagataagtgaacatataatgactgcactgtatggaataaggcctcagcttaaaatgaatgatgagagtccagaggagttcacggaagaaggagctgagcgtgagtaacatggatgaaggggaaagaggatttggaaactggttggaaaaaacatcacagagcaggagacaaccaagcagagggttggagggttttttgtttgtttgtttgttttacttttttccattcttttaattttcatttttactgtaaaagtaacgcattcttgctgaaaaaaaaaaaaaacttaaaaatgtaaagaatataaagtaggctgggtgtgggggctcacacctttaatcccagcactttggaaggccgaggcgggtggatcacctgaggtcaggagttcgagaccagcctggccaacatggtgaaaactcgtctctactaaaaatacaaaaattagccaggcgtggtggcacgtgcctgtaatcccagctactcgggaagctgaggcaagagaatcacttgaacccgggaggtgggggttgcagtgagcccactgtactccagcctgggcaacagagtgagactccgtctcaaaaaaaaagaaaaaaaaaaaagaatataaagtaaaaaactaccccctcaccagtcacaactgaaaagagctttgaagaatatatgggagacagctgtgcacagaggagagtgaggggcaggcagagacggtgtgcaactcagtagtcttgtgagtggctagcagaaggaacgcatatgccagaacaaaccctagtgaaactgtgcaactggagcccagagtggaccttgctctcaaatgccctgagaacctggggcccagtcctatatttctaaattctggccttatgtttttacaaggtcaaatgtggtggttcttggtgtcttacaaacacattttcttccctaaaggcaaaaggaaaaaaataattatcaattcttgtggagtacgttggaaatgtaatgcacagaaaagatgtttgctgtatgacagcaatttgggatgtttccattcctcccaggaaaattaagcatttaatgaaattcaaacaatgataaattgtaaattgataagatgaattcaggaatcgtgttctttggagcactagaaagccatagaatgcttgagaatgaggtgccccttgagttgaattaaattaaggaataaatatgctaaaccgattaactagtaatcacagttcattgtgtaacttattagcttcctttcctgagcatacccaagatgactgactcattacattgacagaaaaacgtgttttcccctacagaccttgacctagaactcaactgcttcaaggtacatttctccccttgccctacttaatgtacacattatatatctttcacataagaataaaaaggctaaaggtagagatagatattgtaaattatcaatgagccagaaaagactagtccaaatgtacttttacaatatcttctcaaaatgcaaataggaaaacagaacatgaaatgtcctattcaggattataagcaagaagaccaatatttaaaggggagtgcaggaaagagaccaccatgctaggcatcatctcagttaccacaagacctttttgagatttgtataatatcataccactatagtccattatgccactaaataaatgtgtagaaaagcaccaatggaaagaagattacataaagtggaaataagaccatctcaggctcaaaggaacctacactatcatctagttcaaccctattatttaagagtccatcatatacaggtgcagtggctcatgcctgtaatcccagcactttgggaagctaaggtgggcagatcacttgagctcagaagttcgagaccagcctgggtaacatagtgaaactctgtctccacaaaaaaaaaaaaaaaaaaattgcctatcatgtacttacttcaattagctatgctgtctagtacatttttctccttattcctttagctgaagaggaatagaactggtatccatttggagggacattggactcaactaaattctcaggaatgaagattaagacagtcaggaaaaatattgggatgctaaatgagtggaaattaagggggagcagagtgtggaagtattttgtaaaaaataaaacacattacttaacatgcagaatgcagaggcattccacttttcctcctccaacacacacccaaggaggtccaggagaaataaaaaggcatggagaaacatagaagtgtaaatataggttagcagctcagtaaatattcagaaattggggaggatggaaattagtgtttttaatttattaccaagtcaggtaatctgtaatccaattacccctttgtcattttttaagtaatatgatgtatatgcccatagctacttcttattttaaaaagtataatatccctaggataaatttattataatggcatatttttgtttgtttgtttgtttgtttatgagacggagtctcgctctgctgccaggctggagcatggagtgcaaagtcatgatcttggctcactgcaacttccgcctcctgggttcaagcgattctcctgccccagcctcccaattagctgggactacaggtgcacaccaccacacccagctaatttttgtatttttagttgagacggggtttcaccatgctgaccaggatgatctcgatctcttgacctcatgatctgcccacctcggccttccaaagtggtgggattacaggcgtgagccaccgtgcccggctataatggcgtatttaaacagctatgattccaggtagtcatttgaatagttagaatcaactcataaaatattatcaaaagaaaggaaccttaacatcaccatgaaacaatctatactccttatgccctttattattctaaacattctaaataggcaaaatgggtgattaatgagctaggtcagcatttacacttatagtcagatgtctacaatgtgttaagtttaaatggagcaatgtttttttgtttgtttgtttttgggggggttattgagatggagtcttgctctgtcacccaggctggagtgcagtggcgtaatctcggctcactgcaacctccacctcccagtttcaagcgattctgttgcctcaacttcccaaggagctgggactacagaagtgagccaccacgcctcactaatttttgtatttttagtagagacgggttttcatcgtgttggtcaggctggtctcaaactcccaacctcaggtgatctgcccaccttggcctcccaaagtgctgggattacaggcgtgagccactgcgcccagcctggagcaatgttgataatataacacattatatggtttaatagcgtattatttatgtgtatatgttagaagaaggtctagaagaaggcatatcaaaatgtcaggatttgtgggaggaggagaacaaacaaaacttccaatttacttcatttgttcttttattgggtgagcaatttttacaataagcatatatgttgtatcatataaagtgtattttaaataaataaaataatattgcttagttgtggataatatgcatcttcttatcatagtttgtctctttagaaaattctctatcaggccaggcacggcggttcacgcctgtaatcctagcactttgggaggccaaggcaggagaggcacttgaggccaggagtttgagaccagcctgaccaacataatgaaaccctgtctctactagaaacacaaaaataagctgagcatgatggcacacacatgtaattccagctacttgggtagctgaagcacaagaatcacgtgaacccaggaggcagaggttgcagtgagccaagatcgtgccactgcactccaggttgggcaacacagtgacagagcaagactatgtctcaaaaagaaagaaaagagaagaaagaaagaaagagagagagaggaaggaaggaaggagaaagagaaagaaggaaagaaagaaagaaagaaagaagaaagaaagaaagaaaggaaggaaggaaggaaggaaggaaggaaggaagaaagaaagaaagaaaaagaaagaaagaaagaaagaaagaaagaaagaaagaaagaaagaaagaaagaaagaaagaaagaaagaaaagaaagaaagagggagggagggagagagggagggggaaggaaggagggagggagggaaggaaggaaggaaggaagggaaactctctatcagatgaagagatatagttgactaaatctgcctatacggcttccagcagaattaaaaatctaaaacttgtgcaagaaaccctgatatgaaagagtataaatatgaaagaaagaatgaaaatcccaatttattaattcaatataatcttattttgtttaagtcagtgggaaataaattttggtatatggctccttttacttacatgcagaggaagttgtaccaattcagattacataatttctactgtgtataatcagtttccagtgcgaaaaggtttaaaattcatatcatatcaccagttctgtatgaatccttaaaatcttaatgggactctaaaaaacaccttacagcatagataagctgtaaacaacattgttctccattgattcatgttcctccttggagtaattccacaattttatgtatccaaaaggccaaaaagttaataagatgaataaagattaatatttattgatactctggtttaaacattctcaaactctatgaggtatataattttattacctatatcttagcaatgaagtaaccaaggtaagaattttaattaaattataaagcataaataaacccccatgctaataatgagtagagtcaggatttgattccaggtagtccaaaaaaagaatgtgtgttctttccaccaagcaatactgtcttaaatattagagacactgaaggtcaaagcagcaccttaaccttttagttgaattatcaattcttgtgtgtgccaacattcaaatttaataaatgcattttattcatctatacgttctcactatttttctctatatggtatttgttacgtatccaaattttttttaaaaaaagcagggccaagtgtggtggctcatgcctgtaatcctagcactttagaaggcccaggcacgtggatcacctgaggtcaggagtccagagaccagcctggccaacatggcgaaacctcgtctctactaaaaatacaaaaattagctgggcgtggtggcccacaactgtaatcccagctactcaggagcctgaggcaggagaaatgcttgaacccgggaggtggaggttgcagtgagcccagatcatgccacttcactccagcctgggcgacagagtaagactctgtctcaaaaaaaaaaaaaaaaaaaaaagaaagaacagtaaagaaggtctcatgtaaatgagaaatgttctctacaatattattttagggggctacaacagcctggcagggtgcttaccaggatatctcgatgcttagcacagtgacttgcccatagtgtagattaaaggtcccaacactaggcttccagtcccaacactgcatctaaatatatgaccttggccattctctggctttactttatttattaaatgagcactttggactaggtaatctctaaggtcatttccatttatttatttatttattttatttattttttatttttgtttttttgagagcttgtctcactctgttgcccaggctggagtgcagtggcacaaactcggctcactgcacctctgcctcctgggttcaagcaattctcctacctcagcctcctgagtagctgagattacaggcacctgccaccatgcctggctaattttctttgtattttagtagagacagggtttcactatgttcgtcaggctggtcttgaactcctgacttcaaatgatctgcctgccttggcctcccaaagtgctgggattacacgcgtgagccactgttcccggtggtcattttcatttctataattagatattatatgcttctaagtgacaagagactaaagacatttccgtactgacctttgtatgtaatcagctgacaccacaatttagaatgtcaaactatcctcatggtattgctgatttgattatggttagaggctgatgtgtctctagtgtgcatagttataattgacactgatgggtataaagcagttcacagggcttagaacagacaaaatttgaatcttctaggttcccttcaatgttcacataaactataaatcatcctaattttggaatctgacagcttcagtaaagccttctggatttcaaagtcatctgtgattccaaaaagagtctctgaatattataccagcctctgtgtaacattctgaaatcccagctctaaataaatcttattgggtgtttggtttaaaggtgaactcaagcaaacctattattgaaaatctggttcctggtgcccagtaccaggttgtaatatacctaaggaaaggccctttgattggaccaccttcagatcctgtgacatttgctattggtaagttgctagccacaagaagaatgactgacctatatattagggtattgacggaggggtgcaatgtgcgagctcaaatcattatcatcgtatttggaaggtccatattagttcatccaatatgctaccttcagagtaataaataacaagaattgtatacttggaaaacattcttaatatttattacttggggaaaaaatcagaggcaaacattcttactttagttttcaatgattatacaacaagagtaaagctgtgtgccgtggcacacacctacagttccagctacttgggaggctgaggtgggaggactgcttgagcccagaagttgtttgttttttttgttttgtttgtctggttttttttttgttttgtttttttttttttttggagacagagtctcgctctgtcacccaggttggaatgcagtggtgcaatctcagttccctgcaacttctgcctcccaggttcaagcaattctcctgcctcagcctcctgagcagctgggactacaggtacatgccaccatgcctggctaattttttgtatttttagtagagacggggtttcaccgtgttagccaggatggtctcgatctgacctcgtgatctgcccaccttggcttcccaaagtgctgggattacaggcatgagccaccacacccagccaagcccagaagttttaatctagccttggtaacatagcaagaccctgtctcaaaaaaaaaaaaagaaaagaaagaaaagaagaaagaaagaacgaacgaaagagagagagagagaaagaaagaaagagagaaaggagaaaaagtgagaaagagagtgagaaagaagagagtgagaaagagagagaaaaagaaaaagagagagaaaggaaagaaagaaaagaaagaaagaaagaaaaagaaaagaaaagatgaaaggagggagggagggaagaaggaagggggagggcagggggagggaggaaggaaggggaggaagcaagaaagggaggaaggaaggaaggaaggaaggaagggagggagggaggtaggtattgtatcagagagtgaaaactcgggtcattaagtagaagtttgaggccattgctaagacattccttcttaactttctttttctaccccctgccctcttctttctagttcccacaggaataaaggatttaatgctctatcctttgggtcctacggccgtggttctgagctggaccagaccttatttaggcgtgttcagaaaatacgtggttgaaatgttttatttcaaccctgctacaatgacatcagagtggaccacctactatgaaatagcagcaactgtttccttaactgcatccgtggtaatcttcccttaaccaactgtcagtctttcctatgggaacaggcaaacctttatgtaccaaatgtgtctttaagaaattatctataaatttgattattttgtaaatacacatagtgtgttagttcattttcacactgctgataaagaaatagccaagactgagcaatttacaaaagaaagaagtttaattggacttacagttccacgtggctggggaagcctcacaatcatgacagaaggcaaggaggagcaagtcatgtcttatacagatggcagcaagcaaagagagcttgtgtaggaaaactccctcttataatagccatcagatctcatgagacttattcactatcacaagaacggcatgggagagacctgcccccaggattcagttacttcccacagggtccctcgcacaacacttgggaattcaagatgagatttgggtgagaacacaaccaaaccatattattctgccccttgcccctcccaaatctcatgtcctcacatttcaaaaccaatcatgccttcccaacagtcccgaaaagtcttaactaattaactcgaaagtgcacagtcaaaagtttcatctgagacaaggcaagtcccttctgcctatgagtctgtaaaatcaaaagcaagttagttacttcctagatacactcggggtacaggcattgacacagctgttccaaatgggaaacattgaccaaaacaaagaggctacaggccccatgcaactccaaaatccactgggacagtcaaatctcaaagctccaaaatgatatcctttgactccgtgtctcacatccaggtcatgctgatgcaagaggtgggttcccatggtcttaggcagttccactcctatggctttgcagcatatatcccccctcctggctgcattcacaggctggcattgagtgtctgcagcttttccaggtgcacagtgcaagctgtcagtggatctaccattctggggtctggaggatggtgaccctcttctcacagctccactaggcagtaccccagtagggactctgtgtgcagtctccagccccacatttccttttacattgcctagcagagggcatgaggtccctgccctgctgcagcaaacttttgcctgggcatccaagtgtttccatacattttctgaaatctaggtggaggttcccaaacctcagttcttgactcctgtgcacccacagtctcaacaccacgtggaagctgccaagccttggggcttgcaccctctgaagccaccaagccttggggcttgcaccctctgaagccaccacctgatctctacgttggcccctttcacccacagctgcagcagctgggatgcagggcaccaagtctctaggctgtacacagcacagggaccctgggcctgggccacaaaaccacattttcctcccaggcctccaggcctgtgatgggaggggcttccatgaagatctctgacttgacctggagacattttccccattgtcttggggattaacattcaactcctcattacttattcaaatttctgcagccaacttgaatttctcctcagaaaatgggattttcttttctatcacattgtcaagctgcaaattttccaaacttttatgctctgtttcccttttaaaactgaatgcctttaacagcaccaagtcacctcttgaatgctttgctgcttagaaatttcttctgccagataccctaaatcatctctcttaagttcaaagttccaaaatccctaagggaggcacaaaatgctgccagtgtctttgctaaaacgtaacaagaatcacctttgctccagttcccgacaagttcttcatccccatctgagaccacctcagcctagatttcattgtccatatcattatcagcattttggtcaaagccattcaacaagtctctagggaattccaaactttcccacattttactgtcttctgagccctccaaactgttccagcctctgcctgttacccagttccaaattgcttccacagttctgggtatcttctcagcagcactccactctcggtaccaatttactgtattcattcgtttccatgctgctgacaaagacatacccaagactgggcaatttacaaaagaaggaggtttaattgggcttacagttccacgtggctggggaagccccacaatcatggcgggaggcaaagaggagcaagccatgtcttacatggatggcaccaagcaagagagcttgtgcaggaaaactcccccttacaatagccatcagatttcatgagatttactcactatcatcagaacagcacgggaaagacctgcccccatgattcagttatctcccactgggcccctcccacaacacgtgggaattcaagatgagatttgggtggggacacagccaaaccatatcacataggtatggctattttcaagtttttttcattgtttttgcttttaggttttgggattctcttttgttttgagagggagagaaagagataattgtgtgaagctagctgtcaactctaattgaatgtatttgttaatcaacattttttcctaagcacagaatagagcaatcaagtgcttactgcttctcctggatcctggggaggaacacaaagagatttccctttggcattccatagttagttgacactgcctaattttaatgatgacttttcatggcatctacagatcaattaaatacctctaatgtcaggcttttagaggatgttttttaagaaaacaggtaaaaattgctctttctgaaattgagataattttgaaaagtgtgggttacccatgggctattcacaaagtacacaattaccctctacccagttgaagactctgaaggactcctgttcgtggtttacactgaaaaaacactgagttgtgagaggttacttgtcttagaaatagggagaaatgtatgtacagtcacttataaataaggactgtttcgcatgtgtaatattaggaaattgcaaaatcaaacaaatattggaaatctttggctctatatctttaaatcacttttaaaaatttatatttttgtattttactttatgtctcatttcattctagaaagaatattttattatagtaaatttaggaaacacaaaaagacaatataaaggaaaattaaaattacttattaattttttatgaaagtaagtctactccaaaaatagtactttctcccacagtcttttgtctccttgcttgcttttctcattcagagaatagctaatctgctgccagcatggtactacaacttccgggttaccatggtgacgtggggagatccagaattgagctgctgtgacagctctaccatcagcttcataacaggtgaggcatgtgtggggaacagttccacaaggagagagcattattgtgaggagttaccaaggttccaaatctctagaaagtgccagtcattcacccagcactgggtgagcatcaatttcatgggagataatattgattctgatcattcattattttgtttagttgataatctttagaaatcaaaataccatttttattttgtgttaccaccgttgacttatttttattctgaggcactgaccttgattaatgtactctccggctgggattgattagaatagaaatatggcaggcacagccatcagcttcacactgcacagtcgattgattttacccatatgatgattatatttgttagagtgcctccattttcttattaattaagccatttttaaagtcataggctgactgtagtagggtcccttgtggaaattaaaaaatagggtttagagacaggtagatctggatttgaatagaccctccgcataccacatataaccttgagcacgttaacttttctaaatatgttttttttaatgtggaaaatggggatgataatagtatcagttatctgttattatttattacaacttcattattatataagctactttgcaaaatacacgacacaaagtttaagcacttaaaaaacaattagtcttagatcctcggaaaccttaaattatgtagttgcatcatcagtagtcagagatagcaatgaaaaggggaaattcatcaaagaaacactaacccttgtggtttgaactaagacgtttcaagaaccttttatcgaacgacaaggttgtaattagagttgtcctgagaaaacagaggagaaaaataccgcttagaggaataattttggcaaatagtttcctcagtagacatctagtttactctgttgaaatgtatgagaaaaaaaaaaagtggaaagaaatcaatcatctgtgaattcttacacaattaacttacataagcatgtctcttttctttactagccaatatccagagcactttttgttccagatgttaatagtaatattagagcagaaaactgaaagaatacccaaaaaggagaaaatagcagttacttggcaagcgctgttagtcttttgcctataatgataatcacatatttaattataagtaaacttcactgtatcaataattcttataatttaactatattgatgtaaactttctgagaatgctctttccttctcaccaggacagttgtctggaaaaagctcagatgtaacatctcaacctgggactgctcaattccagctgtcaaactttgaattatcttaacgattctgggcttctattttctcaccggtagaaccccctaaaatgtcagctaaataggcactaaagcctacttagagacaactgattagtagagcaaaacttaatatattgaacaccaccctgacagtctttgcactgtcttttaagggggaacaaaagaaatgaaatattaataggatttggcttcctggctcaagtggtttaaggtatgcctttcaagatggaaaactgactaggattgggcatagtttataacagtttaaatggacatagcaagtgtggatcaataaactatggttaatagacaagctacttacctggtaagcagtctgttgtcaccaatgtattgatgttgatgattttctatcttttcctgggtcaaataaataagtgatgctgaaccagcagtctacaggtattgtctcagcatattgacagagatggtctcaattttcacatctataaaatgggtataataataataaatacataataataaatacctcacagtatgtgtgagaattaaatcatgtaatgtaagtcactattataatagattattgtcttttttatacttattttctaaacatattgaaaattctagtaggttttattttaaccttcttttttttttttttacttttactttaagttctgggatacatgtacagaacatgcagtttgttacataggtatacatgtgccatggtggtttgctgcacctatcaacctgtcatctaggttttaagccccgcatacattaggtatttgtcctaatgctctccctccccttgcccccaccccccgacagttctcatgtgatgctaatacttataacaaacattcataactaggtatgctttcaaaaataatcattcactgaagaatttgtaatatataaagtaaaaacgcgtgtgtgtgtgattttttttaccttcttatttaaagcaaataagaatctcatgcttaactttcctatgctttgaattttccaaattgtgtggtgtaaaagaaaataggaacaaaatatttgaattaggtgtgatttattaggaactcaagtctaccatctttgttaggcaattcagttggctagccctcaatcatagtaattatgcggaggggccaaagtattaataaacaaatagtgacatcttgtggccttccagcaatatgctaggttttaaagcaacaacatggaaataaaaatctgacatgtgagaggaaagatatatacttctgggtttgcaattttaaagatgtttcttttcctcactaaaattaggacatgagaaaataccctttgaagaaatatatgcataggttcttgtatatgacgaaatatgttggaatatattaggaggctataaggaagccaaggttattttcctttagtagaatattctgaaatatgatgtagatttgtgttacttgttagatgcattgatgatctttcaagattttattgctaagcatactatataagtgctactcgtatttcacatgaaacaaatgcatttttacttcatatattacaaattcttcagtgaataattttgaaagcatagctagttatgaatgtttgttgtaagtattagcatcacattaggggaaatgattctttatagaaaatttccatagattttagttgacattgtgctgtatctcagaatggaacaccgactgtcttcaaaccaacatacacctggaatttaaattcaattgtgtatttgttttttaaaataatcagagttagcagttactttaaaaaggtaattaaaatgttttcagagcctatatagtataaagcttgtgatgaattctcttccctcgttggcaaattttttattttatttatttacgttttttggctgggcgtggaagctcacgcctgaaatcccagcactttgggaagccacgatgggtggattgcttgagcccaggagttcaagacaagtctaggcaatatagaaagaccctgtctctacaaaaaatataaaaattagctggatatgaaggcctgtacctgtagtcctagctacttggtagactgaggcaggagggatgattgagcctgggaggtcgaggctgcagtaagctgagattgcgccactgcactccagcttgcgtgacagattgagatcctgcctcaaaagtaaaaataaaataaaataaaagtaatttttttttttgaggcagggtctcactctgtcacccaggctggaatgcagtggcaggctcatgcctcactgcagcctggatctcctgggctcaaatagtcctcccacctcagcctccctagtaggtgggacaacagggtgtgccaccatgcccagctgaatcttctaatttttttgtagagatggggttttgctatgttgcacaggctggtcttgaactggactcaagcgatccacccacctcagcttcccgaaatgcagggattacaggcattccctgcttaaatttttaaaaatttaaatgcataagatgataaagtagcaagctcagtgttagaatttagcttcgtggctaaaaaaaaaaaaaaaaaaaacttgttcttcccttctttctctctctcactactcactcagcaacatttattaagagcctgttttctgcaaagcactgggctagacactgtcaaaaataatgtcttgttattttatgcaaataacatttgtcttctatcctgcttgtagtactatgatcttctatcttcctacccttgtatcctactgttctttattcccataaacacctttgctgcaagtaaatgaaagagacttagtttgcaggactctaagttttttaatcctacttggctaataactccactgatacctattaatattaattggttgatgtaacaaaaatatacccaaacaagtgaactttttaggaattttgtaatggtgacatttatccaaaagactttgatatcctcaggtacagatgggtctgggggtcttgtatcttagatatacaagatgtgggatcccattaaacaagtgcccatcctgtatcaccatccttcactgttattgagaggtcctgaagttaccgggactatcgtgtgctgtgaattctaattcgctaagttgactctatatgggatttcatgctctgctggtaagtactttatttatccatctattatactaaattgtgcctcgtttctcccttgtagccccagtggctccggaaatcacttctgtggaatatttcaacagtctgttatatatcagttggacatatggggatgatacaacggacttgtcccattctagaatgcttcactggatggtggttgcagaaggaaaaaagaaaattaaaaagagtgtatgtttctttgaatgccagcattgtgtgtctgtaaatttagttttatgaactattgaaaaccactaagcaatcatttattgacacgtcaaatgtttgcataccagttgtctgttttaggctctggagataagacagtgaacaaaaattgaattcttcctttcatagagcttaccgtttaatctttaacagtgagatgtaagagctccaactattgatttcatttatatttagaattatgatttgagctttttcttcaggatgccaaacattttcaagaaaactacaattaacgtgtttcccattttttcccatatatcaccgacacctaaagatttggggaccttgggactactgatttcttttctccaaaatacgcttttggatgtttattgataaggggacagactaaactactgtaataaagaaacaaacaaaaagagagtggctcaaacaaaatagaagtttatacctctcccatgatagcacaggactaaccaggcacttctgctttaaggggtcacccagggaggcaaattctgttttgttgttccatctgccactatgcatagtccttgtctctagagaggaagctttatcaccattacatgcatgttccagcctgcaggaaggggaaaagaaaagggatgatgtggaagcccagcacttacaggatgtgaactgaactgtcatttgtccatgtgacttctacttacaatccactgatcagagctgggtcacatcatcccctctagctgtaggagaggatgggaaataacaatggctgttaggtaggaagccacacgtctacagatatgggtaggtttcttttgaacgtcttagaatgtacatatcagtagcaactcagtaattgtcttttctaaaacctgttatcaatatgtgagaaaatgtcagaatgagacccattccaaataagggaattcattgcaaaatttttctgatgtatataatgcattattaaggctacctcacattgggcccagctgaggaatttataaaattttcagaagatataacgtatctataatataatcaattgcagactgctgcatagaacagagagggaatgtgtctgctatagtcctttagttgtttggggtggtgcactgattcattcactaaaagtttaaacccttgattttgatgatcttgcaggtaacacgcaatgtcatgactgcaattctcagcttgcctccaggcgacatctataacctctcagtaactgcttgtactgaaagaggaagtaatacctccatgctccgccttgtcaagctaggtaagaagagtgcacagagatgggtgtgaaataatcactaatgtttgcatcattcgattcagcaagagctcctcaattcaatgaaataataacagaaaaatggctaattttttatgagtagaaaatagacatttgtactagcaaaagggtatgttcaacttggtacaagtttctgtgagtgggttgtatactgttctgggaaacagtggtgttcgctgttctttgtaaggttaaagaaaccaggtagtcataggattttggagatggaagcacattagagattatctaatgcagtgttcacaaccctataagacaacattctattttcatattaatattatgtaatgctctctttaatatcttaaatagtaatggatttaaaaatctacatattgattttttaaattttatatagtttcccaactccagaataaaatcaagacaaaaagaaactaatttataataaaataatatggatttcctaaatatatggtcagacacaactactctaaaagacataatgaaattacctgatgcctagatataattaaaatgaataagttggggtttataagaaataaaaagatcattagtccttcatataagaagtataaaaataagcaaagaaatgaacaagttaatataaattgataacaaataactaaacaagcatagatacaggtagatactagaataaaaactagagttaaaataagtactaaaagatgagatatattttcatataatgagagaaagatggaaataattttaattaaagtagggacaacacaccaaaagtttataaatggcagcatagaagcaagctggcttcactcccctctacccaacagaaaaccaaaagcaaatatacactctgagattttcaccagcaacaacccagaactcaaatacgaggatgcgaccgattccagagccatagagaagtgaaaatactctgggcagatggtaggagaatcaggcttccacattcgtgacgcctcccccgcgattctgcctggcaacaagtgtgcagaaaatcttctgccaactcatgtttctacactggaaaaagtgaggttgaggtagtcaactagtttccccactatcttgggctccctggcaggaaatctgtccttgccttaacccacaggaagcatcgtgactgcctgaagggagaaatagcttgaggataggcagaaacaaagagatgagatggaactaccattcccagtcccagcaactctgctctgtaacttggccaaaggagacaccaaatcagagtggctgttcagcagcaccatactgtaggaggtacatttcacaggtcccttgggcatgagccccccagctaactttgacacactgccaggataattcctttaagacctttctttttcaggacaggcagagccaaggcaaatctggacttaaggtgccacctagagctgaaatgtaggcagtgatctagtggtaaatatttgctaggcaaacatagccaataaaagacaaaacaaggcaaggcagacaaaggaaagtggactaaatagttaattatttaatgcaaagacatagttctatgcccataagaaacaacatcaaacagggaactgtgacccgcccacgctacccaggaaaaggacaaagcaaaaatccaatgactgaccctaacaagatggtgatctgtgagctctctgaacaagaattcaaaatacagtttaaggaaaatcagtgatgtccaggaaaacacagaaaagcaattcagaaatttatcagagaaatttttaaatcaaacaaattcttggtactggaaaatacgtttgctgaactgaaaaacacatcacagcagaatggacaaaggagtggaatgattcagggagctaaaagcctatctgaaaatacaccattggaggagaaaaaagaaaaataagactgaaagtaagtgaagtctgactataagatattaaaaaaaaaaggctgggcacggtggctcacacctgtaatcccagcactttgggaggccaaggcgggcagatcacgaggtcaggagatcaagaccatcctggctaacatggtgaaaccctgtctctaataaaaatacaaaaaaaaaaaaaaaattagccagcatggtggcgggtgcctgtagtcccagctactcgggaggctgaggcaggagaatgatgtgaactcaggaggtggagcttgcagtgagccgagatcgcaccactgcacaccagcctgggtgacagagcaagaatctgtcaaaaaaaaaaaaggtattaaaaaaaccttaaaagatcaaacataagaattattagtattcaagggggagctgaataaggaagtttactgaaagaaataataatagaaaacattccaaaacttgagacaggtacaaatagccaggttcatgagggtctgagaataccaaacagataccactcaaataaaatcaccccaaagcgtataatactcagactctcaaaggtcaaggacaaagagaagatcctgaaagcatcaagagaaaaggagcaaataacaggtaaacaagctgcaattcacctggcaacaaactgtacaggccatgaggaagaacatttttacagtgctcaaagaaaaaaaactgccatccaagaataatgtatccagcaaaattgtccttcaaatatgaaggaaagataaagtatttctcagaaaaacaaaagatgaaagaattcaccactaccagacctgtcatacaagaaatgcaagagagttcttcaatctgagagaaaaagacacatgcgaaaagaaaacttttcaaggtattagacctttgggaaaattaaatgcatggaccaacccaggatattctgttactgtgattgtggtgtacaatccatccataactctggtataaagcccaaaagacaaatcttttaaaaataataatagctacagcaacctgttaagagataggtaatgtaaagcatgtaaattgaggcaacaaagtcaaaattgggtggtggagagagatgaagttaaatttttaggtgtggtagttttgcttttgtttctattcttttgctcatgatctaagataagttgtcatctctctaaagtaacttgttatggccaggcatggtggctcatgcctgtaatccagcactttgggaggtcaaggttggtgaatcgcttgagcccaggaattcaagacctcatctctactaaaaaaaaaaaaaaaggaaaaaaagaaaagctgggtatggtgacacatgcctgtggtcccagctacttgggaggctgaggcaggaggatcactttagcccaggagattgaggctgcagtgagctgtgagctgtgattgtaacactgcactccagcctgcatgacagagcaagacccccatcttaaaaataagcaaataaataaataaacttgttaaatctataagattttttataagccttgtggtaaccacagcacaaaatcatataatcagttcattaaaaataaaaagcaacaaattaatacataacacttaataatcacttaaccacaaaatatgaagagaggattctcaaaacaatctgaaaacaggcaacaaaacggcagtagtaaatccgtacttagcaataataacactggatgtatatggtctcaattctcaattaaaagtcacagtgtggctgaatggataaagaaataagacccaactatatgctgcctttgagaaacccacttcacctgtaaagacacacagggactgaaagtgaaggggtggaaaaagatattccatgcaactggaaaacaaacaagcaaaaaagcagatgtagctatgcttatattagataaaatggaccacaaatctagaattgtaaaaacagacaaagagggttactatataatgataaagggatcagtttagcaagaggatataacaattataaatatctatgcacccaacactggagctcctaagtaaataaagtaaacattaatagatctaaaggaacagatagacttaattacagtgataggaggggacttcaacaccccactctcagtaacgtatagatcttccaacagaataacaacaaagaaacaacagagttaaactacacatgagacccgataggcctaatagacatttaaagaacatttcacccaactgctatggaatacacattgttttcactgcacatggaacattctccagaatatatcatatcttaggacacaaaacaggtctcaacaaattcaaaaagtacatatcatatcaagtatcttttctgaccacaatggaataagactagaaagtggtaacaagagaaatctcaaaaaataaacaaacacatggaaattgaacaacatgttcctgaacaaccaatgagtcaatgaagaaattaagaaaggaattttaaaaattcttgagacaaatgaaaatgaaaatacaacataccaaaatctgtgggatatagcaaaagccatagtatgagggaattttatagcaataaatgcccttaatataaaaaagtagaaagttcaaatacacaacctaatgatgtacctcaaggaactagaaaagcaaaagcaaaccaaacactaaattagtagaaggaaagaaatgtaaaggtcagagcagaaataaatgaaattgagactaaaaataaatacagaagatcaacacaacaaaaagttggttatttaaaaagataaaatcaacaaacctttaactagactgagaaaaaaagagagaagacccaaagaaataaaatcagaaacaataaagtaggcataataagagacctcataaatacaaagaatcatgagagactactatgaacagctataaaccaacaaattggaaaactagaagaaatggatagattcctgaacacacctaatgagactgaacaattaagaacaagaaaaccttaatgaaccaataatgagcagtgagatgaaagtcataataaagtctcctaccaaagaaagcccaggtcctgatggcttgacccctgaatttcaccagacatttaaagaaggactaatgccaatcctgctcaaacttttcaaaaaagctgaataggaaggaatacttccaaattcattctgtaagataatatgccaagaaaaataataggctgtggataaggaaaaacagatactttaacattcttgcaaatgaactggatctttttgtgtagtgtaatgtcaaaataattctttatattatgacatacagctggaaagtgactgtgtagcatacaactggaaagtgactgtgtaacacaaaacacatcttctacattcaaaaattgaccatttattgcggtatacatttagtttctgatacttatagggaaactcgaagacagtatcctaaaatctgccacagacaatggaggatggattgacacaaagttgtgtgatagacctttagagacagtatgaccgaaagagtggcaacccaaaactaaatgcataatttcaatatgtaattttcacagcagagattttataattttcatatttcaaaaattaagtttatctaatggcaataaaagtgttttccacatagttaatgcaatttagtgacatcattttttaagatgtctgctaatttttgtgtctgaatttgttcataacagtctcaagccatctctgttattacatgtgttcatattagcagctgtaagtaaagactaattcgtggttgttttattagtagcttaaataccatgggtagtattgttggcagtgatgtacttttagaaaaattttagaaaatctaaaaaacaaaaaatacgatctttcctcaatttacccagtaattgcatttctccagaactcaatgcataggtcactgagtcttaaatttctttgtctcctatttgccaagacaaaagctaagtttttgtgctgaaatactttaaaattgtataggtaatttggaaatatgtgatgtgttgattagacactatggaagtaaaaattataatattgaataatttataattttaaatactatcttaattggatttaaatatgccttttcatgacaactttcttctaaattattttacttaatttctttttaaaaactttcaatattatgtagcaaagtacttgcaatttacacttatggtggattttctctggtatgacatttgaaagtcatgtgggatgtgggacatgggacaatttgtcttttggtgtcctcttaataattccaggacggctagcatttctaagtcctgaccacaaaagaacagctaattccctctgctgtgactaataaaaacattcctccaaactttcaaacaccctcaagggggcactagtgccccaattgaggatcaagggttgtctcttacctttcctgcactgaaggcaatctgctcttcctcccttgtggtctatacttaaattctacgaatgtggagagcaccaacttccaactttgcataatctttctattaagaaaaaagttgcctgtctaccaattccagccattatctctgactctgacctctgtgggtgtaaagggccgttcaaaaactcatttccaggtaactgtaattacttgaagattgagctcatattcccaatgtcttcctttttccaagctttactaatacaggaagctattaagtgtttctcaggtcctagcagctttctccaactcatttggtttttcagtctcccttaaaatttaagttcagaggtggtcttatcaaagtagcatttagtgggcctattggatacttcactgaaatttctatgtgacatcatggtcgaaggtgcctcaggaatatgagtcaaagtcatgaactagtacaactgtatctacataggactgtgagttaaaaccatgatagtttcccaaacttatcaaaatgtttggagtctccatgtctccctgataatagaatggactatgtaaaccagcttggaaaatttatttaaactttacaagaaggaaagttgagttttcatggaaattatttctagttaatgtaacccttaggatcaataacctttttcttattggtatcttaaatatcaaatggaatattgtttctatcttattcctctctgtagacaagacaatctttttatgatgtgcctttcttattttcttgaaaacatataatgttggtttttatcctttagtcaaaagatctgttctactaatcatgttattgtgtatataagccctttccattttatataacacaatgcctgaacacctataactgcttaacagatactgttgaatgaattgaaattgcggacctcaaagttgaacatagtattgcagttaatatttaatcggaacaagtttaacctttcagagaagtgaaataatatcttgctttagtagtacctgaattgcaggttttgtgtgtgtttgtgtgtgttttttacagaactttcattctagttgttttatgtttcttcccagcattcattttgatatatatagaagtcatagtcattctcctttaaagaaaaatacaactttggcacagatttttcagagcatgtttgaatcagaatgccattgttaaagctggggccgtaactggttgggctaacctgcagttcaatttatctataatagaggcctctttagaatgcctctgaatgactcctgtgtcatggagggtaggttctacctctatagaaagaaaccaaactaccaatgagtccagtatcatataaattaatctaatgtgtcatgtgcaagggtagagagccctcaaacagttgccaataattctcaacattgtatcatcaataaacatccataaaaagaaatgcaccaataatggtgcttttcccaggatgttgaaccaaccatcccattaggaattttaggttgccagcagtttcacgaaactttggtggtatgtggtgacaggtccctttgacagtcagtcattactatcttctagtcttggtgaatcaacctggatccctgggccaactttaagaggacatgttaagtctacataagataatcagtttcccaaccttaaaaaaaagaaaaagaaaggaaagaaaaaacaggaatgagacgtgttggacacatcacaaatagctctctggtaatagaatatccattcatcaatccatttaactaatatatattaagaaccttctaagtactactcagatgccagagtacttgtggtagtcgtgatggtaatgaacccagagcgctactttcactttctgttcacaaggagcttatgatctagtgaaggggaagatggtaatagtgctgtacagtgctctacaacagggaaatgtggtgcagaatgactgtgtggtcaaagctttctttgaggaagccatggaggctatggtctgaataacaagaagaaccagccacaaaaaggccaagaaggaggatgccagacagagggaacaggcaggcctgagtatagatcttttaaggcatgcagttggaatattatcttcagagtaatgaagggccatttagagaacttaaaataaacagtccgatttacatttaaaacaatccctctggttgcttaatgagaaagggattattgtatcaacaatgaaagtaggggaactaattaaggggctatttgtgccagctttaaaaattatattctaattcaaagaagttgcaagagagtgatggtaactttgactacggtggttgtaatggagatgaagagaagtggacagaattcaggagctcttttggaggttgtgtccacagaactttctgatacggcagaaacacgaagtgagggaaagggaaattaatgactcccaggcttcacccttgagcaactaggacaaatggtggcgcaattcactgagattgagatgactagtaaaactacaggaggaggacatttagggtgaagtaagaatcaaggattcttctttggatgtaaacaaatttaaaatgattattggatatcccggtgcagatgtgaaggccaggggagaattctgggctggaaatataaatttggaagtgtctggatgaaatcaccaagtagtaagtaaagacagggaagaaaagagaagccctggatcaactctagaggagccaccccagcagttagaaattcagcttagcaggaagcatcagaaagagagagtggaaaggaacagctaaggaggtcagagaaaacaaaacaaaacaaaacaaaaacagaattgcacaccaccatcatcaaacttatgctttatcctgaccacagacatgttcgggcacgttcgagataaggaatcatataactttagtgctaggagagcttttggagataattcagtgctatgtcctcatttgaacaagctggcgcttagagaaatgtgacacgctttatacattgctaggtcttggtccagaaacagtcatttcgtactttttatccatctgctgcttctattcctggactggggtgtggcctttttccttcaaacttcattttttctattaaaaaatttaacagaacagggaggagcctcatacccacttttgtgactttccgttcctctttggaatttggtcttagggacattggcttgattttcttaatcttactcatacaaacctttatagagattagaaatctttaaaacataatttggctatggacaagaaaaaaatcaaaatactttgaaatgttaagtatttgggggatagtaggctttttctctctgtctctctcaaatatggttatagatacatagaaatctgtaggctgccagtcagctagaaagaagctaataaaatgcttaaggtcttatacttttttaaaaaattattcatcctgtgaatcagagaatatttacttagcatttactatatgccacacactattcttggttctgagcatacagaaatgaacaaaactgacaaaaatgtcaaccctcattctaatggagaaaaggagatgataaacataaatataagaatgttaaatggtgataagtgtcatggagaaaagtgaaagaggaaaagaggataggaagtgctgtgggggatgggtgcaatttttgtgaggagtagagtaagtgtcactgtgaaggtgatgtttgagtcagagcctaaaggagatgagggagtaaaccaaagagatcactgggatgagattctgtaggcagaaggaaccacaggtgcccagctatggaagcatagtgttcctggcaagttcaaggaaaagtcaggcaggcagtgtggctgcaatggaacaaacaaggtagagagccatagatacagggcagagaggtagcaagggaacagaccgtgtagggtcattgaaaagacactttcctgtgagtgagatgattctccattgcatgctttaagcagaggcgcataacctaacgggtttcactgggtcactctggtgataatagattgttcagggcaaggataagagcaggaaggagccaattaggtaatatgaccatacatccctgttgccttagacaataccactttgcaactcttatggattatttaaaaggcagtaatcctctttaggatttggggcaaggcttttctgccccaaaagtgttcccgtgtggacatttttgataaattacatggtcaccttaaagtttagagaacactgagtctgtccagataagagattatacttgtttaggtcagactgggagccacagaggcgatgaaaagtggtcagattcaaaatttattttgaaggtgttgctgagaaaatctgctgatggacttagatgttgtctatgaatgagtaaaagcagcctagagacacagcaagatttgcggcctgagcaattggaaagacagaggtttgatttattaacttggaaaagattatgggacaggctggtttggggcaatgtcagaagttcaggtctgggtgggtcaacattttgaaggttcctatgaaaccattaaataaatactgagcaggcagttagataaaggagcttggattcagtgaagacttcaggactaaaaatataaatttgagtgtaggcaggcgacagatgtgatgagttaacaaagactcaataaagaaaaaataatgctatccaggaactaagccctgggccactccaactttaagacatggagatggtgagtaaaaaccagcaaaagagactgaggagcattggccagggaagcaagaaagagcacagaaaagtgtcctgtcccaggagccaagggaagagaaagcctcagcgagtggagattgtccaggtcaaacctgtgaacaaatctggtaagatgaggaatgagaattgaccactgatcttagcagcccagaagtcactggtgattttgagaagaggcatttgggtgccatggtgacgggaaaaaaaaatctaaaatgcacaggagctaaagaatagaagaatccaagaatttttggtagttttttgtttttattttgttttctttaagtgagtgaaaacagcttgtctgtagactaagcaaaatgatccaacaaaacagagaaaactgttgatgcagcatagttagaggtgagacttggtgtgatgtccttgactggagcagaggagatggaacccggggatccagtggaaggattgggtctggatatatcttcaggaagacaatgacagacaaacagacagtatgggcattaatgggatagtgagcagagtgaagatcatgatagccgcttgtggatggtttcttctgattgacttcttgtaagataaacacatgcatgttctttaggtttgcagggggcaatacctgccatgctactcttctgatatatacctccatggccagcagccccatgcaagcattgttttctgatttaggttctcagtgacagccatgccacagtcccatggctctgtacctgggcctgacactaaccaatccctcgcctcaatatacccctcctcactgcagtcttctgagtgtcaccatggtttgtcaactgcccagaggcataccaaaccactttagtgcttctttttttttttgagacagagtcttactctgtcatccaggctggagtgcagtctctgctcactgcaacctctgcctcccaggttcaagcgattctcctgcctcagcctcccaagtagctgggattacaggtgcgcaccaccacgcctggctaatttttgtatttttagtagagatggggtttcaccattttggtcaggctggtcccgaactcctgacctcttgatctgcccgcaagtgcctcccatagtgctgggattacaggcgtgagccaccgcgcccggcccactttagcacttctctaaaggcatttctcctgcccatcataaggtactgcatattctgcaggtacatgattctctccaatgtattggaagaatctgaaggagggacacatagggcaatgactgtgaagtctggcattgacctaaatacacaagcaagtgcccactctggaaaagttggtcttctaagcaaaggaatttttctggaggcctggtcatccccacttatatgcaactgactgggtaactcgctgattgggaggaaaacaggtgtaataaggacccttgattaggagtccagaggtgtggatcccagttcttgccctcacaaacaaattgtgttaccatagcaaagtaactcagaccctctgaattccagcttcctatctataaaatgagtctgggctagatgatcttttatgctccttcaacttttagaatttcattccatacctgagttcagaataaaagcagcaagattaatgatgcaatgaaagtgctgatcttattctaagaattttgcaatatatgactcctaacaaaataaaaatgctaagtaaaagcacatgctcctggaaccactgaaaaggaggtattcagatatttgttttgaaactaagtgaagagaatcagaagggtgagggggtgggaagtgggtggatgatgagaaattatttagtaggtacaatgtatgttatgtgggtaatgaataccctgaaagacctgatttcaccactatgcaatctatgcatgtaacgaaattacactagtatcccataaacatatgcaaatttttaaaaatttaaaaaaaagaaagtaatgttaaatgggagctttctctgaaaaactctattgatctttagaagttacttaaggtactaaaactatcaacccatctagtgattcacagaagaagatattatacttgctatctctaagccttaaagaatataggtaaggctgggcacagtggctcactgcctgtaatcccagcactttgggaggccgaggcgggcagatcacttgaggccgggagttcgagaccagcctgcgcaacatggtgaaaccctgtttctactaaaactacaaaaattagctgggtgtagtcgtaggtacctgtaattccagctgctcaggaggctgaggcaggagaattttttgaacccgggaggcggaggtcgctgtgagctgagattgcgccgctgcactccagtctgggtgacagactgagactctgtctcaaaaaaaaaaaaaaaaaaaaaaaaaaaaaaaaaagaatatagttaaaaagtaatgcaaatgacagacatttctaactcctgagaaaattttatttttatatataggaaaaaggcctcataatttaatgtgttttcaggtgctaaatatttgcctgaatttttttttttatttcctggttttttttttaaatgttcaaattacttgttaaatgtatctaggaaaagaatttccctaagtcaacaagacaaggtctaataaacttcaggtctaacaaagacttctgctgtttaatgtaaatatttctctccttaatttcattgcatatcaatcttaactcaccctgaataatttctatacctcttgtttattttcctttcagacagtgctttcttttgcagatgttatttcaccaacttgagcatagtttctgcagtccacactgcttacattgcagatgcttcctttggccaagtcgaatatactatatgacttacgctgcttaacatagagttgcttgagttgaggaaaataaaaataaatttaaaagacttatgacaatatagatgttaacatttatgctttgcatatgaagagcattctaaaaaactgttatcagtgaggctaaagattgaaaataaatgttgttatgtggatcatggattaagataattttaacaatacttttctacttaattttccttattaccaatgttgcacatttgtaaaatgactcaccacgctggtccttatggatataatcttggcctcataaacatcattctctaggcagctaaattaatgagtcacattaaaagaagaaacaatgtaatagctatcagagaaagatgggttttagacaataaacacattacattctgctcctaggctaaatattacatctgactattccctttggaattcctgagaaaaggaagagatttgctgccagagcacagaataagaatcagacactagctcacacttcaggaaggtcactttcactccccagagatcctaggcaacagcttgagcctctcataatccaatctaaattaaatggtagagatggccttgcagccttccagtctgcccatattctatgcattgtacttgattttcttataaaattagattggattctcagtccaaacccggagaggcatggaatgagagagaagaaaagaaaatagggaaggccagctagttgagtggaacgccagcaatattagaaagcttttagagggtatttaaaagcaaacaaccctatatctatacctcattttatgaaaatggtatgtctatcccccttacccatatacataggtactcacaccaaatatcatggactgtgaagttattttaaacaaaaggaaatttgaccttttggagcatgagaatatggaaaatgttatgattgaaaatgtcatttagagagataaaaagcaatagccaggagatgttccataactaatatctacatgactttacattatataaagtgtttgtgtatgcattgtcttaaatttcatttactcttctcaacattattggttttttcctatccttctgctttagaagactgactgtatttgatattttatagggttttttcatccctcatgtgcagaaagggacatatttggtattttgaatagtaagagactgtattagtttgctagggctgtcatagcaaaataccacagactgggtggcttaaacaacagaaatttgttttctcacagatctggagtctggaagttcaaggtccaagtgtgagcagagtaggcttctcctgaggcttgcagatgatcactttgtaactgtgtcctcacacggtcttttctttgtgcttgtacatctctttactgtttatatttcctcttcctataaggacaccagtctgattagattagagcacgtgctaacagcttcatttaatttaatcacctctttaaaggccctattcatcctgggtgtggtggcttacgcctgtaatcccaaaactttgggtggctgaggtgggtggatcacttgaggtgaggagttcgataccagcctggccaacatggtgaaaccccgtctctactaaaaatacaaaaattagccgggtgtggtggcaggcacctgtagtcccagatactcaggaggctgagtgggaggatcgcttgaatctgggaggtggagtttgcagtgagccaagatcatgccactgcactccagcctgggtgacagagcaagactccacctcaaaaaaaaaaatagtcacattctgaggtactaagggttagggtttcagcatatgaatttaggcggaggggatataattcatcccataacaaagatagaaagcaatcaaaatgcctttgatgtcattgtattccctatcatatgcaattgcctaattaatatttagccactatctactttaatcttgtgcttctgagaatggaaaacatgagtcatgtaaaccaggggtgtccagtcttttggcttttggcttccatgtgccacactggaagaagaattatcttgggccacacataaaatatgctaacactgatgaatcaaaaaaatttcactaaaagtatctcacaatgttttaagaaagtttatgaatttgtgttgggctgcattcaaagccattctgggcagcatgcggcctacgggccatgggttggacaagtttgatctaaaccatcttaggctgtggcactgagctggccttgacttctcatgagaagtgggaaccccctagccagtttttgccagaaatttccagacttctactctaggcaataagaagaaatgctctaactcagtactattcatttgaaacataataagggccacatgtataactttcaattttctagtagccacattaaaaattagtaaaaagaaacaggtaaaattgaattcgatatactttatgtaaccaaatatatccaaggtcatattgttccaacatataatcaatataaataattattaataagatattttattcttttctcacactaggtctttgacattctgtctgtattttacatttgcaacacctctcaatttggactagccacatttcaagtacgcaacagctacatgtggctagtggctgtgttggacaattcacattccgattcttacattttaaaacatttcctgggacagttgttgtcttgagtaggaaaatctaattataagcactcccaattcaattatactttcacttgtgaaatcttgtaatagtaataagttcataattataataacaataaattgtaataactttctttgtttcctttgggataccagagttaaatttctgcctgattaatttagggaagcacaccaatcacgaagatcctgaacagtcctcaagcaggtgatttatgtatgtattcattgacctatagagctgacatgtaaacgtcttccagaaaagtacacagtgatcacaggtgcagggaccttgaaataatctattgccctcatattccacccaaaaagaaaaatttgttacgtggttgttagatgtcccagacctttaggagattttcctgaggatcttatcacctagagccacattctcagccagaacaaaggaaaccctcactgcagtattcatgtcgtattccttggaccactgggagctcttgcagtaattcatgatagttcttgactttgcccctgaaattggataattttacctacataaaaacagaagagaacattaagatacaacctcagcgtgtctggtcttgcctggtgcttgaatcctcctcttttggttgatgaatcttgactcatgttttaaatcagccgataaataagattttttgagtacctataggtggctacttcaaatgaagacaaagtcatttataacacatgacccttgttcttaaagaatctaataggatctactagaatcaggccttcactcacatagattatataggaaataattaaaggcagtagaatgtcagagaagggataaatcattaagagaaagagtcaccaaatgagacttcaaggaggaggtaagactttttcttgaccttcgaatgagcagaataaagagcatactgattgaaggcaaacatgggctgacatagagcactgccctgaagttcagtgagaagactgtctttcccaggaggcaacacatctgtgtgtcaggaatggtggtgaagctggttggatagcatgcagccagtttaagcaggatcttaaagacatggtatgtttggatgtgataccacagacaatgcacagataggatttaacatgagtgaaatggcattttaaggtgattttaatccgttgttgacaaaatgaagaaagaattgattagagccagggaaaaagaggcacagcaagtttgtgatgatcaatgaatgtgatcacaaaagtctagacatgcaatataatttaaaaatagattaaaggaggccgggggtggtggctcatgcctataatcccagctcccagcactttgggaggcagaggcaggcagatcacaaggtcaggagatcgagaccatcctggccaacatggtgaaaccctgtctctactaaaaatacaaaaaaattagctgggcatggtggcatgcgcctgtagtctcagctactcaggaggctgaggcaggagaattttttgaacccgggaggcagaggttgcagtgagccgagattgcaccaccactgcactccagcctggtgacagagcgagactccatctcaaaaaaaaaaaaaaaaaaaaagattaaaggaaaaggtaacgagtttttaaaagatatgctctctgggactgagaaataagggaagagcctcagaattgtgactgaggaacaattctgtagtgtgcatttttaaaaaagaaaagcctaggctcagcctaactaatcattcatctatgcccccaaacaacttcacacttggttctatagattcaagttccacatgagtcagaatccctaaaggacataatcctattagcaaaggcagttataaaggaagtgagaagtggaaattgacctctgtgtttcattagcagtcttcctcagagcagaagtgggacaatacaatgcctggaggactggacaattcattgcaagtgaaaaagggctcctgacacctattgtgaattttgcttgcctaagaagaactcatctctttcctccttcaactcttctgcctaaccttgtcaagttgctgcaggaaagaaacatgcttctttttagttggacacaagtttaggagatctgtgataaatcatggcaagaatgattttgacatacttcttggtcctgggcagagtcacaatgatgatattctagaaacaaggttcaaatctttccacacaaagatgtgtacctgtcaaagcagtgaaatggctgacaggactttttcaagcacctctaaaggacaggagctggagaacagacttaggagagtggggcagaaaatgaaaaatccaagtaacaagcaggaagaaacctacaacagtgggtagtcgtctgacaggcgcatataggtggatggaggatgctgttatgtgaacctagcagcaaggtacaatatgtccaaataagcaatgtcagggggtctgagagcaggtaacagggaccccagcttaaaaccttgagttcaggcacagcactctgcatactgggggacctagagggaaagacaacatccaaaagacagggtcacaagcagaagaccaggagacattcaggaatggagaatgagacagcagatgactattagaattgaggaacaggcagggttttttggtctcaagagagcaatgccagtgactcaattactagaaataagtatgaaaaggacagacaacacagcttcctttacgaatggatttatttattattaagataaaatgtctaagataaaaaatttatctaatgttttattaatcttccaatcccctcctatcaattcttttcttaaaaaattatattatcagccaggcacggtggctcacacctgtaatcccaatactttgggaggccaaagtgggtggattgctggagcccaggagtttgagaccaacttgagcaacatggcaaaactccatctctgcaaaaaatgcaaaaataagccaggtagtcccagttacttgggagtcgaggcaggaggatcacttgagccagggaagatgaggcttcagtgagctgtgttcgcactactgcactccagcctgggtgacagagtgagacccccgcctcaaaaaaaaaaaaaaatgatactatctgtttagctttatctttttaaattttgactaaattttcaagcagccatttttctgtctgaattgttccagatagtttccagagaaaggaagacaggttgttggctaaataccaaactgcatctcatcattagaaggaagcacaccaaatttcatttttctccacctttattaagtgcagatttttgtttctcatccaggaagttctgtattatcagggcaatgctaacttcagtataaatgacacagaaactattaatagattatgactatgatgaaactgaagtagaaaacagaagtgttctgaaaagagaagtaaaaaaatggaagggggaaaaggcaaagtattctgccttccaagttagatagctatctttatgaaaggacatatttcaaaggcaatataaagtctttatggtgctcttacctacctatatttgaattgggggatgcttcacctgcttattagtgaaagaagaaagaatacacttagtaaattaaattttttttaaaactttgtctttgctcagaaccagctccacccaaatcactcttcgcagtgaacaaaacccagacttcagtgactttgctgtgggtggaagagggagtagctgatttctttgaagttttctgtcaacaagttggctccagtcagaaaaccaaacttcaggtactgtaccttttgatctaccttttctcagttaacttaagtaaggctaattatctgggcaaaataagaatcttctatttctttgagctatataaaatgaaaactgtttatttgctcttttgtgtttcactgatagaaattaacagcaggcttagaccaagcccaaaagttgttatgagaacttttatctttgtctgtatcacttgttcctaattcataagtcactccaggtcagacaaaggaataaaggtagtaggccattgaattgatcaagggaagaaagaccctacaatataaaatataatttaacaaatatgaaccatttgccaagtatataaaggcactgaatagaacacacatgatagaatcaatatttgccttcaaaacatttttatatggtgtagacattgcataagtatagaaaaaagtaaagtaaaatataagtaccacaagacaggtccattcgaccaagagaatttaaaagaaacgtgcatatctagtttgtaagggggacagtcttattgcaaaatgaagactgagagaaggttattgctaaagctctagaattacaaatggcagatacgataaacagagttattcaccaggtcagaatgaatgaaaggaaagagatgaacctgcagttctatgagtggcaacgccacaaggaaaaaatatttcacagccagaagtgaaaggaaaaggacagatttgttagggattttacataatatagtgtgtagactaatactgcgaacataagtaattgatcttttttaaataatgaagttcatgagattgagaagaaaaaaggaatgctgggagtgcaaatcttttcatattgaatgctaagataatttgctttgattcctttctccttttgagattcccttctatgaatgtatctcttgttgatttgtactgaacagctgaattttctctattctaagaatccttttggaaaataactgctctgccaataatggattttcttctctataactacagtgatgccttcctttaagaaaacaatggttagttagctacttactacaactgagtcctgttagcaaaagtctttccttagaataattcttttatagaatagtgaaagagaaggaagtggaagaaaatgctgatggctctcatttctttatgcaagggtgtttcaaaatcttgttttgaaaaaaatgctggctcatcttttgctgttgtacagtagtacttgtcactagtctggccatgggtccaccaagttagcaacttctttgactcaagaataagttaatactaaatgtttcttagtgcggatagttgccatgttttagtggatgttatataaaagctaagaatgcagacaaaggtgtagtgtccttaatatataaagaattgctacaagtcaaaaaaggtaaaggtcaacaacccaaaacaaatatttcatagaaaaatacagaaatctcttgaacagatgaaaacttcagcaacctcacttacggtaaaaaaaaaatgcaaaataaaactacaatatacaattttcactagtaataatgggaaagctcagagtttgcaaatgtatggtactggaaagaatgtagggaggcaggcattgtcacgcattgatgccaaaggtgagtaacttgcaaaatgtctgtagagaactatttttctatagctttcaaaattttaaatgtacactttttgactcagcagttcaaagaatgtgacactagcaaagaatatatgagtatatgtgtatgtgtgtacgttcacacatatatacatattacatgcatatattgtgtgtatatatgtgtgtatatatatgtgtgtgtgtgtgtgtgtgtgtgtctatatgcatatgtgtgtgtcttcccaaatttgtgaaatgaagttcattgtagcattgtttgcaatagcaaaaaatcagagaccatttacacattcatcaaccggggctcattaaataaattatggtatgtcctttcaacggatttctgtccagctcttaaaaagaataaaacagcttaatctgtactgatatggaaaaagcaccaaaatatattgatagctaaggtaaaaaaattagcagaataatgtgtaggctaagccatcacttatgttttttaactgtgtcatatatgttcatacatccataaaatgcatatgggaagaaaaataatgcctgacaacatggaataatgctgcttccatggaagggaattggtcagatggggaatggggaaaaaaggaaacatttttcaatgctattctttgtcatcttatacattttttactctgtcaatctattaccaactcaactatgaaatatatttttaaaaaatatagatgaagttaacctaaaatttaccttattttctgaaaccccaggaaccagttgctgtttcttcccatgtcgtgaccatctccagccttcttcctgccactgcctacaattgtagtgtcaccagctttagccatgacagccccagtgtccctacgttcatagccgtctcaacaatgggtaattatacacattagtgtataattttctcactttttttgaatatatatatatatatgtatttgtatcaatattccaccaagaaatcccaagcttcggagtcagagagtccttaatttcaatcccaaagtgcacttactagctatggagttagagaaagacatttggtgcctctgagcttttctttcatctgtaaaattggaataataatatgtaactttctgagttgttttgaagcttagaaataaaatacttaaatccttagtatatgctgtctaaatgctagttgctaactcatctcatcttcttcagtaataggcacagtactcttatcaatccaatttcatctatttagccttggtcttcatctgtcaccgatcagagaatgacataattgataactgggtcaaagcaagaaagtttccaatccagccaaaagtataagtgggaaaattagaggttaatgaaaggtctggaatgatgctgtttatttccttattcttttcttagttgtattacatgtgttactcctggtttgttagagtctgattctgcaacctgagaccctctatgaagcctcttgtaataaagtcactcataacttcactggtttagttccatttctgtaatattagtcatatatttagctgctaaattcagggatgactggagcggactgttttcttttttctttttctttttggttttctgtttttaatttttgttttttcagaagagaggacaaaaaatatacctgcaaagtattttaatggtctctcattcctacatccttgtacactttctaaaatatacagttgacgatgaataatgagagacttagaagtgccaacctctgcatagttgaaaatccatgtataatttttgactccctcaaaacttaactactcataggctactgttgacctgaagtcttaccaatgatatagacagttgatcaacacatttttgtatgttatacttattatatattgtattcttacaataaagtaagctagagaaaagaaaatgttattgagaaaatcgtaaggaagagaaaatatatgtactattcattaagtggaagcagatcttcataaagatcttcctcatggtcttcacattgagtaggctgaggaggaggaggaagaggagggtttggtcttgctgtctcaagggtggcagagagtaaagataatccatatatatgtgaacctgcacagttcaaactcattttgttcaagggtcaactgtaccttaatgtccatcattccttgtcagctccatgacaatgtagcataacaggtgatattattaaacttatttataaatgaggaaaatgaggcccatagggcagatgaaatggcttctctccaaatagcagtactcaagcgaaaaagctcttctgatcatgcgtccattgttctttctgtttaagcactctactcataaactggagccaagctggcccaaatgggaagtggtaaatacccagaaccttagggatcagatgcacctgctcattctgtgactttatgatcaatgcaaaagatggtatgagtcctcaggcccattttaaagagttttataagaatattaaacctatgttcctgcctttgatatcctgttcttccgtgtagtatgaagaagtagacaatgtgtaagtgccacaggagacaagtctttatatagagtacatgaaaaggacgtgacccctgttcttcagggccctacaacctattaataggttttatctcttgagctgtgcagatggaaaacccctaaacatatggccacggatcatcagaatgtctgcttctagtaatgtgttaagtgcttcagcagatggtagtttgctaatgtctttttgatatacattattagttgtaagcaaagtatacagttgtgctttctgacttcaaaatcatgggcgtaaaataagaggttgccaccctctaagcttgtgaaaatgttaaaaaacgataatgcatggtaatgacttccacatttttagctttcaaatgaatttaaactgtggcacaggtattcttcattctttagtttccctatgtaagaatatcctgaatgttgtaggcctttgaaagggactcaattcttccagacacctcaataccacttatcagtctagtttgctaagttacagttgaccaggaagaggtcattgctggcttggggaacatgattgttactattattggtatcatcgtaagctcactgcccttaagactagatgaaaagcaatgaatggttctgtttggttccctgtaagagaacctatgatgaaaatgcacaacttatctctttagttacagagatgaatcccaatgtggtagtgatctccgtgctggccatccttagcacacttttaattggactgttgcttgttaccctcattattcttaggaaaaagcatctgcagatggctaggtaagttaagttttactaatattttatccggaatctttaaaatatctttatctgccatatatatattgtttttgcacacctaagttgtatagcggtatattggattttagttttcagtgtctgtttctattgtgtgtgttttctaaatagacttcgaaacattatattggaaaatattaccattgaaatgagaaagcaaaggattgcttgtttacacaaagtcagacctcttgctatcaatcttggcatttgaagtagcccatatatggagatccattacatttgggtactttcatacacatttggaataaaagaaatatctatgacagttcagtatagttaatgaaaaaagttaataaaaatggagatgacaagaaagaacggggtggggggcgggaaatcctctccataattttaagctgttctattggaaaatatttgtacagtttatgattaggtccattagcagtctctattagttttattcctattactcagagttgcagccagcttagtttttcttgcaattagaaaagcctttgatttatgatttcagctcttccctgttcctttgaccactgatgcattgctcatcagagcacattctcaagtagtttctgtggccccctgtattatcagaataatctatcaattcccttaaaaactgttgcttatttgaatactacttggtttgggaaattttgttaacatttatatttgcccaatattaacctgctgaattataaattaacattcttctcctgtctcagagttctatcactcacatatttataaataaattcatctatccaatagtgatctaatcagtgcctgacatggcatatccaaagaaaaatcagacatcaaagctgtccactaggagcttacttacctaactggatatatgaatagatagatatatttaaaggcataagctgacatgtagcataaaggggattaaaaacaggatgccatgaaactagagaataaagactaattctgaatgtgaaaataagcttcttgaaggttggcatttgaataatcttaaaaggataagaagagatgtgggattgcactgtaactacagtggagagctctgaaattacactccttgaggtcaaatcttttttttttttttttttttttgagacagagtctcactctgtcgcccaggctggagtgcaatggtgccatcttggttcactgcaagctctgcttctcaggttcaagcgattcttctgcctcagtctcctgaatagctgggattacaggcacgcaccactaggcctagttaatttttgtatttttagtagacacagggtttcaccatgttggccaggcttgtctcgaactcctgaccttaagtaatctgcccacctcagcctcccaaagtgctgggactataggcgtgagtcaccatgctcggcctccttgagatcgaatcttgacttccaacttgcgtgaatttgtgtaggtcactgaaacttcatgcgttcatattacaaatattgctacatatatgacagtatatgaaacagacaaaaatatgtgccttcatggagctcatattctagtgggagaaatagacaataaacaataaagatataagtaaaaggactgccccttaagttagcaggtgataaggaaaggaaacaaggtcaggtaagggagataagcagtaccagtgtggtgttaggggtcctaggaggtgggtaggcttcactgaaataatggcattggagcagagacttgaagcacatgagggaggtagcctgtgttatctgtgggaagagtgtgcccagtggcaagaacagctggtgtaaaggccctggggtaggagcacgactgggatgttcaaagtgtagcagaggggccgttgtgactaaagcggaggaagacaagagtagaaggagatgtcaagttatgcagggcttcgtatgcctttggaaggactttggcttttactcagtaaaatgagcaggcattgcaggctctggagcagaagattaacagcatctgacttagatttaacactttcattttgacttttatgtagaaaacaggctgtattgaggcaaggacagagacaggcatatcaactgtggtagccaggaatccaggcaagagatgctaatagttcagtccagagcagcaacactgaaggcagagagaagccatcagattctggacatattttgaaaataggagcaacaggatttgctaataagttgatatggaatggaaatgaaaaaaggagttgaggctataatcccagcactttgggaggctgagccaggtggatcacctgaagtcgggagttcgagaccagcctgacaaacatgaagaaaccctgtctctactgaaaatacaaaattagctgggcgtggtggcacatgcctgtaatcccagctactcaggaggctgagacaggaggcagaggttgcgatgagccgagattgcgccattgcactccagcctgggcaacaagagtgaaactccatctcaaaaaacaaataaacaaaaaaagagagttgaggctaactcctgggtttttggcccaagcacttgaaaggatggagctgccatcaactgagagaggattccaggtcagagttgggggaacatcaagacttcagttttggaaattgtattagtcagagttctctagagggtcaaaactaatagtacatagtagtatatatatatcctattagatattatatatagatatagtgtgtgtgtgtatatatatatatatctcctattatatattatacatagatataggtatatgggagtttattaagtattaacttccacgatcacaaggccccacagtaggctgtctgcaagcttgaggagaaaggagagccagtctgaatctcaaaactgaagaacttggagtccaatgttgaagggcaggaagcgtccagcacaggagaaagatgtaggctgggaggcgaggccagtctctccttttcacatttttctgcctgctttatattcactggcagctggttagattgtgcccacccaattaagggtgggtctgcctttcccagcccactgactcatatgttaatctcctttggcaacaccttcacagacacacccaggatcaatactttgtgtccttcaatccaatcaagttgaccctcagtattaaccatcacagaaatgttaagtttgagataacttgcaagtgcaggtgcagagtagccacctggacataaaagtctaatgtttgaaagagaatttttggttgaagatataaatttgagagttgttggttctgcacagtggctcatgcttgtaatcccggcactttgggaggcaggcagctcacttgaggtcaggagtttgagaccagcctggccaacatggtgaaaccccgtctctactaaaaatacaaaaaaattagccaggcgtggtggcgggtgcctgtaatcccagctactcaggagactgaggcagaagaatcgcttggacttggggggcggaggttgcagtgagctgagatcgtgccactgcactccagcctgggcgacgactgagtgaaactccgtctcaggaaaaaaaaaattgagagttgttaacatataaattgcgttagagctttagactggatgaaattcagggagtaaatgtaaaagaaggccctgcattaatcactggaacaatcaatattaaggttttcagggagaaaagaagataacagtaagcgactgacaaagaggcagccagtgaagtataaggacaactaagggagtgtggtggcctggaagctaggggaacaatgtgtatgcagaagagatgataattgcccctatattagtggatacttaggagcattaacgcagtaataacatagcgtaatactcaactcataggaagtgtgcagtaaatgttagctcataatagtaatggtggaggaggtggtaatagatgtaatgcaagtagtggtatttctgagcattttttgtggtacataccaaagatatttaggagaggtggttctgattctttcagctagttattaaagcatagattctcatcatttttcatgctatgatcctttttggcagtctggtgaactcttctaagaataatgcttccattttctgtgcctaaaataaaatacataggattatacaactatattgaaatatgataatcataatatttaaaaagcaaatgtgttgtacactttttaattagtatattcaatgtcaatatgtaatagtctaacaatttcatcatggtgatgcatatgaccaatatttcaagatatctgcagcaagtctattattaaaaaatatgtaatctctattgttagcaaatcatccatgtggatattctgatggtttggtacctactttaatgatagaaaggactgctaagtttagtcacaggttgtgaaaataaatatgtacccttttcccacatatgttcatagagtcctaaattctatctttggaactccagattaaaacccttgagttacaggtaaaataaatcccatatataggaaattgacataggaaaattcattaatgatgtgtaaattataatacactatgatattatattagtgtatttttcaaaagaagaaaattgttcttggaacaccttaataagaacaggtagataattcaagtaattagcacattgtgccagtaatgttaaaatctctgcttcagttctgagtattaaatccattaattccgtataaagaaaaaatgagatacatgagccccaatgagctgttattcatgcatgaaattagccaaaagatagagaaggcatgagaatatgtttactttttctctacttctggaaaaaaaaaaaaaacttcaacagtgtttttactagcagattaataggccacattccggacagtaggcacaccagaagcttgcctatttcaatacattccactcttttattctaatctccagtgatgaataatacgggcatcacaatataagagaaagattttggaggaagtaaacaatccacttgatccactatcattgtagggaggaaatcaaaatgccataaacaaaaccctacaaagaatttttgctaaagatggaaaatgctcagttcatctaggagagtttctatgttactattaaaggctttgtaaaaaaataaataaatattataccccaaatagttcaaatatttcttttagaatcatgaatgccctttggaaaggattgtgaagtgaattcttttggcctcaaataatttgatttgcaaacttgcaaaagattatttcttttcgttttagctttctgttttgcattgtatgccaaaagggaacatatggaacttctattagcttcttttattttgttttttttttttttctttttctttttgagacagagtcttgctctgtcacccaggctggagtgcggtggcgcgatctctgctcaccacaacctctgtctcccaggttcaagcaattatcttgcctcagcctcccgagtagctgggattacaggcaagtgccaccacgcctagctaatttttgtagttttagtagagacagggtttcgccatgttggcgaaactcctgacctcaggtgatccgcccacctcggcctcccaaagtactgggattacaggcgtgagccaccgcacctggcctagcttcttcttttttttaatttaatgctgtgatgataagctggtaaagactctctttacttttaggtcaacgtaagaatgctttgtcaagcagtaaccttgattttgtggttcctttaaaacagggagtgtggagctggtacatttgtcaattttgcatccttagagagggatggaaagcttccatacaactggtgagtattgttttggaacaagcttctacatagtttaactatgctgtgtgtgctccaaagtcgattttactatcctttggggatagttttgtctgattatccttttgtaatttcggtgatggtagactttcaatggctagatcttcacagaatataatggtttatataagctcagtgcagttctgaagtagggaaagcatcatggtctgctctgtatttacaatactaaacaagggactgaaacagtggtgcacacgcaggagcccatacctgtgctgaaaaagggcttaaatgcaggagcgccgctgaacaagtggtggctaaaggcacgagaagagattccaatgaagcagcttgcgacagatcggcttctccattttattttatattttattttattttattttttattgttttgtattttttgaggagacagaatctccctctttcgtcacccgggctggagtgcaggatgatctcaactcactgcaatctctgcctcctgggctcaagtaatctttccacctcagcctcccgagtagctgggactacaggcgcgcaccaccaaatctggctaatttttagatatttgtagagatgaggtctcactatattgcccaggctggtctcgaactcctgggctgaagtgatcctcccacctcggcctcccaaagtgctgggattacaggcctgagcccccatgccaacccagcatctccattttaaactcacatttcagtgcctgaggcaataagagccaccacttctgttaaaaagttgtacagcccagtattcagttctcatgcttacagataaataaatatcaaagccagtgaagtttcataagaaaacatggcttcatttttctttatgcttgagtattaaggacccggaaggaggaagtgttcgaattttaaagagcattgtcaagagattaaattggttgacattatacctgacaatgatagatgaagattaacaatcctatccagttcaatcaatgcccaacaaaagtactaattaagtaaacatttaacatgaagctaacatgtactacttacatggtctagtttgtttcttttgcaagaaactatgcaaagtatatgtaaatgaatatatgtcatattaatcattgttcagttatttctttctgtttactaactccctaaaatggttaatcttaaagaaatacacatgggagactggaaattttacagaatcaatgagggagggagaactttatttaggatataaattttacttccctcagtgtagctgatactcactctagttgaaaatctagttgaaaccagatttcttttaataaggcaatatgttgtgccatttaaaaattttaacatgagtagaattttgctattaaaaaacaacccaactgtgaagaaaaagaaatccatcaacccttgatggtgaaaagttaggaaacgttactaggtttgttcaaatatattagcactctttccaaaattaagaggttgactcactgatacttgtttcatgcctggttcacccttgggaggcccaatgggagatcagtgatgagtggcccatctaggaaccaatccaattatatgtatttaatacttgtgactcatgagagatagatattaactaacttcacagccagtcacaattcatggaatttatgggagaccagtcatgggagagctgaagcaaaaaagaattcacttcaggatctttctataaaatcaagcacattttgcagctcttcacaaagacagttttgccgactctagcattttctagctgactgagaatagatatctcagtgaagatttgtaataactgaagtgacaaggtgacagtatttttccccctaattctcagaataactatagatgcagtcacaggatattttaaaatctatattaatgggtgttctatttgacaagtggtttgaatatctgaaaccaggcatttaaatcaacagtctgaattagaattgaagtgaagctaaactattttgctcctacttagctgaatatcagtgaggtcacagactaagtagttgatgagctacttatcttgaatgaatgatatccttgtatcatccatacctctgttttaagggttatatttataaattttatagtaatttaaaaacaatacagaaagtcacacctagtagtgcagctttattaagaatgtctcttaaaagcttagtcttcaccggaatcagtatatgtaaactgaccatttttattttctcacacaagctgctgtttagctgtcaaatgatgttacagaggtttcttaaaataggcttaagcataggaagaataatatccaagaataagcttcaagataactaatgaggcatataagtgcttcatttaactgaatgcaaaatgtaatcacctggtagcagactaattaacacaaagtaagttgaaagaaatatatctgattacaataaggtcatgtgtgaataaaaactgattttgtcaatattgtagcatttaagcccgcacatttatatttcacagaatggattaatatttaattgtaattaaggtgcttgtcatattaattaatcccaataggtaatttactgatatctattcacagtttatattactaactcttgcaactttttcatctttccatctgttgtctattaatgcacacaggcgtaggagtatatttgctttcttaaccctgctaccctcatgtctttggactgattatcttttggcattttatattaatccttggtaagtgatttttttttactgtttaacacaaactctttaaaagttagctttcaagaagtaaacaaaaaggaaagtttctttttaactattttgtatgttcagtaacatctaaagttattaatcatgtattgaagtgaattaaagcagttaccggtacaaagatattaactataaggttttccgttaaatttttttccgtgatgttgttggcaagcgttttttcccatttagtactagttatttgtttcttcattgagtcaatccattggcctctcatctttgcaaataatgctttccattttccattatcatcttcatccattagagagctccaaatttccaagaaggtagaaatgcattaagatggagaaatcagagtctatacaatcctctgtatctgaggcctccttgtttttataataatgctaactcagtgactattaaacagctgactatacgcaagcctctttgtatgattatctgatttaattttcccccgcaatcctgcagagagtattactagtcccattttagaaatgtggaaataggggcttacggagatttactgtcttagtagcacattccactatgtacagaatccaggttccaaactcaggtctctctgaaatctattctttcctctgtaaagagcagactcctttaatttcttattttcttaacttctggatcattttaataatcaaatcttgaagtgttccttttgactttttaatatgtaatgataacagtaaccttgaattctgagactaaagaattaagaactctttcttttcctgtgctataagataaaaggtagcagtttccaggggaactgacaagaaaatcattgtccttaaatattaatacctagtgtttaggtactaaattatgtacagacagatccataaatgtggacaacttgaaaaggtctcagaagaaaacaataaaaatatctcatagactggaaaaaaaatagcttatggggtggtggtgcgggtatgaaaagcaatctggagcatttatttattcaaaaagacaattgaccaaatgttctccagctcctccaaggacagaataaatacagctggcagaatttaggatttcaagttgcactggaaggaacataaaaaaggatttcctcaaaatagagattgttaattccagaattcatatcttcttttaaaaaaagagactagaggaaagcttttgaaacaaagtagacatgatgtgtaggtaataaagtcagaggaatgtgctagatgctgaggacccattcactgttattctaagttcattgttacagtttttagtatagggcttcagcacagtcaactccgtattttcagtatttgacatcaaatagttttcaggtatgaatagcacacataaattccatttcaaccttcaaaatatacatttacttttaactgaacatctactaatcatcctcaaatagtgtgcctaccattaaaatactaacagcaaatacccataaagtatcccagattgcaaataaaatgaaagaaagatgcatatatcatttccttgcttaattctctgagactttctcattttccacagtgcgtttttaagcttctgtaaggtaggcctgtgcaagtaagcatgtattccttaataggcctcattgatgaacatatgctcaaatttcagcaaccctcacaaggtctgctatttctaataccaatcaaatagcacgaggcccaacttatggggagaaaatacccttcagtaatttttagaagaatcaccttgaaactgtaaatggttgtctccagttgagaagagaaggtaaaacatagagctgcatgctttctgtaacttcagtaaatttcacacatatcaactagtaaaaacatactggatataaactatgttctcagcccttttgtacaatgccagatacaaaagaagtgaaattcatgctccccgctcgtggaaatacagcttctactcacacaaccactccaattccctgtttgcttcatctaataacttgtggttattttcccctgctttcattggctaaagagtcatttttaatcctcctaatgatgtgtttgtcttcatatttcacctaccctgtgaacaacagctgcaaataacaagagccatctccccagacgcacactgcctaacacactgtccaacttcctttctaaactgtcggtttcttggaaatatatgttcctgttgattttctaaaacccatctgatgccactagtggtttgtgtggaaatcaaaaaactctttctctctctcatagtgttgctcgaatctcttcctggggtggtagcagaatcagtgtggagcaccagtacccagttaggttggtctcaggattgtgttctgcaaggatttctgactttcagaacttaagagtatgtttcctattgaaagaaatcatctaagttgaactagctatatctagattcagtgttaaatctttttttttttttttactgccataatgaccctcatgctgtactcaggtatttatctgcttgttctcaatcctaggcagttggcattttaagcaagaagtggcatttagttgaaaatgctcagctttactcctgatgattgcacattctatttgaagaatgatataatatactaaagtcctttttaaggtttggggatggtttctgcttagctcatcaaagagtaagcagcacttacaaaattggagacttttagagttttgttttgtcttgttttaactattataaatctcatgtccttgctattgctttttcggaatgaattgcagtatggatggctttccaagactgtcataaccatggctaatttatgcagaatgtatcttaactttttgaagtcattaggattttgaaccttacctaatataagtgaaagagaaaaaactaaaagtgcacaatcctctatgcatatatgctgtaggtatgtctgatgggggttatttattgatttggaaaatcttttgcaatgaaaaggcgaaccctacatgtcacacaaaatcgtcactgtaacatgtgcacatattggctctttccagaatgtgcttaagttaaaattgctagcaaagccttaatttgcgtgaattttcccctggttttagtctcggaattagcacagcaattgaaaatgtaggaacattttatcagtgttgctgtggagtttcataattcaatcctgtcatgttccacagccttaggatacagaaactccttggaatcagcaagatctaaatagaacaatgaaaattgtatacaaatcatgattacttatgccaataagtatatgataatatgtcatacaaaacatgtagtggaattatacgttatattgaaagttcattcaataatgaatgagattgaaagaaaaaaaatgtgtctctcctccatgaatcaagtttctacgcagctgccgagtagtagcagcttaatatttcagcactgaatttattcagtgttaccctcttacatacatttgttacttcctagtttcttttaaagcctgtttggataggaaagtatttttttgttcactcctgatcacaaaatgtgttggcagcctcctgactttaccagagctgttagtcatctccgctgacattctgctttccgaaagcactgaagtaattggctcttactacaggaagtaaatgtggaactcctaaaactaactaaattaccatcacggggctgaataaaaaacatgatcaataaatattcctttaggttcccaaatgcctataagatacagctatgtccaacatgatagtgttttttgaggggatcagggagaggcaaagtaaaaactggactgatttttccctctaaatctcaagtgtggaagacaaagaggatgagggagaaaaaatagaacaagaaccattgaatggattgttttcacttagaagtgggaagaaattaaaactacctgaaaaccacaaacaccacttgccttcgtggacgtgttcctacatttcttgacctgcattattttctcttcatccacaagtcccatcttttcaatcagaacatcacaagcccaagtctagtattcaattgttaaaggaatcattaggtgaaattcagagggtaacatggcagagattattttgtttcagttcaactgaataagcatttattgaccacccactaggtgtttcattaactatgctcagccctggggggaagctatagtgagtgtagcaaggtgtgtacctgcaactaacaatcacacaatgtgagaaactctccgtttgcaaagtgctgtgaaagcacaaagtactgcttcgtcctgctaaaagctttcaggaagtggagatatccaaacattcataattttaaatataaataaatatttggacacattaaagtactaagattacaactggttatttactatagactgtttattttctgaaaagttgggtgcttctatcaaaattatgtaaagacctctgaaaattacttgcaaaaaagtttgctgtaacatcacttgtacagtcaatcatgtttctgtatttactatttatagacaacaataagaatacaatcacaaagtgcttcaatagatactgttagccttagctaacttaggtaagttatcttacttggttgggtgaaaatcattaccttaattatctcctaaacaaatgtaactaactaaagcatgcattagcatttcctgtgtttgagcttatagactagtaatgatgaagagcaagcaggtaataggtccagttcttcagatagcttaaaaattagttcaagatggaataaaaacaacgccatagtagaattatacaaggtacatgtccacactgacagcacacattcacatccccagagaaaaatgtcagaaaatgttattttagtctttaattaagaaaacaacattccaccgtctctttattagttctccatttattcccccattcttccttcctgcctgtagaaattggagtgttcaggtggtagatagatacttctatatatttacaaactgctttagcaacttaatcaacagcagttagaaatttcatttctagaactcagtttttggcaaatgggaagtataaagtgcagatatgttcatgcaatctagtagagttttaaaaaatgaatctgaaattattattatcttctcatgtaaggaaaagtaaacaaacctgatatgtgtttaatgaaaattaaataaaactgaggtacctgatgtaattatttaaagctgttcaagtttaattattatgttaatcaattcttctgcccagataaatttgtcttttcttttttaattatcaggagtaaaaatggtttaaagaagaggaaactgacaaagtaagtttttcttactatgtcatttaaaaggatgtttgttataataatcttaacgttccaattaaagattgcttgtcttcaaagagaagggacgcttaagaaagaggcaaatgcatattacaatagctaagcacaataatgtactggttgtttatgcctgagtggcagtggccactagaaaagtgtatcacagaaatcacatcagaaataaggacaatgtttatcatatcaaatctgagagagtggatcgttagcaatttttaaagtcttggaggaggaagtatggtattctaaatacagtatatgaaaatctaatatttaactacatcaaagggtttcaaaaatccttttagtattttgaaattctgtgtttattgcaggaaaaggcttttactctatttgatgttataatagatactttgataatgctttctcaagaaacctgtataataaatagaaaagataattaatctagcctgtggttttccttatctattaaaccattaaatgagaagaattactattgtggtaagtgaaaattaacccccagttgatttcaaaagcctattagattatcacctccatgccttttcttagttataattctacatatgaaaagtggaactttcctttatatagagtttgttcttgatacctgcctggatagaacattggtgaattagtacaagaaggaaattagggggtccagccaggtctgtggcatctatgcttatggaaagaaatcatgagtaatccatgacataatccaaaagaaaagttgatgtaaaaatgtttctagttagtcttgagtggcatataattttatggcatatatgaaaacagaataattttttctaagtcaatttcattttttatttttattttttaatttattttattttattttttggagatgaagtctcgctctgtcacccaggctggagtgcagtggcacaatcttggctcactgcaacctctgtctcccaggttcaagtgattctcctgcctcagcctccccagtagctaatactacaggcacacgccaccatgcctggctgatttttgtatttttagtagagacgaaatttcactatattggtcagactggtctcgaactcctgacctcatgtgatccaccctcctcagcctcccaaagtgctgggattacaggcatgaggcaccgtgtccagcctctaagtcaatttcaaaccagcatacattccactggcttataccaactgatgtaggagagataagaccagactgaatagaggagagggtaccatcacctgggagggatgatttcacagaaacagaaagactttgttaccaaaaactgttggttgggttggcaggtgagctaaagaggcagagactagagcatttagaagatagcgtccttggacgaaaaggagagactgtcaaggcttgctcctcccatgactcaggcaaagaaaagaaggagaagcaagacccagacaaaagatagggtagagattaggagtggtagaacatacccacaagcaaaaaaaaactcacatcaattcggcttccaccttcccccctctcattttcctttgactcctctctccttctctagaagacatttcttgaaaggctttcctctcacctttttatttgccttctctaccatttctctttccctccaaatgccccaccactaccatatccccctggttcccattttctatctccacttgtcttcattccatccttcctttccatcacctcctctttttctttttcctctgtagatatttgtccttttggtctctactcccttccagctttctttttcttctccttgtcattctccttctcccttatgtccattcttctgtttgctattccttcctctctctctcttttccctctgcttcttgcttttacttcttttaacccattaatactttgtctggtttgccttctgtatacatgtgcccattttcctagtaacaagatgaaagctagagttgttaaatccaactttaaggtcgatacactgcccaaagacaccagccagagagtgcagttctaagggggttcattccaggagaggagtcccaactttagcccattcttttggaaggataacaagtttgaagtgggaaaagctttgaaccaggacttactctccctggattccagtgagaattctactgcttagtagacatgtgatgttgggctactcacttaactctcttagccgtggctctctcagctggagcatggagctaatgttgtctattcctacctcagggatcaattaagcaagataatgcatgtgactatttatgaagtgtagcgtgttttataaatgagttattgttattaagtaaaaacatttcagtttaaaggtattctctggaagatataacgccctctaaaatttactaaaatgttaacataaatgaattaatcagattagctaatcaacaactttaaatgagcattattaaatactatgtattttctaattggacataagaccacagttaggccaggtgcagtggctcacacctgtaatcccagcactttgggaggctgaggcaggtggatcacttgaggtcaggatttcaagaccaccttggacaacatggtgaaaccaaatctctactaaaaatacaaaaattagccaggtgtggtggcacctgcctgtagtcccagctacttgggaggctgaggcaggagaatcgcttgaacctaggaggcagaagttgcagtgagccgaaatagtgccactacactccagtctgggtgacagagtgagactctgtctcaaaacaaaacaaaacaaaacaaaacaaaacaaaaaagaccacagttagatgatataagctgagtaacacaccacaagaccaagggaagggtcaactataaagaccctgccaaagtggaaaggcttgagttagatgacagaatgtggaattctgcagaagcagagagctactttagagagcaaattggtttaggtaggctctagaggagataagcagctacagaaaactacaggagataaaacttgattcttattctcaaaaaaaagtgagaacttctgctgcggatgcagaaacatagctcagatgtgttacttgattgaacctctgagccatttccatacttttatagatatgcaagcctctaaagataactcactccagtgagaccctgggagctttctggacaaaagtttcatcccactgatcctgcctctgctttggggagactgtagctagcagcacaattccttatacttgtaaagctgttgaaacttacaaagttctttatgtactgtatgtcaaccctgtagctgtaactactgtattttatggatgagaacattgactctgaagagttaggcgattctctaggataacacagtcaataaagcaaaaccataactcaaacaggtctttggaatccattcctttgttattttccatatgccagagttttttagaagcaacacagatgggggtgtgtgtatacgagtatgcatatatatactactgtactgctacagtaagagccaagtggaaatctagagatttctcctatcaaggaagctggatatatatgcccttcttttcaattgcaatatattaaggattggtaacttgaaccaaaaaaaaaaggtgagtgctaaccttagagaagtaaaacttctattttctccaagaagattaagaagtatgatattaaacaatatataatacctatcaacaagaattttaaaatgtatgtatatttctttgtgtttggcaaagcccggttcaactggatgactttgatgcctatattaaggatatggccaaagactctgactataaattttctcttcagtttgaggtgagttggttaaggcattttctaccttctgtaatggaaagggcctgggaattggggggtttgtgttgcggtcatgtccctgctcactggcagtgcgtaacaaaaagggtattggcctggggattgctgatctgctggtttagagcaagggttgtcaatccttgcttagtaggcaaggcctcaggtggcacaaatgagatgaggggaagaagagaataggtgcaggtactgaggtgagcaaacatgggtatagtagaagccatcattgaaaaccagggaaatcgagagtacaagaagaaaaatgcaagctgaggcatgaagcctgagacagaatttccctttcaggggatttgtagtgtttctcatgcttcttaggccacagtagtggcggatagtggataaaactgaccccctttgtgtcctgggcacataacatcctggagtagggcttttcaagctataggactcctggcattctacttaataacttttgtgcagttttattttctttccttggacaaattggggagataaagttacacatgatttgtgttaagaaaaaaattgacaacatctctttttttccgaaggacacatatttctttggatctaaaaccatatgtcagaagagatggaagtgagtgagtctaatatctcagcagtgtgggggaagataattagttctcactttttctttctacatattttatagctcataacacagtctaaatggccccccatccttcaggtttctatagcatggcttgagtggtcagtgattcagggaaaaggggaagataaagtgatttttctaaattctgtagttttttttttttataaagccttttaagtgctcttttctattaaggtagctgctttttcttcagtttttaaaatcatttctcctttccacttctcagccaaggacagctttagtctgcaaaaagcatcagtggtcctggtgtggagacactaatggggaatttgaggatgagaagaatcttatacattaccaaatacaaagaccgctaactaccacctgtgtcctgaaaaattccacacagagcctgctcacttatccattgtatccaggtgcataggatattatagatgctacaccaaatgctatactcaaagaaattcaatttgaattggaaatgaatgaggaggatggcatttcagaaagtatatcaaggaaaggaggactttttttctaagcaaacatgaggcaaaactctgaaaaaataaatagctagatgattctaacgatgatagaaattatggtatagctacacttttaccttattaaagccacattttcttaattccttcaagatggcatgcccttggtggcacagctggatcataacctctgctggcaactcacagtttatgtcttgaaacccaagcataactattactgtttctgaattgcatgaaaaaaaattcaacaagtcattttccagtaaacatattcttttagttgtgagtgacaaaaacatagctcaaacttgtttaaactaaaggaaagggggtttattcaaaggatactaaggtatctcatacaatcaaagaaaaggttgagtagctagactacgtgcagggaagcagcacagtttcagggatgactggagccaggggcccctctatttctcatttctgcttctctctctgttttggtttcactttgtttcactgaacaaagagaaacaaagagaaacgcagccagagagggcagatgtttgtgttcagtgaaacaacaaacaacctctttttctgtcacttttgttttgttttgttttgttttttgagacagtctcactctgttgcccaggctagagagcagtggcgcgatcttggctcactgcaacctccgcctcccaggttcaagtgattctcctgcctcagcctcctgagtagctgggactacagttgcccaccaccatgcccggctaacttttgtatttttagtagagacagggtttcaccatattgactagtctggtctcgaactccttaccttgtgatctagctgcctcagcctcccaaagtgctgggattacagccgtgagccacgatgcccagcccaacctctttttcatagtgaaaagcagccaacaacaacccttgagcaccacagccttttgtttccatggtttccaaagggaattactgtctgtctttcttgtttgtagtttgaaaattaacaggggaggattttgatggacgagcctgtgtcatggtgcccattcaaaccaatcacagccagagagggcagatgcacagaatctctaaatggaaccatgtgggctcaagtagcaaaacctaagaagggcattatctcccaataaagagagggtattgggagaaccaaaccataagcgattagcatgctatctttagatatcacaaaaatatgaaaagcagaattataaattttatgtgctaaatgttcaatttataatatgctgagggcttttattcattcaatggataaatgaatacatttagcctgacttcataggatttataagaaatgtgctaaactaggaatctaaaatcctgaatcctcactacagtgttgctactaattaacattctaaaaaatatgtttttttcttaaccaattgatatataatgagtttggggtgggcttgggggcggatgatgtattagctacagattttttatgtagtgaacatgctcatgtataagtttcaatttatccaactactttgttggaataattcttatggattgaaactgcccaggcaaagtatatacaaaatctgcattttgagtaaatttcccataagtggagtaagttttcccagtgttcctaaaactatacaaacagtatagtatagtatatacttcctaaaactatacaaagagtagatatcaacatttgtaatcattgataatgtaatattacaaagaaattgctttctcatctgttaacgttaagctacatcatcttcatatagcactattagtcatttgtgttatttcattttcctctgtttcttttattttcatgtaccttataatcttcatcattttgttactgatttctaacagctgatttatgattaaagaggttaacattttgtgaagggctgaaaatgaaataccatttttttctcatttttttacattggggttttatttggagtttgtacagaagttgtgtatttaaaaaataatcatgttctgcttttttttaagtacattttctcatcaccttagtttctttatgtataaaatgggtgagttgaactagatcaatggttctcaactggacaagtaccagtcagcccccagatgaaatttgaaaatgtgtgggagtgtttttggttgttataatagcttaggaggaggatgctaacagtattttatggaagagggacgaggcgttaaatgctcttcaatgagtgggacattcccgcacaatagagaattgtcctaggccgaaagtgtttgattgagaaatatgggttaaatatgggatgaggctacaatcaagctttataacccatgtgtattagtcatgggttctccagagaaaccaatgggatgtttatatagaacaaatatgatgtatatatagagagatctattttaaggtattggcttttgaggttatggaggctgacaagtctgaaacctgaagggcaggctggcaggctggagatccaaggaaaagttgagtttgcagttttgagtttgaaggcaatggggaggcagaattcctccctccttgtaggacctgtctcttctcatcaggccttcaaactgactggatgaggcccagccacattacgtagcataatcagccttcctcaaactctacttacgtaaatgttaatcacatatgagaaaaacaccttcacagcagcagactggtgtttggccaagcaactggacactatagcctagtcaagttgacgtctaaaattaaccattacaccacgattttaaagtctttaatattgttatttattctgatgctctcttcatacatttctattcttagaacattattggtcatatatgtaattaattgggtggtaagtcctgacattatttacatattctggtaggaaaatacaacttactctctagggctctgttttaagtcacaggcttagactgtatgttttggactaacatttgctcaagcagtggcccgctggtccaatttacttccttcttcatttgacagacttcagatattaccagtcctcagtcccattctgccccctacatcctcagggtcagcgtcagggtttcctcatcaattttcatagaagtagtgtgctcccatgcctgatttcaggatgtatgctggacctttcacatggcagccctcacatttttttgaaatacattgatagttaattgagacttaaggaaaaaaatgttcctaactctaatgagaattcaagagggtatgagatggccaaatcaccttggtctagataattccagcagctgaacttgtacttgttctgtttatattaatgcctagtatttgtattcattttgatactgacattgaaatatcacattcacattgagaaatcacatcatttataagcattttgcagattgaaactaatgtctggatttatagatactaccaatacagccataagtcatacatgaagctatatgagttactaatttgtgtttactgaataaatttcttttttactctgaatctgattttaaatctgctagaaagattgattatccttctgataaaaatatacaccgttcctttaaaagtcttgggacccagggattaaaataggttcctcattttttacatttcacatgggaaagattttgaagaaccagactttatagctgaaatgtgagagcccagaagacatatcacatattgctcattctgctattaatgtctgtgcttagtgtttgatcaggatactagtaaaggccctcaccatctctgttcagacatgtggctgcaaagatcaaaacaaaactacagaactggccatgcagttcacaagaggtgacctttgatttctggtagtagcttttacttgctatagatggaacctcttctgtcaacaccactggcactttctttctcctcactttttccaccccttatggacacgtaatctagtaatcttagtattgtttgaataaaccccctttcctttagtctaaactagtttgagctatgtttttgtcactcacaactaaaataatgtgtttactggaaaatgacttgttggattttttgtaatcatgcgattcagaaacagtaatagttatgcttgggtttcaagacataatgtccaccctatcccaaagcaaacaccgaaagcaaactctcacctgctgacattgttacaaaccctaagaccagaatgcagattgtgctctcctcagaagatgatattgcaggttatgggctgaatatctgtggccccccaaaattcctatgtttaatccctaacccccaatgcaatggtatttggagatggagcccttgctaagtaattaggattagataagctcatgagggtgaggacttcgtggtaggattgttgcaggacttttccttagttcagctaaagatgaggtccttgtccatcccacagccatgaaaatttaggttcacaggcaatttggagggtgagtaaaacagggttttattcggtgaaaaggaagaaaagggagaaacagggactctcactaggctggagtccctgctagagcacttcccactggcagcttgaatctcaggttccacacaggaagaggagaggccaggttccttccccactgcaaacatggtgaacttcccgaggctccacctctgtgagcaggctagttggaatttctccaaggaccccctcccacctgactgtctcaggatcagccaagataagatgcctaagaatgaaatctaccttgttgccatcttgatcttggacttcccagcctccagaactgtgagacataaatctctactgtttaaactatcactctatggtgttttgttatggcagcccaagccaactaatgtaatgtatatgcttgtgctttgctttccaagacctgtatgcttcaaacacagccaacaaaacgtagcctgctactgggtttgggtgaccgtattagttcctatggctgccataacaaattaccacaattgtcgtggtttaaaacaacagaaacttattctcacaattgcagagccagaattccaaaatcaaggtgtcagcagggccacactccccctgaagactctagggaagaatttttctttgcctctttcagcttctgttggccacagcaattccttggcttgcagctgcataactctgatctgtctccatctttacatgccttttcctcttctccaggatgatctcatctcatgttctctaacttaattacaactgcaaagacactttctccaaattagatcacactcacaggttctgggggttaggaggtagacgtatctttttggggatcaccattcaacccactacagatgactgtatagcctagaagaaaagggtgataaattatatttagaaacaaaactgacaaaagaaaattcagaaatgatttatgtgggtttcaggtccatcactccatagtttgtcttcataaagatttaagccagtggaatttccatatggttggaaagaaaataacttcaaagctgctgaactggaaacttaatattttattttccacttagtgacaggctaaattacaaaggcttcaaagcatactgtgtttacatgcagttcccactttgctgcaattcaactttggcaacttccacttacagtgttcagccaattaaacctctcttatcaacttagagtatttacagcaggaaggcaacacacaattaaagttctgtcagttagtcagcttccacaattaaagttctgtcagttagtcagcttccacatgtgctcaaacgctcagcctcaatctgtttccaccattccttttgtatctgaggccttttcccatggcttatcagtctgtccccaaagcaagagaattgggggaagagttgttggtctgctggcataaatggcagaggaggaagaaattatggagccaggcaaagcaaaacaaagaatcatcacaaaagtattttacaatgatcatcaatagtgctgtattagtatttgttgagttaaattattccatttgataatcactataaaaaaggaaggtgtggagaaattactagccttatcttacaggtaattaaagcaaagtttaaaagagtttaactacccttccaagaacatacagtttataagtggcatgtcagaatatgtgagatattttgaaaaaatatctatgcaggcattttctaaaggaggtagatttctgaaataatttaagcaatggaagcatcatttaaataaacttataactaccaaaaggaactaacctaaacatcacactgatttagttgaaatttactaaaaataagttgcttcttacaagaaaaatagagtcaacctttgaataccctttaaaatggaacactcagttataaaataacaatgggaagcatctgcctaaatatatttggcaagtaagtgcctgagatggaaaaaaccaattttgtgagttgaaaatcaaatgtaacatagtttgtatataaaactgacatcaacttagtccaaagaacttcagatattgtcatcttgaaaagccaaaagagatgaggaatcaaaggaagagagaaatctgggcaatttttgttggttcatccatgttggctacagtcaggcaacccaatgccattaagcgcaaggtaatttgccaccaaggatcttctagttaaaagcatcagaagacccaataacttgattaataaagcatgtgctttgcaaagagcacttgaataaagacacaaagggcatgaaacagatatccctattcaatcctagaacgtggtcaagtggctccaattctcttcaacagtgttaaaagaccctccgaaattcttctcctagggaagtattcctccagctttgattccttgaagtaataattgggaggaattatgaagagtaaaacttgtgctcaatattaacattctataaatgtaaataaaatttataacaagtgatttttgcctcgcttagtagtcttatagaaagatgcacactatgtgggtaatcccacttatacacagttatgtacactgtttactaacattcctctaacatttgtataggaatataactagatccactgcattggttgcacattgtacaactccagtgaacaccgttcatatagaccacaatgtgaatgatgcctccaagaaatacaggtggcctgaccgtaatccccgtttcctgtaagacacatggcatagcaacttagaaatccccctttccccataacataccctttttgaagtgtgacagttatttatataaaaatttcccatcagttcaccttctgaaatgaggtttataagagtaccaatatacgcaggcagacatttggatgttcttattctcactgaaggattttccccaacaactacagatccatctttatgtttgaggtttcattaccagatatttagtgactgttaatcccatactttgtaacatggagattgttccctactcattcctcactattttttactactttctctaaggctcattgcctacaagaaaaaaaaagcctagatttcttcagagaataggaaatatttatacaaattgcataaacttaagttactctattcctccaaaaatctgaaatgcatttttattttcaaatatttcataccctgagtgttatacatatagttcttacttctccaaatgaccactaagttatccaaggtatttatgtgttgtattagatagctattaccacaataatgctgtataagaaacaacctcaaaatctctacaataacatttacttttctcactcatgggtctgtggaacagctggggcagttctgcttcaggctgtgggtcagagtcaggtctgccctatgtgcctcctcattctcggactagcagcttccctgggcatgtctttttcagggtagatggcaggcacacaagagggcaaaccaaacaagcaagtgcattgaaagcttctgagtggacttgatttctatctaagatcattggccaaagcaagttgatgatagtggggtggagtaccttccacctctaaagggagctactgcaatgtcatatagcaaagggcttgtgagcaataaaccagttgaacaataatccaattcacaccacgtatggaactctcaaatccattctctgtcctttacaggagttgaaattgattggactggatatcccacactttgctgcagatcttccactgaatcgatgtaaaaaccgttacacaaacatcctaccatgtaagatcgtcaattgtgccaataacactcatgtcttaagggttgaaggactgtcattgcagattaatcaatttcaccaatctctggccatacccacttgtggtccggatctcaaggccacgtctgagattgcattgatctcactctcctttgatgtctttagatcttagcatatggaggaagatttaattattgtgcttttaaatgaattgcatctgaacaaaaagactgatcatttggccctttagagattaaagagccacagtcaaattggggattggatcatttgtactctcataaaatattttcagccaattcattggtaatggaaagaggcaaatgggaaggcgatgcagtatattaaaatgccttctctaacttctgacaagttatatagttgcttagcattttgtaataaaaagcagcattcaaggaaaaaaaggtaatataaagcacttacaaaacaattaaaatacattccagtttagatttcacttttctctctgctacacgctgtggagctaggcatgaatggaaaagtgagaagagaaaggctgaaaaagctctagaaagagaagtctcttcttgatatggtttcttgatgaaattagatatattatcataataacacttcacatctgtacacagttcagaaattacttctttaatttaatgtccacctacaaaagaaacccatgcatcttctgttctctaggtctccttaaagtagtgaactctctggatatctctaggtgaaatgaaaatcgtgtgcttaggctatatactatagctgtccaatcaatctcacagatattgtagttcctgaaatactctgaacaacacctaaacaatcctggaaacaattctttcaaggacaggagagctggtagtgaaaaaaaaatagtggttggaagatattcacttatttatttaaacaacaaaccaaagttgaagaatagctaaaatatcaggctaaaaattattatctgcctactctgtcactgactgatttaacttaatattggatagaaagggccaaaataatttttccttccatcttgaattttaatatttttttctccttattctctacagatgacttcagccgtgtgagattagtctccatgaatgaagaggaaggtgcagactacatcaatgccaactatattcctgtaagtagaaaaaaaaaatcaggcatcccaaagctaaccagccagagaaagactagcagggctatatggatgtgtcaaacagttcaaaagagagcctttcccaacccagcaattgaattctaaaaagtttgcattactccgtttcataataaagaatagaaagaaaaagtccatagattactaatgtttctatttctttataaaggtccagtgaaagggaaagtagaaaggttaaagatcacctctcttatgtttaaatttcacattcagcaaccaaattcaaagggttccaccctagcacctgcacttttaaaatataaagacagttattattgtcataaaaaggtgtggatgtgatttttacagccttctggataacaatgcttacaatcacacagactaattatggtcagttattctgatagcctctttgattaaaacaggagaaaacattacataggtgtgtgatcctttgccaattttatcaccagtaagttttcagtttttttcccataggcgtgaagcagcatttggtgttgacagtgtctggttaggtgataattttgtcacttatctttcagggatacaactcaccccaggagtatattgccacccaggggccactgcctgaaaccagaaatgacttctggaagatggtcctgcaacaaaagtctcagattattgtcatgctcactcagtgtaatgagaaaaggagggtacgtacttactgaaactgctcccacttagcagcaaaacctgccctagccactgccgttgatgaaatgcttgctgttttcaaagtcaaataaaacatagagacaaatcgctaaatttaaaacattgtattcgggaagcaagaattagaatttgggggtaaacacacagacccggtggtctttgcaatgtctaaaggaaaaaagagaaggttggaagtcttctaaaaaggagaaatattgcatattgttttgcaggaaagttcattagcactagtaaagttttggggagctggcaagctctgattggtgaatgcatggtggtgggtaaaactagtctcagagtcccaacaggctgtttcagttgctgttagataccactggtttcaagttactaaaggcagtttcagcaaccggggcttacagagaattacattcctggaacaatgttatgcgttctgagtgctttcttttttttttttttttttttgagacggagtctcgttctgttgcccaggctggggtgcagtggcacgatctcagctcactgcaaacctctgcctcccaggttcaagcgattctcctgcctcagcctcccgagtagctggggcattctgagtgctttgtcccctgacccctcaactctgttttagttagatatgataagaatgacccaagtcatgtgataagaattcacactacgtagcagaaatggtttgctttatgtttcatcttcaccacggtcctatctaattctttagaggcgaatacctttgttttccctaagtgagcacacttaattcctttcctagcctgtttgttttaaaaaattgttttgtccttgctccaggtgaaatgtgaccattactggccattcacggaagaacctatagcctatggagacatcactgtggagatgatttcagaggaagagcaggacgactgggcctgtagacacttccggatcaactatgtaagtcaccaggcagagagcaggtgctgtccctatgctgacacctgctgagaccagtttggtcggggagaccctaacccagcggcgctagaggaattacagacacacacacaaaaatatcgagtgtggagtgggaaatcaggggtctcacagctttaagagctgagagcctcgaacagagatttacccacatatttattgacagcaagccagtgataagcattgtttctatagattatagattaactaaaagtattccttatgggaaataaagggatgggtctggctagttatctgcagcatgaacgtgtccttaaggcataggttgctcatgctattgtttgtggtttaagaatgccttaagcggttttccgccctgggagggccaggtgttccttgccctcattgcggtaaaccgacaaccttcagcatgggcatcaaggccatcacgagcatgtcacagggctgcagagattttgtttatggccagttttggggccagtttatggccagatttgggggcctgttcccaacagacacctacaccaccaccaccagggaagtgctgggagaccaacccaatgagcactttgagctttgcattgctgcttccttcaagaggaaaaatccattctcagtgtcattgtttcccatttcatcagtgatggtgtggatgatatggttggtctggagaggctgagaagacgcagtaaaaagtctgcactagttcatctcgaattagctcaagatcatagaagacactattaatcattgtttatgaggcatcattgaggacagaagtgttctcattacttatattaatcatatatgagtataattggggtatataaggcacacttatgttttaaattaaataattaaaccctgatttagtagtttgggttttgttttgttttttttcttgttttgttctggtttggttttcattatttgtaaggtacttctaggtcttattatcataattccctatctctcttgaagggctattgatttctgatggataacacatccaaaaaaaatgtctgtttttctcacaaggcctgacacctttctgctgacaagtctctgagcaaacgctgaatatttctgtgacaggcttaggtgttaacatcaattgaagtcatgccattgacctcagcctatagaatatacagtttttactattaatagtcttctccacttgaacatgctgtctatgaagacaaaattgaataggaaagttctcactgagatgttcttccctgcttagaaacaatcctttctaatagttaaggaaatagcaaactgtagcctgtggaccaaatttacccactgccttttggataaagcccatgagctaagaatggtttttacattttttaatggttgaaaaaagacaactgagtatggtggttcatgcctgtaatcccagcactttgagaggctgaggcgagcagatcacttaagcccaggatttcaagattgcctgagcaacacagggagatcccatctgactaaaaattcaaaaattagctggtgtagtggtacacacctgtagtcccagctactcaagaggctgaggtgggggaatcacttgagccccgtaggtggaggttgcagtgagccaagattgtgccactacacttcagcctgggcaacaagagcaagactctatctccacacacacacacacacacaaaaaaaatcaacaagaaaaatagtattttatgtgaaatgctatatgtaaattatgtgaaattcaaatttcaatgtccatatataacattttattagaacacagcctgcattgttgacgaattgtctatgactgcttttgtgctacatcaagcttgagtagctgcaaccaaaactatatgatctgcaaaaactaaaatatttactaactgtctctttgcagaaaatgtttgctgacccttaaaataggcaatggaaacaaagattgcccgtatcaatacaacgttagaacttgatactacctactgattgatctctacaggagataaatcacttcttagccattgttaattgccacttgttaactggcagttaacaatgtcttttatgaccaggagaattcaggcaaatccccgtatgactctaacaggctgtgtttcgtgttgtttcggtcatttaaaattcacattgcttccttgttaagcacgtttttactcaaatgcagagtttcagcttaagtgtcaccccctttgtggcgtcttctctgggcttggacaccgttagcccattccttctctggggcagagtcttaagtaagctgctttatcacagcacaccatagatagttacaattctcgcttcttgtgtctgcctccccagtatactgtgagtttcagaagcaagtgctgtatccctgtggaatgaataaatcagtgaatgaatgagttatttcaaaaataataaggcacttgtaaagcatcaatagactttccgtcagagaaaatatttgtcaatccaaatgccatttgaactctgttttttgttcttagatatttcaattgaaaagccagtgcaaactgataaccaaatacagtacaaatctgtccctaggtttgcacgtagtagaaaaaatttcagagcacaaaatagggtctgttccattgcctattctgttgacaaagaagagtcacatagattattgcttggtcagtactatgcttcttgtccttggtcttaagtgatgacctatctttcaatgacaatcatgtgaaggacttgaaaaataggaataaaacattgaacagtagtgtttgtttgtaaggaatttacttgttacaagcgtctggtaccagagtgcccccttttggccataagcataatgaatctaaatgttaagctacaatgaaggctaagttgcccaaagaacattgtgctatgctaattaatatatttttcaatttgtttcattttttgtttatacccttctttatccattccatattgatatgtggaaactttccaattataaaaagataaaattacataaataaggaactcaaggtaagagaaatttaggaatagctaagtaagataaaaccagaagagttttctcctttaacaagaaaggagagaaatgaccataacacacaacttgtcactttctactacttgaaatttggcatcaactgagtgagagctggagactaaagatcatcaaaaacgtgtttgttgccagggactttgtgccctgctattcagctcacagggctgaccccagttccaggacccctgccgtgtagctgcggagaaactaactacaatttaatgatttcctgattttaaatcaccttgcactttttaactgaatacattttcacttcaaccgtactggaatatatatattggctacaatgtacacatgttatacaaattatgatcagcatttaaacagggcaagcattttcctgaactttcctggcaaccaaagttatctggtggctgagtattcttaaatcctcatgatgttgaataagtaaattattctgcacaattctttatgcccaagatagtttctcaacatacttcctgaagagagcagtgagggtagccagcgtctttgtagacttcatgttctgtgtgtctaagccagagcccttgaacatagtaggggaggcactgcatgctgctggggatatattaggtgccaagggtacaatgggtgtaggggaggtgataacttatgtatatttaaacaaatcttacatatttatttatacattttatttatgaattgtctttatacgtttattttctgtccaagaccactgactctttgaaattcatttctctttcaatacctgaacttaaattttagctcaaaactgacagcgaggccaagcttccctccttcccagttatgatatagtattccagcctctgagtgaattctaggctcttcacaagtttgagaactgagggatgaatcagacctttatgaagcctgggtttgggatatttctgatggctgataacaagtggagaatatgtaactcttacaagttagttgggactaaaaagagttgatctggaaagatatacattctagttaatatgtactcagttcagagagaacaacaatatatttgatgtatgggttaataggaataggaaaatatacaagttatactcacttactggggactcccagaatcaaccatacaattgcacggagctggatgacggtgagtgatggtaatgaggtactagtaagtagtaatatcacacacatgattacacttaattcacacaacaactcttgttataagtatcattaggccatttttagatatgagaaaactgaagctcagtgagtcaagtcctctagtatcaaagcccaagacaaggattctcatataagtgattttgtgaaagtgcattcttagggaaagcccataagggagcaagggaagcagattgacagagaagaagccctacagagcattcagctgaaaatctcacctgtgctggatcccacagagagtgctgggggcatgaacagcaccatggtactgtctcactctgaaaaaggctggatttttgtaccccacaattagtcagtcattagctgtgggcttccctcagcaggagaacgcaacctcttaggcattttctatcgaggcagctctgtgcagtggaaggcaactatcaagagataggtactgctgtgctgttagcagcaactgggaaaagtgtgtcccaggctggcaaagtgtatctaaagggcaccaacagcactttctacagtgtttaattcattagccaaaactgatgcagcttctaaatgacagagccaggatgcaaaccctaatctgcttaagtgttgtccacaggtacagattagcctacttatcctactatttgaagctttatacaattagcgtggttttttttttcaatacctattttatgccagatatggtgctcaaagctggaaaggaaagtgtactgaccaggagtggaacgtggctctacctttttgcatgcttaactagcagagtcctgggtcatcctaacagtgaactgaaaaattaatgcttgtttttggcttttttctctaaaggctgacgagatgcaggatgtgatgcattttaactacactgcatggcctgatcatggtgtgcccacagcaaatgctgcagaaagtatcctgcagtttgtacacatggtccgacagcaagctaccaagagcaaaggtcccatgatcattcactgcaggtaacctcatcaactgcattttctattaaatattaggagttggttttgtaaggggaacagctcaccattccataagcccttatcaggtttagttgaaaattaaataaactctgatgttttttaaactatgattaattgatgtctcactatatacaatgtttattctggctttcctgtatctataccctataaaatagatgttattattccaatttttaaatgaaaaaaatagagaagggtagagatgttaagggattcacacaagttcatgcaactagaacatggaggagttagtattcaaatccaggcatgccaatctgcaaagatcatgcccttaatatgtgatattatcctactccatcaaggattctgggtagttacaacatggacaaatacaaggtcaaattatagaaagctgatcacagcttgacataatataaataggcataaaaactagaaaaggaaaagaaaaatgaaaatattcagcttaggaagataaacatatttgctatgattcctcttcgggattgtctcttaaattgtcagacagtagaatgaaaaaggatataggatataaaaaaatcaaggtccacactaattcccaacaggaaaagttatcattaaatttaatttgttcttcctactgtatgaacagagctccatcaaaatctatctctgtgatacaatattgctgtaaaatccttatgcaacctcaaaagaacaggggacataaacgtgctccaatggcaagtgagaggtggcagtgggatgaagatgtgaagggaagcattggcagccatgccaacctaagcaaataaatctacaatcccagacctactgccttggcccttgtgaattagaatgactagaatgaggaagtatatgtgtgcattcatgtgtgtttgtgtggagtgtgtgtctccctggaaaggaaaatgcttcataagctactaagtttctgtttagggcagatattgttgctgtcaatccactgtaggcattcacaggttaaaagatgtgctttagcaggtaagattatctgttctcaaaatggttcttttcaagaacagaaaatgaagctcttcaactctggggtcaaactcacagattcctttcatggaagatagtaagtgcagttctggatatgactttacaggtgctcacccaatggcagatcattttatctgagaaatcctgggagggaagagttgtctagtagaaaaagcaacccttaaactcaaggtttatagagtgggatttttctagcaaactttccatataaatttgcttgaactttctcttttcccatcatttcacagtgattcaaagctaagagccatttgactctttattgaggattagagggaaaaaagggctgacttcaacacatagaactagggactgtgatgggcagttggtcagcgcatgtcagtccacttccatctgtgccccgagcattgggattgggggactggctgagactgggtccaaatttttcatttgattttaaggcaactatctcaaaggtccctgtgagatggaagcaggcccaggacccactaaaatggcaggcatgctgtaaggcaggtctggggtggtgaactgaacttagggttgaagatacacaaatctctgtggtcccagacctagagttagggtatggacatctcaactggagttttgagctgatctgagggcttaactctgatgctgttcaaaagacagggtattgtttatgtgtatcagctctctgaattcagaaatcagttcccgagagtactcaacatggaatccctacttttctgcagaagcagagaccccgataaagggtgtggccaatgcagtgcaaatgtctctcaggaacgtagccatgatagtcagaaatgtgacattagaaggaacaccaaccacaactccatacttaaaaatcagttaagtggaaaatattgtcaggagcttagtctgcgtttttccacaagggtactatttgtagttttttagaaatcatcagttttatttcaacagtaaagtagcaccatctgggctggccgaggtggctcacgcctctaatcccagcacttcaggaggccgaggtgggaagatcacctgaggtcagaagttcaagaccagcctggccaacatggcaaaactccatctctactaaaaatacaaaaattagccaggaatggtggcacatacctgtaatcccagctactcaggagggtgaggcaggagaatcacttgaagccgagaggcagaggttgcagtgagccgagatcatgccattgcactccagcctgggcaacagagcaagactccatctcaaagaaaaaaaaaaaaagaggggggagaaaaaaaagaagcaccatctgaataatatgccatcggaacattcttttgcagtgctggcgtgggacggacaggaacattcattgccctggacaggctcttgcagcacattcgggatcatgagtttgttgacatcttagggctggtgtcagaaatgaggtcataccggatgtctatggtacagacagaggtaggaacataatctatatgtatttttaaattttccctggactgaaaaacttaccattattcaatgatatgcttcaaaacaattctctcaaacttctttgtatctttctttcccattttcttattgtatatgttcaaactgctttgaggcataaaagaaatagacactagcctccagaaatccattcgacatatagtgattatacttttattggcatcataattcagagtgcatgggtagattcgtaagagtaaaacctctttgaacagactcagagtcaattgcagataacagccatcctgggtaaatgccaccaaatagagactgttgaactggtgaaatttgatttatatttgaaatgttggatttgattcaatacatttgtcattagtttatcctccgtgtgactctatcccaattcacttttgatgatgattagaagttggatttgagctttctgtcccttttatgattttaaagattcccagtccccaacctaccagcattgccagttcccttcatctcaatgatgaagatttattattttaacaacatggaagcatcccctgaaatatccaacagtgttacgtgctccgtcttcctcctcttctcccgagtcctccctccctgaaagcctgaggatgcacttagtctggagcgacaacccaaggcaacgccggcagacagcaccgcctgcctcagagcagccgtgggtgtgtacccttgtgggcgcaaaaacccaagtacaacagcttgttcataagcctcatcacccagccatactcgcgacttcttagcttcggtcttacaataatcctttttctcaaagagtatgtgtgggtggagcgcttgggtagaacacaacctggcccgacctgtaatcagggtatttttaaaatgctttggtcttcctcatgcttttcctacccagcaccactagatgtcagtatcacttcaaaagcctagagtaatggcggccgtctcagctgtttctgctttcccactccttttacttttctttcctcctacctccccattcttgtctgaccaatttttggcaaggctgtttcaatacattcatttctgaactacagcaggatcataccacttgggaaagagttatcctcgttaatattcagacctctcattgataattaggaagcaagtccaattggtttcctcacttggtttcaatcatgctgcctagtaatttagtgtggtggggacatcagtatcactttttaatcataagtttaaaatgtctggtttcccagaggagtccactgtctggtgagtaaacagtgctttattaatcggtccatatttttggcttttacttccataaatttgcaccttgatatgtgattaaaaatccacgttatgtatatgaatcaccaagcttcaaagagccacaccttattttaagtattttgcatttaatgaattgtctcctcaatttacttaattcataccttttacaacttcatagattttggggcctggcgtagtggctcacagctgtaatcccagcactttaggaggctgaggcgtgcggatcacctgaggtcagaagttggagaccagcctggccaacatggtgaaaccccgtttctactaaaaatattaaaaaattagcctggcctggtgatgggcacctgtaatcccagctactcgggaggctgaggcaagagagttgcttgaacccaggagacggaggttgcaatgagctgacatggtgccactgcactccagcctgggcgacagagtgagactccatctcaaaaaaaacaaaaaaaacttagtagattttaattatggcctgtttgcttttgacttttctccaactacagattcttaatctctttcacatgacacatcctccatcccatttttagggtcattatctttctttgggtggttatcaagcagccaccatgtcgctttctgcaaagccaagaaaacgttttgttttctccctaaatgttttaccctaaattttggttgttttatttgtttatgccagcattttatgttgatatctccgcggacacagcctttttaaagtacagtatccccatcctggccaacatagtgaaaccccttctctactaaaaatacaaaaattagctgggcgtggtggcacacgcctgtagtcccagctactcgggaggctgaggcaggagaatcgctggaacctgggaggcagagcttgcagtgagccaagatcgtgccactgcaccccagtctggtgacagagcaagactccgtctcaaaaaaaaaaccccataaaataattaattaaaattaattatgaaataattaaataaaaaataaagtgcagtatcccttccctgaactctcatggggagttcaaagtcagcaaagggggcagaggttccccgggttacttactttttccaacttttctagcttgacccttgattcccgcaggacttcctggtggatgttttccagttccagttatttatctgtgtctttttttttaacttatgtctagaacatcttcttcatttacctttattttttccttgttcctctgcttaccatggttcatcccgtattttgaatacagattgatctgcctaagattctccttaagcccattcacattcaaattctgctgccaggtcacaaaagttaacaaggaaagaacaaagtaaaaaaaggttattcttttcacatgtatcatcctagagtactcctttgacgctaatgattttcaagagaatgaaatggttctccacttgagctctgtttttatgtatataatcaacccacatagaccatatttcctcccatcactggtatctaattttccagccttctctacattgccttgaccccaccattccacctcacccaaaaaattgcagaagtagctgataggatgagccatgtctccaggtgcaacatgctgcctggactgcactgtgacctgccctcttcctcttcctcacctgaccagacacacttcatagacttcttcacgcaagtagaggcgtatttagaaagaatgccagaccctgaggggagcctgaatctccactttactgctgcacaagtcatgtcacctctcaaggctcccatttctcttctgtaaaatatgaatgataactttcactaatttttgtaaagcagacatgatgggaaataatataacctagataagtgatttgaaactgtgaagtgctacttatgaatgatgttctcctctcttctatttttatcgaatattttgtttggttttcctctaatatccttccctggaggtcagttggggctttgctttgagcagcccatcctcttgatctgcagtttgaatttcgggactttcaaggacaagtccctccataaatagtctttatttacttttcttgtggtcttgttgtttggttgttttttgttttgatacaaaatgtagccactaagcagatgcagattgaatgtccaggcaatctctggtcttatctattccctgtgttgacataacaccagaagcaatggattaggtgtccatgtgtgatgaccacaaggggtagctcagccactgataggataccatcaccacaaaagggaatatattttctccaaaccgtgttgaaaaatacaggttaggctgaggcatcaatccagtgatgttcgaaatattaattttgttttttgtatgaagttgttacacaggaagcttcttaaaatcctatgaatattttgaccggatctcatttaaatgttatttctagtgctattacttatagagaaactctgggaaacaaagaaaaaggaggaacactgtgaaattacccttacttcttggcagaaagatatattttggtgatttcattttggctttcattcaagtataacttttacatgattgtgctcatattatatgtatgtatatatgtgtgttactttacattctatttacattgtagtttctcatttaggattttactatgtagcctgtatagtatcaaaaattacctacaactctataaatctcattttaaggacagactaatgtttcattaaagatacactattgcatacttaaaccaatctcctttttatagaacattaaattggattattttccactttttactattatctgtgtccacaccatttattagcactttattaattctacctccacaaacaataggtaaaatggactgcctcaacaaacttgtcatcattaaatattattcttttccttctagctttgtccactacatagatagaaaataattatttcaatgtactttgtattacttgactattgttggcatattttaatatttcctcagtttacttcaaaaatcatttaataaacacagctaagtgctaagcattaggaataaaaagacatagtttctaacttccagggaatatttggcctagtggttgatgtcctttacttatttgtctatttgtatatgttactgatttgaatgactttatcacaaaaataaaggcatcaatattctgtcataattctagaaaatatttttcttttccagtttgtggtttaccctgtgttttattctttttaactttttaaaatatacagtagattgagatttttatttgtaatgtattctactgctcttaattttagaaattcctttcctaaaggaatcagagagaaattaaccaatattttcctctgtatttttaaagacaatttattaaattacctggaatttgctttggtgtatgataatgggatatcctttttttttcaaaatagccccatgatttgattgaatattcatttcctttagcattaataatgatttaatgtacagcatggtgaacatagttcataataccgtattgtatacttgaaatttgctaggaaagtagatcttaagtgttctcaccacacacacacacacacaaatatatatacatacatatatatgtatatatacacacacatatatataaacatatatataatctggggtgatgaatgtgttaactagcttgattgtggtaatcatttcataacatatatgtatatcaagtcatcacattgtacaccttaaatatatacaatttttattatactgcaataaagttaggggaaaaaaattccactgtttttttaaaaaagccatgatgttctaagctctgttattaatcaaaatacttgtacagttgattctcttggattttctagttataaaactgtgtctctgtaaataatgaaaatggtttcctttaacaccagatcttgatcattaaaattgtcatagtataaaatattatatctttgcacatgtctgctctgaaacctgtttttgtcttttgttccaggagcagtacatttttatccatcagtgtgtgcaactgatgtggatgaagaagaagcagcagttctgcatcagtgatgtcatatacgagaatgttagcaagtcctagttcagaatccggagcagtaagtggagaagagctctccacgagtgctcagtcttagaactattagagggggatgtgatggatgggacaaaagacagcagtagccatttgtattgactctgacttcacatgagtatttcttcccagctcctggcctcacatgggtggtcacagggagaaacaagtactgtagcagatctttgagtttcaatgcaccttggttggtgttggcaacaaacaggagcttctgcacatcatgatgactttacctccattccctctacccagaaccctaaattattctgttattggatctgtgcctgtaatatcaggatactaccatccaaatctatctagatatcttgtgcaaatattttattgattacaagggctgtatacggggttacaaaaagacatgagctggattggacactcctaaaaccaaaaacaacagtgacaatagagtctcaggatagcagagtctgaaaataccttggtctcccccattatgtgagcccttacttgagagcttcatgaagacacttgtaacatattcaacgtcctgtactccagttttgactacgagatcagattttggaggtgtaagtaaacttggctgaggtaacagtaatctgcccatttagttcagtaaacagactgtagagtgtctgactatactgggggaagaggagccaatgacagggtagggagatgacagtggtgcatgatgggagaatcatgaaagtctgggaagcatatggaccagtgggaaggataggattagcactgcacctctacatccatcaagagagacagagcgcacaatggagcaggaaggataaaaaataaagaaagacagagagaaacaaatttgctgggagagggaaagacattcagacccacagaaaggaggcagcacacagagaaagatgcacagatcaacccacatctgcatgggttgtgagactgagcatagtgagagcagtggtggagcaatagaagattgctgtgacaccaggctgcttactgtctttctttgtctcattcacaggagaggacatgatgtgcgcccatcctcccttgcttccagattgttttagtgggccctgatggtcatttttctaaacagaggccctgctttgtaatatgtggccaaggagataatttatctcacagaagcaccgggaagacttagccttaaagagcctacagtgtccttttggactctttcacttcgggacatttaataatggaccaaattcaacagaacaccaggaaggtcaagacgctctccaaagggcaggaagtacagcacttccgaagagtttagttggccctttgctggttgggctgagttttttatttttaagtgtttgtttttcagtgcaataatttttgtgtgtgtgtgattcttatcagaaagttgaattgttttctgcctacaccgttcatcagccccataacccaggaaggaacaggcattgttagcatcagattatacctcattattaaaaggaggcatggccacacatgaagaaatggtcattctacttcaaagaaattgagccagcactatctgtactccaacattaccggatctggattggggaggttggtcagggaagagaggggttctacccacagatcaactgtgtaatcttttactattcaagctataattcagcttcaaagtagagtagaaaaaaaattgtcttaactgttctagttcttgatggttttcttccttattaacagttggtgtttcttccttggcccttttggactaatgttactgtccaagttctttctcaagaaaccacatctggttcagaagagtgtcaagttggactctttgaactctgttgctgtctgagcaatcgtggtgcctagactttgcattccttgttctgttgacctgcatacatgtgagagctatttctttaagaactatataggctgtgaaaacgcactttctttcccccaaagagctgggaatttatgaagttatggcaatgaactgcagcatgctgggacaattatttgactacttttttttgtaatattgtcaaatgtctctatggattctgacagagatttctttttgttttgttattcttttggttgtcagtttcattttaacgagtgtaactagtaacattttattctttggattttgtataattacagtacatgattgtgtattgtgacatgaatgctgtcaaaatgacattgatggcattgtgaagcctgttactttgtgtcacttcctgataaataagaggtgatgacatggatatacaacagaaaacactttgagttgaaagtaaacacaagctggctgcttccctgtggcaactgtggctattgtgagcctccgtgtgtgtgcttccaggaggctttgctcctcttcatgcacccgacactgccccttccctggcttccctccatccctgatcatcttcatgaagccacagatataagatcagcttaatattttatcagtgaccttagtgttggtgaaggatgccaaatgaacagctctgcaccccaccgtctcttgtcactgaaaaggcttggccatggcagaccttggcagagtttcttgcaagatctggccagtgagtctcagtttcaccttgcagggtgaatggcagaggatgcccataccctgcaggttaacagcttgggctcctcaggggttgtcagttcctactcacctccctgctaccacctcctcctcttcttctcacccccgactcctttatttccctttttggacattttaataatgtgtcgcaccattctcaggaacaaacatggttaatgaaaggtggcaaagggatgtgtgacattcttagattttcacacatgggcagtcaggagtgaaatgtgcaaccttggaagagctgatacaatgtatggtaagctgaagtacgtttccaacactgctgctcagagcatacagaagttttgcatcctggaacattgcttcccatgaaacaaagcacttcataaatattttatgtttttcttgagcaccctttcaaggtagggatcaaatagtgccagatcaattttcccaaaaggaaagaggaagtatccagagtttagactgaaggcttagagtcaaaactacaggaaggtcacactgttctctggaacactgttgctcttcagtttgtagagtttatgatggaaaaggcatcagtctgtcaaaagacttgtttaatcctgataatgactttggaattatctctcctgggtctcagttaataaactgaagaatgacctaa

SEQ ID NO: 522 - DNA, 276076 bp, Homo sapiens; identical to SEQ ID NO: 521

SEQ ID NO: 523 - DNA, 65638 bp, Homo sapiens
gtaggatacaatttttgctttatttataatttttttttttcaattaggaaactgagacttaagaattttctctaaaaaaaataaaaactggaaaacaagtaattttagaaacaaatatatatttttgatagaaactgtaagtaaatattcagtactaccagaaatatactatcttcaactctcggcttttttccaaaagatacagaatcattttttggaaaagatacaagatgtacagacaaatcacattcataccttacaatttaaattcataatgaacaatgaatattttcatattttccagaagtttgaaatttcaaagttgttagcaaaattattcatttccataatttttacgagtaaaaatagaaagagctgatcatgtaccttaatattgtcactttatatattactcaaaagtacaaataaccctaaaagtagaatcccaggcttatcatattataaaaatactgagacatttatcaaacataactaatataaatgaaactacatttttaaaaatgtttcacaaacaccagtccatctttctctttggttcagaaaataaaagaggtaggttcaaataaagaaaatgcctattacatcattagattttcattaaaatgctggaaatttataacagaaattattagaagtgaaatgagtttaagaactaaattaaaaactgataataacttcaactagtaaatatttttctaagttctaatcacacaaataagaaaagatagttgactataaaaatggctttagtaaaataaaaaaatgctctcattattataaattaagtctcctatatcctaacatgttcctaaaacttggggcaagagagaatatgaatgtatatgtttacaaattgggcctttcatttaaatataggtatctaatgtataagagtaatacatactactattaatatgtatctctcacctttgtgctgcccatattgaaaacagcaagttcaaagatattcaacagtgagggagaaataagcacatcatttgctcatgatcaatccacttcatgcaattaaaaaagaaatttcaggttactaagaatggtcccaagaagtcttcctgactaaaacggaatctgattcaaaaggtaggaaacaaaggacaaaggaaaacaaagatgctctgcagaagctgatacaagtcaaaggatttcgtttcctgctgcttttcaaagcaatggcaggataaacggaatctttcaaataaattgccttgtgttggtaatttaacagtaatatactgaaaattagtgtataactccaggaaccaaataatggtacagtggtaaaatggaaaagtgcccactgaaataaatataatttcatcacttcccttcagaaattccaccactgtgttcattcgtattcagctgaaagaaaaataaggacataaaccctatacttatttggatgcttttgctgtaaggtatattttaaatgtaatgattttctattaatggttctataaggaaatttaaagaaatctataaagacattcaaaatatataaaacaagaaatttaaatataaaggaactggcataaacgtaaaccacccgaaataaagattaatgatttataactctaacacacaaaacaaattttgttcaagccagtacattttcagatttcggattcagggcagagatttgcaggattattaagaaaagataaagtataattgtgtggccttttcaaaacacattaaaactatgattttgaacatttctgtgtacatataatttagcccaaaagtttgaagtgaccattgttaccatcttcccttttgtgaaaaaaatgcagcttcttttgccatagacttgtttcaattcgaggagaaaaagtcactccagagattgttgaaagtttcaattatcaggctaaagcaaaaaatgcaacatcatttctgggttactcctaaagtttgcttcatattttcataaaccacataactgatgcctacagcagggagcaccttcatgaagtttggggtgatgcctctgtaaagtcctggtattccttctttggaaataattcgtcgaaagaggccaaccatattcagctgtggggaaccttctaacatggctaaaaaataaaaaaagagggtaatttaatattcaagtatgtttcattattatgacaacaaacaattatgacccagaatgatattctaaaatacagtaaaaggacaacatttattccaagaagcccaagacaacatcccttttatgatcctctttgtatagcacctaacagtgagtgtcctaactatagtaatgatggtaataatagttatttattaattactatgttctaaatactgggttaattaccttccataccaatcttgcaaggtaaatgttatatcaattttgtaagtgagcaattggaggcttagaaagatggagaaatttgtcctaaaaaaatctaagtagaaaatggtagggctgagatccaatggtctgactctaaagctggtacactttccaccaccccacagtgctgctgctgcctccttcttactagacaagcgctgaagagagaacagttaaatctcaggaagtaaggggagtatggaagaagctctgggaagcttgggaaaaagcacaaagacctgggccttggaaatgacctcaacaagcaggaagagaaagcgaaaaccagtgttgctggcacaaccaagacaacgggaggagtaccatgtgctatggagatgcagccaattgttgtatgtggttattacacagagagtgaacaaagtggggctagattattaaaggctttgaaattcccactaacaactttggaactgacaccgaaaggctgcaaagatgtctgaacagatgtaaaatgatcagacttttaggtcagaaatgacagtctatcagccatagacaatctatcagccgtatcagtcatgcaaagttctggatcagagctggcagacaggagggttagaatcagactgcatgtgtctgaatttcagtcccactatttaccacaggtataatcttgtgggagttacttaaattctctctgccccagttgctcatctgaaaaatggggataatgttagtattcccatccccaagatggttatgatggtgaaatgagagaatacacaagaaacgtgtagttcactactttgtgtttttctctacagccatgactgtctctcagctccttaaatacaccatgttggtgcctgcctcagtgtcttcacacatgctttccctcaactggaatgttttctgttcccactccactggcctgtgcccagctaactcccactcatctttccagtctcagcttcactgacagcattctgcagcgcccaagttaggttatagctccttgctctgtgctcccctaacaaaagaggagttggtttaaccaggttgtttacttgctggacataacgtcttctctactctacactggcggggccacacctgacttgttgactgctctacccctagcatctggcagtgtctagaatgggacaatggctcagggagtatttgccaattagttactgactgcttggctggggttgctgtggctggcacttggaagggaggttgggaatagagctgtagatgcccaaggtgtactacttaagaaaacaatggataagactgaccagggaaagcatcaaagagaaaagaaaggcatttgaatgcatactttaatagagtggggatagcaataaaagccagcaaatggtaaaagttatcaatgggctggcagaacaaccaggatggtacagtgtaatcaaagccaacaatggagactgtcacagtgaggaggaatcacagctcaaaacttgtagggtctacgcaacactaaaaaatgattccaaccaccatttaccaaaaatttaacaaacccaagatgctttatttatattgttggtaattcttacaacactgtacaattttcattcccattaaaaaccccaagaagtctgaggcaaggatctgaacccaaatccatcagatactaaagcttataatcttaaaacgtgcatgtaacacagtcaaaaaaaatagtactctgtttatctataaggcatatgtatgcatacagtacatatgcaatgcttctgtcgcattaaaatttcatgacgagggagcatttagaaaaagaatttctgaaaagattccttaaggaggcaataatgaaaaaaaggttgagaaatactgtcttaaaactacagtctgcatcttagtagaacttggagttctaaaagcacattactggtgcagcacttttatcggtgtggttctgtaatcaaaaattcaccttgagcctgcatgcgagttctcaccaaagccaatgggtagctggccagctgaccacaggtgctggataaggcaccgcatcccagcaacaccatgactccagggtttacagaatcttttgcaaaattatccagccaataggacttcaagagctgccagagaaataaagaagaaaataattaacgaactctacaacttcaacgtaaacattttcacagctattctcaacctcatgagaagccccgtttctgcaggatgaggccacgcatttgcagaagcagcaggcactgcaggaggcggtgactctgtggagaggtgggaggccactgggggtgcggaacacatgaggtttgcaccggttactgacattcttctaaacaaacgtgaactgcgcagcaaacgctgcaggatctaaagaacacctcttatggtgagtattaataaaataatataattctactaattgtatctcattttacacgttacatatatttcatttgagccttacagaaactcttacataaatctattattctgattttagaaatgagaaaaattcatctcagcggagtttttgtttgtttttttgagatggagtctcgctcttgtcacccaggctgtagtgcagtggcccaatctctgcctcccaggttcaaacgattcttctgcctcagcctcctgagtagcttggattacaggcacccaccaccacgcccagctaatctttgtactgttagtagagacagggtttcaccatgctggcaaggctgatctcaaactcctgacctcaggtgatccgcccgcctcggcctcccaaagtgctgagattataggcatgagccaccacaccaggcccagagtttttttaagaaggactcagaaccaggcgtgctgatcaaaaggccatactttatccctgttactctaggtccctgtatttcattagaaggcaataattaggagaaactgtataaaatatatatgataatcaactttttaaacataagatactttaagtataaaatacatgttaatatgttatataacaagtttaactttttaattttttaatcctgtaagactaaaaattttaaatcctacaggattaaaaaattatctcaatggattaaaaaatccattgagtgcatttctcaatggaaatcttgcaggttagaaggaaatggaatgttatattctatgttttgaaacttaaaaaaactgccaaacaaaaatactgtatgggcaaaactgcccttcaaaaaaggagaaattaagactgtccctgacaaacaaaagctgatacagcttatcaccactagaccggccctacaagaaaggctaaaaggagaaacaaaaggatgataaatagcaacacaaaaccacaaaatatgaaactctatggtaaaggtcaatatttagaatattataaaatcctatagtattgtaatgaaggtatataaataacttgaaaatctaaatttcaaaaacaaaatttaaacagaatttaaagaagaaaagcataaaaagtaactataaatctatgttaaggatatacaatatcaaaagacataaagtttgtggggaggaggtgaaatatgtaaagaaatagagttttatataccactgaagttaagttgtaaacagcttaaaataagttgctataactttagtatgctttatgtagttgcaatggtaaccacaaaaatagcatctatagaatgcacacaaagggaaatgagaagggaatcagaacatatcactacaaaaaaaaaaaaaaatcaacaaaacacagaagaagccaggaagagaggaagggaaaaacagaaaagccacaggacaaagataaaaaggtagctagccaaatgacaacagtaagtccttccctatcagtaactgctttaaatgtaaatggattaaatcccctaattaaaagatataaattgctgagtgaataacacatacagaatcaactataccttatctatgagactcactttagatctaaggacacacataagctgaaagtgaaaggatggaaaaagatattccataaaaacgggaacccaaagagaaaaggggtggccataattacatcagacaaaatagactttaagacacaaactgtcacaagagacaaagatggacattacataatgataaatgggtcactttaccaggaagaaattataacttcatatggacctaatattaagctcctaaatatatgaagcaaacacttacagaactgaagggaggaataaacagcaacacagcaatagtagtagaccaccaccccacttaatggtgttggggaggacatggagaaattggaatcttggtgtacattgatagaaatgttaaaaaacaaaaaggtctagttactatggaaaatgacatggaggttcctcaaaaacttaaaaatagaattaccatttgacccagaaattccacttctgagtatatgtcaaaaagaactgaaaacagtatcttgaagagatatttgcacaaccatgttcactgcagcactattcacaatagtcaagatgtagaaacaatccaaatgtccatcaacagatgaataaagaaaatgtgatatatatacccaacaaattattattcagccttaaaaacaaaaaagtcctgttgtatgctatcatatggatgaatcatgaggaaactatgttacatgaaataagccagtcacggaaagagaaataccacatgatttcacttatacaaggtatttaatgtagtcaaactcataaaacgagaaagtaggttacacagcgctggggtgaaggggaaattgggagctgttgtttaatgactatagagtttaagttttgagaagtgaaaaagttctagagatctgttgcacaacaaaccacaaacagttaacacttactgtactatatatttaaaaatggttaaaatcataaactttatgttatgtgtttttaatcacaattttttaaaaaactcagcacaagaagtaaagtcctgaaccataccacctcacacctaagaggacggccataataaaaataagcttttttaaaatggaaattaagtgttaataaggacgtggaaaaactggaacctttgtatgttgctggtgagaatgtaagtgcagccactatggaaaacagtctgatagttcctaaaagctaaacacagaatgaccatatggctcagcaattccattctgagatatatacccaaaggaattgaaggcatagactcgaacagatacgcagatgccaatgttcactgcagcattattcacaatgttggaaaagtagaaataatccaaatgctcttcaacagatgaaggactaaacaaaatgtggtatatacacataacggaatattactcagccatgaaaagaaatgaagttctgatacatgctacaacatgaacaaaccttagagacattatgctaagagtaataaatcagacacaaaaagaaaaatactgtatgattctacttataagatatcttgaatgggtaaattcctagacatagaaagcagattagaggttaccaaaggtttgagttacggagggtaggaagttattgcttaaaggttaaggtgtttctgtttggagtgaggaaaaggatttggaaatagtgttgatggttgcacaatattgtgaatgtaattaatgccactgaattgtacacttaaaattagtaaaatggcaaattttatattttataataatttttaaaaattatgtaagaagccaaaaaccatttgcttgtacacttcaaatgagtgaaatgtaaggaatatgaactaaatctcaataaagctctttaaaaaaaaaattcgactcttcttttcattacacattccactcttcctctacgctgtagcttaggtctcatcctaacatgcaccctggctcatgtctgtcgcagcacagataaccacgctgagttttagtcgtttgtctcccccaccagaccttcagtttcttcaaggcacacattgagtcctttgaatccccagatccagtgtctaacctagtggtttgtatagtgtgtgctcaataattgtttgtgagattcataaattattaaatgatttagattgcagggttgatccaagatttgtattcttccgtacaaggaatgaaactgtattactcatgttagtcacattagtcacttggcttaatgtcagatttttgcaaatccaaaacaaaggaaaaaatctctagaaacaccttttaaggtgaacaactatacctaactttgagtctactcttcattaacaaaagcaattcccaagaaaatctaatacaaaagtgaccccatgcatattcacactcaagttacttgaaagttcaaataacacatgcttgaatttacttctggtcacacactgttttctggtatatatctacttcttcatataaagtccaattctaacaagatctaactgcattttccaattcaaaagatttctacaaactcacctcatacacagcaagatctatgcctgcataaggtatgatacctaataaattgggaacatagcctttgtaaaaagctcccaagccttcatgtttcaaaatcttcttggcacaatcatatattccagagtactgcccagttttgcctacagccagcctggttttcataacctggatataaaaaaaaacaaaatatgattgttcatattaactctatcatcatgggattcaaatgaagtaattttacatggaacaaatacctagcacatattgtcactcaaaagactgtacaatttgttgatacattctctttcatgtattacctctattggggggctaagaccaaagccagagagacccgtttactgcaaggaggatctgatgaaggaagtgaccaaggaaatggaagcaagataatctattgatgtcttaacaaaactgactggtgaccacctgcatctggaaggtgagggaaatggtagtataaaggataaccccaatacttctagcttggaacacaggatggggcagtggggagttgggaaggtgatactattaactgatatggaggatatgagaggaaaaataggtattaagtttttttgagaggtgtgtggagtaatataaacaatcatattaagatgcttaaaaaaagctgtattagcatgcataccacatatcggtgaaaattgtatttatcttgcttaagtcatcagttactaaaaacccctctgctatatcaataaattccacatctacaatattatttttgctataaagcagtagttggaaaacttttcctgtaaagactaaatagtaaaatatctgtcgttgcaagcctaaaatattaggtctcggttgtatattacttttcttttcttttgtttttgcctactttttaaaaattgtactttaagttctgggatacatgtgcagaacgtgcaggtttgttacataggtatacacgtgccatggtggtttgctgcacccatcaacctgtcacctacattaggtatttcttctaatgctattcctcccctagcccctcatccccaaaaaggccccagtgtgtgatgttcccctccctgtgtccatgtattctcattgttcaactccaacttatgagtgagaacatgtggtgtttggttttctgttcctgtgttaggttgctgagaatgatggcttccagcttcatccatgtccctacaaaggacatgaactcatccttgtttatggctgcatagtattccatggtgtatatgtgccatattttgtttatctagtctatcactgatgggcatttgggttggttccaagtctttgctattgtgaacagtgctgcaataaatatacgtgtgcatgtgtctttatagtagaaaaatctataatcctttgagtatataaccagtaatgggattgctgggtcaaacggtatttctggttctagatccttgaggaattgccacactgtcttccacaatgcttgaactaatttacactcccaccaacagtgtaaaagcattcctatttctccacatatttgccagcatctgttgtttcctgactttttaactaactggcgtgagatggtatgccattgtggttttgatttgcatttctctaacaaccagggatgatgagccttttctcacgtttgttggctgcataaatgtcttcttatgagaagtgtctgttcatatccgtcacccactttttggtgggtttttttttcttgtaaatttgcttaagttccttatagattctggatattagccctttgtcagatggatagattgcaaaatttttctcccattctgtaggttgccggttcactctgatgatagtttcttttgctgtgcagaagatctttagtttaattagatcccatttgtcaattttggcttttgttgccattgcttttgtgattcagtcatgaagtctttgtccatgcctgtgtcctgaatggtattgcctcggtttttttctagggattttatagtttaagtctatgtttaagactttaatctatcttgagttaattttttttttataaggtgtaaggaaggggtccagtttcagttttctgcatatggctagccagttttcccaacaccatacattaaataaggaatcctttccccattgcttgtttttgtcaaagatcagatggttgtagacgtgtggtgttatttctgaggcctctgttctgttccattggtctatatatctgtttggtaccagtaccatgctgttttggttactgtagccttgtagtatgtttgaagtcaggtagcgtgatgcctccagcttcgttcattttgcttaggattgtcttggctatacaggctcttttttagtttcatatgaaatttaaggtagttttttctatttctgtgaagaaattcaatgttagcttgatggggatatcattgaatctataaattactttgggcagtatggccactgattcttcctatgatatgatattgattcttcctatccatgagcatgaaatgtttttccatttgtttgtgtcctctcttatttccttgaggagtggtttgtagttctccttgaacaggtccttcacatcccttgtaagttgtattccgaggtattttattctctttgtagcaattgtggatgggagttcactcgtgatttggctctctgtttgtgtattattggttaataggaatgctagtgatttttgcacattgattttgtaccctgagactttgctttaagttgcttatcagcttaaggagatttggggctgagacaaggaggttttctaaatatacaatcatgtcaactgcaaacagagacaatttgacttcctcttttcctatctgaatacgctttatttctttctcctgcctgattgccttggccagaacttccaatactacgttgaataggagtgctgacagaggacatccttgtcttgtgccggttttcaaagggaatgcttccagcttttgcccattcagtatgatattggctgtgggtttgtcataaacagctcttattattttgttatacattccatcaataactagtttagtgagagtttttaacatgaagtggtgttgaattttatcgaaggccttttctgcatctattgagataatcatgcggtttttgtcactggttctgtttattgatgaattccgttatattgatttgcatatgttgaacagccttgcatcccagggatgaagccaacttgatcatggtggataaacttttggatgtcctgctgcattcagtttgccagtattttattgaggattttcacattgatgttcatcagggatattggcctgaaattttctattttggttgtgtctctgccaggttttagtatcagaatgatgctgccctcataaaatgagttagggaggaatctctctttttctattgtttgaataatttcagaaggaatggcatcagctcctctttgtacctctggtagaattcggctatgaatctgtctggtcctgggttttttttggttggtaggctattaattactgcctcaatttcagaacatgttattggtctatacagggattcagcttcttcctgatttagtcttgggagcgtgtatgtgtccaggaatttatccatttcttctagattttctagtttatttgcatagaggtgtttatagtattccctgatggtagtttgcatttctgtgggattggtggtgatatcccctttatcattttttattgtgtctatttgattctcctctgttttcttctttattattctggctagttgtctattttgttaaacttttcataaaaacagctcctggattcaatgatttttggaagggtttttcgtgtctctatctccttcagttctgctctgaccttagctacttcttgtcttccgctatcttttgaatttgtttgctcttgcttctctagttcttttaattgtgatcttagggtgtcgattttagatctttctcactttttcctgtgttgcccactttttaaaaatgtaaaaggcattcttaggtcaagggctgtatgaaacagtccgtaggtctgtgttttgccaacctatgcactaatgaaaggatgtctaattaggataatcaccatataatcaaatcctgagattccattattaaatttatggtacagaaactctttggacaggaatggcagccagcctctaaagtggcagccagcctctaaagtgacccccagtgatatttgtctccggttattaacaccattataccagcccctcctacactctaccagggttggtctgtgtgatcaatggaatacagcagaagaggcaaaagataccagctttcatcttaggcactctctctctctctctctgttggaccactgactctagggaagccagctactgtgttttgaggatactcaggcagcctacagaaaggctcacgtgataaggaactgatgtttccagccaatagccagtgaggcctggcagcaacatgagtgagcttggaatccgcctccagctgattccaagctctgactaccatcttgactgtgggctgtgaaaaaccctgagccagaggcacccagctaagctgcttccagattcctgacccagagaaactgtgcgatgataaatgcttgttttaaactgttaattttgggataacttgttagagagcaatagacaaccaacacgaacaccatcacacagtcagacttgacaatggtactcacctccattggatatataaaagtctgtgcagttgctccagccatggaaccagaaataaatctctcaaatgttcctattttttgtccttcttcagtaagtaacttcttgtactgtataaacaagttttaaaatgcacattactacctgctgtggactgagctgcacccccaccaaattcatatgttgaagctgtaacctcccatgtgatggtattaggagatgaggcttctggaggtaattagggttatgaggtcatgaggatggagccctcatgacaggatcagtgttcttgtaagagcagacaccagagagcccactctctctctcccccttcacatgtgcaccaagaaaagaccatgtgagcacataccagctgtctacaagctgagaagagaacgctcactagaaatcaaactggcttggcccttgatcttaggctttcccgcctctgaaactgttagaaataaatttccgttgttgattccacacacactgtggtattttatggcagcccaagccaactagacaatcctagaatacaaatcagctcctagaaatcaataaattgacaaatgtgatgatgtgtctcgaaatgtatacactacattaataatacatagcagaagagcaaggcctaaatgctaatacacgcagtgactggacagtggttttcaagtcagatttccacaaaacacagatgtctcccagattggaccaagttgctcctttgctgaaacagcataacagcatccctccccaggtgtacagaaaatacaaggttaatcaagttttcacaatgtttggatattttccccacagtttttaaaagatgagtttattttcaccagtgcaaataaaatgaataaataggtgacaaacaaatattaacaaaacaatttataaaaacagtttctgtaggtaatacatagaattatactaacctatcaagcccagcatctccctggctatcagtactaaagtgacccaacatagctaactggaccaagggtataaatatgaccccaatacagccaaaatagtgactggccagtatattaatatcatgggattgagagtcaggcagacctgagctggaactccagagccacgtggcctcgagcaagttcatgaacaggtccacattgtggtttccttgtctgtgataacagtacttacctcacagggttatggaaaggattacaaaaaaataatacttgtaacacggttagtgcaggtctgaacacctagcaaatgttcagtagatgttattattattattaatatatgaatacactatctttacacaacttgctaagacattctgcccaaacatagaccatgggaattagccaggcaagccagattccttctctcagaaatgtgagggggtctccagaggtaagcagctgctgtcaccagagggacaaggggaaagtcaacagagagaagtggactcatgcatggagaagggaagggggaagtctcacctcctggacttctccagggatccttcccctacatgatccatccccacagtgatgcccattcctgtgccagccagtttctgttccctgggatctaaagtgcccaatgcaacaacatacgatgactttctcctagcaaatctgtgttttgctgctcatgataaaaattaagtatattatcatttcatgagattcccaaataccagacattcctccccagagagatcactgcttccaagggctctgtttcctgaactacagagtgttacataaaactcctcttctgcataggccctattaattttcctgcatgtcagattgtcaaaatcattaaacataatttgcttaaaaaccttcctgcactttaacagtaactttgaaggtaccttttataccttggacccccacagcacctatcaaaagtacagagtaaacgtttagtgactgatggaggataaatatttaaaggataagtgcttgaggctcctattccccgaaacataccatatacaaagggaagacttcaggacagagccaaaaagtcaggcactgtgcctggtatgtaaaactatgtcaccaagcttagtccccatcttagagatgaggtaatagtcacagagactttaagtaacttgccaaggctacagaactgaaccttcctaaaggagacttaactgagccctcaaaaccaccctgaaatccttttgtctatctcagttctctcccatttgttagactaaccattttgatcttctccattctcctccagcttccaataccacttcctccctcattctcagatcacatcctttctcaggagctcaaggaagagtagagaggccaccaggcagaatatcttggtattctgcccacctcctgcaaaattatccatagctactcacatattttttcttcccaaacacgtataagaagagttcttcttgtaatcaaagactaatccttttaacagtctctggatagaacctgtctcccccagcccctttccatctcccactccctttccctacacacaaactcccttgaaacacctaccgggttaatcaacctctcttacctatgttttcaacttctttatttgtattgacatgcttccttcagcaacaggcacattaaagtcaaatcaaaatcctccctccaggccaggcacggtggctcactcctgcaatcccagcatttcgggaggctgaggcaggaggaccacttgaggtcaggagtttgaaaccagcctggccaatacggtgaaacctcacctctactaaaaatacaaaaattagctgggtgttgtggtgcactcctgtaatcctaactactcaggaggttgaggcagaagaatcacttgaacctaggaggcagaggttgcagtgagatgagattgcaccactttactccagcctgggtgataaagtgagactccatctcaaaaacaaacaaacatacaaacagaaaaaaaacaaaaaaacaaaaaaacaaatcccctccacccaacatctttcttatctatcaccctctccctcttctagtttccttctcttcactgtcaaactccctaaaaatgtgtctctactgtccaagtttcttcacctcccattcactttaagctcatttcagcatggtttctcatttcattacttcacagaagcatttatactaagcttacctatctctgggttgagaaatcctaaaagatattcttattatattcactacccagtagtactgacccccatgaaaccgtttccttccactgactcctatgccatccctctctctggattttctcccatccctcgagctatttcttctcagtgtcctttgcaagtttcttcttttacttctccctttggacttattcctagaattcttctcatttataagctcttcttgagtgatcctgcccattccaatggctcaactcagcaacaacctctctatcaaagatctctctcttaatggctagctgatatacccaattgcttactggacagctccctgtacatgtcccacacatctcaaactcagcatgcacaaaatggaacctgatattgtattctctttgaatgcagtcactcaagttagaaattagaatatcattcttgactcttctctttctcacctccatatccagtcagtcagtgagttctgttgattctacttccaaaatatttctcagttcattcccttctccattccttaaagacatcaccttatactggtgttcatcatttcttacctcaattatttaaatattctccctgcctctagtctacctcactctcccccaacaatgtctccactcttttttcaggttgatattccttaaatgtgaatgtactcatttcacttccctatataagatgctacaatagcccctaccatattcagaataaaatccagactcctattacatttggcccctgtttatctgtccagctctttcatcattatctttccggaaacacactccaccagtcttgaggcacagtgaaccaccttcagtctcttcagtgagtgatgccttcttgtgcctacatttctgtccacatgctgctccttctgtttccaatccttatcttcccctttatttatttatttattttttttttgagacaaggtctcattctatcacccaggctagattgcaatggtgtgatcccagctcactgcaacctctgcctctcgagctcaagtgatcctcccacctcagcatcctgagtacaggcacacacccccacgcccaactaatttttatattttttgtagaaatggggttttgccacgttgcccaggctggtcttgaactcctgggctcaagcaaactacctcctaaagtgctgggattagaggcgtgagccaccacgcccggctccccttcatcttaatggcttgagattgaggcaagcttgagctctaattccagtctgtcagttctgtcttttcatttacttaataagggtttcctggcactgggcaaggtgctaagaatacaagtagctactgcctaaggaagctcacagtctcacaaagcagataagtacagagaacgtcagaattcaatgtgaaagtgctgtaacaaaaggaaactagaacagaaggcttcccagaggaactaactcctgagtaagtactaaagggcatttcccaccatatgacatatagaaagaggaagggtgtctgtctgtgttgctggagcagggtcaggagacagggagtagcagaaagatgaccatgcatggtggccatattgagtgggaggcactcctgggtcatgcaagcagagatgctgaaacacacagtacacaggtagacctacagtgttgagataaagaggaagatgttggagtggaaagcagtcagtacagagatggcagctgaaaccacaagaacactaccccacactattacactgtcaatgatacaatgacactactatggtaatgacaacccacagagaacacaggtttaccccatactgatgatgtgtttgacagagctacataccaggttgaaaagatctttttcttagtttcctaaagtactagctattcaaggaacaaaatctatctgaatctaaaagtgacctagttacatactctgggaaatttgagaatatatacagcctatttaccccgaagtaatttacaatccactgggaaaacaatgggttttccatcatccaatgaaaaatgggatattctgcaattcagcactcgagggaggctggacaggggaggaactggctttgattgagatgcttagtatatgcttgtcacaggaaggtggcttttagagagccccgagggatgaatggaccttcagcaggaggagagaaaacagcaccataggtccagagcccataagaacactacaccacactgtgtagacagctttctcttcatgtctaagaaagttagtgtgcagaaatcacaatactataaagaggtctcaggaaggagcttgggtggacagaagcagaggatgcctgttggtggtatccaaggtaagaatctgacaaatggcataaagcaaaatgtgcatatttgcttgcaatacccatggactttttcaaaaataccaaacttcttgcatactgaaataactgcattgagtatttatttattttaggctgtggctttcctatcataaaatccaagtatgtggtcagaataacctaagggtatctcaaacattagcccttaataatcatgatttgaatcttcaaaccttcatataaggaaaatagccttcccaaggataggttctaattaaaatcctggagactagattttctttaattttttttttttttttgcttctctatttcctaggcaaagaaaaggataccactggacttcgtaaacttctcaagagtattctcttgctcaagaacaaaacactctccagaataatctaaaatctacatggaataatacaaaaactatggggggggagttgaatttcaaggcccttacagtccttgataaacaatgatggaataaataatggaaaacataatctgtggctgctcaactagacagttctgctaatgaccataaagagaacccaaactctaaaacttacctctgtatttcccctttacattgagttaggctgaagcaatagctcaaataatccaagttaacaaaagccgacagagaagtgattcagaggtaaatgcatttgttcattcattgactcattcaacactcgcttgaaacttatcacatgccaagctctgtctaggtgctggagtacatggggaagaagccacgcccctgccttcatggaggtgtcactccaaactcagctcaattttacagcaacgtcaaattacacaaaggacttcaacttatagttttccttccagaggttagattgtgacactttcataaaacttatgttagtgtgctgcttctgctcaggattcagaatgaataaactaaaattctacccttcctttaagaactacttagaaaaaaaaaactttataaataatatgatgaattaagaatcccataacttggtcatgagaaatctctgattttatttagtctaatctcctataagtgatcctccttatggagtatatgtgaaagattatcatgtattaaaacaagaatcccaaaagcattatacattaacatttattgaatccgtttactaactcctctttgttaataaattccacgggtgataacaattacctgttcatatgcccagaatttaacagctgtctcaggagcaattttgatgacgtttgtaccatttcccctccaaagcgagcggatacctccttcttttaccatctgtcgaaagccaccaaatatgttcattttgtctgattttgaaccgtgaacctaaaaataaaagcagaatgatataaaatgctggtggcatattactattactttttctagaacaaccacacaatctttttcaataccctttctaactgcaagaagatatatttgaaaataaaatatagaaaggttgaaaaatatatataatgatgagagggagtattgccatgattttagaggcctgtctctgactctaaaactaagaataattggtatcttcagtgtgagaaagcagagagagaagacaagaagagtattaaaattatgaacaaccttcataagataatattaactaaattatgtatcaggcaatggaacaccctttgaaacatgaacaggctcagttaaagggaaataaaaaagtatactgcagataataatattatattattacatataatttaatgtatgtatattattacatataatttaaagtaatatgttactccctctcctcaagaagtagtacagacatgaactgtaaatgggtctgaaatggtttggatattgtgtatatcagggctaccaacactggaatgcatacagcctgaaaccaaaaataaaaattgcaccctctttggcatattttgaggccctctctaggcaataaattcattacaacatgtacccatcctgtgagtactgataaattacttggcttatactacagatgtggtagtcacttaaaaatactgtaccttatgaccacctacagataaaaactgattaagtccaatacaccaaaaataattaaacaaatcagctattcttctgattgtttcagctcacataaaaggggtgactaccactaaacacacacacacacacacacacacacacacacactcacagaacgggttgaattctgaaggccagccatgtggccagtatgaaaacgggccccaataagaactctgcacaccaaaggctcaggtgagcttccctggttggtctgcaatattccatgcctagtgccacataacagtgccaggaaagtaagacatggagactccacagggagaggacaacagaagctctgccctatgtgcttctttacttgactgattttcatccgcatcttttccccgtaataaaccataaccaggggtaataagctttcagtgagttatgtgagtctttctagagaagtatcaaacctgaaggttgactttggaaactcctcaaatttgcagaaactaaattccagagaaatccattttattttaaataaataaacttcacaataaaataggacaaaggaaaaaataaatgcttattcaagttctctaaaagtcaagttactactgttcctaaagaaaaacacacaccaatcccctctcctttttctttaaagcattagctttgcccctaaataaattttgagatttgggtacattctgaaggaatgctggcttaaaacagtgtcagaatctttttgtacagaaatctacagacaaatataaaaagtgttgaccataagtataacaaagttttaaaaatattttgtaaacaactactatgttccaataggttattccagtgtaccagacattatcacatacctgatattgcttgattcttaaaccattcttattagatattcttatccccatcccagaatgaaggaaaatgagacctcagaggtttcatgcagcatgagaaccaggagcactggaggcaaagatactgcattccccctctcatttgttgtaaaggaaaagtcaattctctgggcctcagattccccctggaaaaatgataaaatacctacttcactgggctgctgcaaggattaactgggttaccacagtgagcaaatacatattaattcttttccattccctctttccactctggccagcccaatgctacactgctagtaaatagcaaagtcagtctataaagccagatctttttctgctaacctcagctttagaataattttcaaaattacattgctgctctaagattctagatttcaaaaatactttacttttgataaagtatattaaaaagaaggaaactataaatcaggagaatcctacaacaatagctagagatattttttgaattaaatgtttgaatagtcatagaatgccaaagattaaaagttcattacacacatgtactaacaatttaaggtttggtacactgccatacttacatggactgaatttagagttaacagcaacaaaatagatttattttttagggtataaaagattattactgagaaattttaaaacttctttttcaaagcaccacatttctcattgttttagaatatttagggcaaacctggacacacgataataaagctcacctgcatcatgattttcagacggtccaaaggggcagtgcttgttcgagagacagcaccagcaatgcctcctgccaaaagctgcctccaccattgtccggattttttttcgtcttccgtgaattcatctggaatagttaagctatcccctatgtcaattccctgtaaaaatgaaaaaaagatccccatgcgccttagttaaaaataatcccagaagacgttttgttttagagaagaatcatgttattttacagttaatatgaacttcattccctagaatttatactaaaccaatttgagtacatagattataagttgtctactcacaatgaacaaagtacagtatcagttcacaagaaatgaaaataaacagtaattacaaatatacaaaaccaacagttacaactttctttcattcatcatagattcacagtatgttttctcttggtctaggttaaaatgaaagggcagcattttatcatagtcaatcttttttattgcaaccatttttcataaggctagaaaaccaactggtgatgacatcttttaagaaattcgttcatcaattcttaaacaatacttcctttatctcaaatttatatccacatcatatttataccatgatatgttttaaatatgtaaataaaaattaaaactgtatgtgaatacccctaaactcatttcctactgtttataaaaatatttttataaatctgacttatcatttaaaacatgcaatagattctatataaaatttagctaatggagaggtattgtttcaaatcatcaccccttcaacctattctacattactatagtttgagagaaacaattctataataatatttttacaattctattatctaaattgttttggcagaaaaatttttacaggcaagagtgcaacggggaggagctctcctatggtagtaaccctcccttccttcattttactatcaataaaatggagatacaattgtagtctcaactgttatcaactaccttaaaaaataccgtaagaattatgtaaataaaacttcacatagtgtacaatttatctaggcaactgaactactagtataatattatcttatactcatagctgagaaggcactaatcaccaacaattttataatgctttatgtaagcttaggcattgttactagtggcaatgtgaactcctgacttcatttaatgcatatttaatttagtcaaatctgaagtgtagaagacaagcccataaagaaaaaaaaaaaaaaaaaggccgggcacagtggctcacgcctgtaatcccagcactttgggaggcgaggcgggcggattacaaggtcaggagatcgagaccatcctggctaacacggtgaaaccccgtctctactaaaaatacaaaaaaaattagccaggcgcagtggtgggtgcctgtagtcccagctactccggtggctgaggcaggagaatggcgtgaaccccggaggccgagtttgcagagagccgagatcgcaccactgcactctagcctgggcaacagagcaagactccgtctcaaaaaaacaaaacaaaaacaaaaacaaaaacaaaaaataaataaaactccttcagagagttcctaagggtttcaggagcagattgcacaataatagaacttggtttacatcagtatgcagaatattaatgaaacaatcaaaatttgaaagtttggtggaaaacaaactggtatgaaatgctaagcagatgaagcaaaaagattctgtaacctttaatgaatattgttaagtgccttatgccagagataaacataatctgaccaaacaaggacacagatccttagcaaccatgaggtgctgagattatttggacaatatagtacctataaaaagtaaaagcctacaacttttacacttccctatggcagaatacttaaatgccaataaaagctagacagcttattcatcaaggtggtacttcttccaagttttcagaatggacatttatgcagtcttgggttgtttttttttttttttttttaattgatcattcttgggtgtttctcgcagagggggatttggcagggtcacaggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcctgctgccttcaagcatctgtttagcaaagcacatcttgcaccgcccttaatccatttaaccctgagtggacacagcacatgtttcagagagcacagggttgggggtaaggtcatagatcaacaggatcccaaggcagaagaatttttcttagtacagaacaaaatgaaaagtctcccatgtctacctctttctacacagacacagcaaccatccgatttctcaatcttttccccacctttcccctttttctattccacaaaaccgccattgtcatcatggcccgttctcaatgagctgttgggtacacctcccagatggggtggtggccgggcagaggggctcctcacttccctgtaggggcggccgggcagaggcacccctcacctcccggatggggtggctggccgggcggggggctgacccctccacctccctcccggacagggtggctgccgggcggagacgctcctcacttcccagacggggcggctgccgggcggagggtctcctcacttctcagacggggcggccgagcagaggcgctcctcacatcccagacggggcggcggggcagaggcgctccccacatctcagacgatgggcggccgggcagagacgctcctcacttcctagatgggatggcggccgggaagaggcgctcctcactttccagactgggcagccaggcagaggggctcctcacatcccagacgatgggcggccgggcagagacgctcacttcctagacaggatggcggccgggcagagacactcctcactttccagactgggcagccaggcagaggggctcctcatatcccagacgatgggcggccaggcagagacgctcctcacttcccagacggggtggcggctgggcagaggctgcaatcttggcactttgggaggccaaggcaggcggctgggaggtggaggttgtagcgagccgagatcatgccactgcaccccagcctgggcaccattgagcactgagtgaacgagactccgtctgcaatcccagcacctcgggaggccgaggctggtggatcactcgcggtcaggagctggagaccagcccggccaacatagcgaaaccccgtctccaccaaaaaaatacgaaaaacagtcaggcgtggcggtgcgcgcctgcaatcgcaggcactcggcaggctgaggcaggagaatcaggcagggaggttgcagtgagccgagatggcagcagtacagtccagctttggctcggcatcagagggagaccgtggaaagagagggagagggagaccgtggggagggggagagagagggagagggagagggagagctgtttttttttgtttaatactctataaatctatgcctaatagaataaatagaactctacaggttaaggagctactgggactcaggtatcctggcccataagtgttacagagtgttcttgggtgataactgtacctatggtttatagctccaaataagtataaatacataaagtagacttactgtagaatgtttccagaaacggataatttcctcaatgtctgtaacaggattaaataagaagtagtctctccattcattccagtccactgtcattgtcccatcaacatcaatgctgaaattttaaaaaaatgatcaaagtacaaaactaaattgataaataaaactaacattattggccactttacagaatgacagtttcttttctaacataatattctcattaaattaaaaaaccccatccacaaatataggttgttggaaatggcagcaagcattttatggtcctgtcagatagttttaattatctagataaaaatgggcccaaaaattacagccagctcactaaagaatactttcagcactctgtcaaactctgccaatgagctacaaaacacaaaaacttgaagataaaatattaaacgatggtaatgaatagattcattatccatttttttcatgcacttagtggatcatgaagataattcttaatgttctattgcaacatttgaatgtagttttgaaatatactcaaaacatgctatcaacttcctcgaagttaggaaaattaacagctattataaaaaatcaaactgtcagtgactgtgcctttgagtcttttttttttattattatactttaagttttagggtacatgtgcacaatgtgcaggttagttacatatgtatacatgtgccttgctggtgcgctgcacccactaactcgtcatctagcattaggtatatctcccaatgccatccctccccctccccccaccccacaacagtccccagagtgtgatgttccccttcctgtgtccatgtgttctcactgttcaattcccacctatgagtgagaatatgcggtgtttggttttttgttcttgtgatagtttactgagaatgatgatttccaatttcatccatgtccctacaaaagacatgaactcatcttttatggctgcatagtattccatggtgtaaatgtgccacattttcttaatccagtctatcattgttggacatttggcttggttccaagtctttgctattgtgaatagtgccacaataaacatacatgtgcatgtgtctttatagcagcatgatttatagtcctttgggtatatacccagtaatgggatggctgggtcaaatgatatttctagttctagatccctgaggaattgccacactgacttccacaagggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttctttcgagaagtgtctgttcatgtccttcacccactttttgatagggttgtttgtttttttcttgtaaatttgtttgagttcattgtagattctggatattagccctttgtcagatgagtaggttgcaaaaattttctcccattttggaggttgcctgttcactctgatagtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctaggggttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattggtctatatctctgttttggtaccagtaccatgctggtttggttactgtagccttgtagtatagtttgaagtcaggtagcatgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattgccttgggcagtatggccattttcacgatactgattcttcctacccatgagcatggaatgttcttccatttgtttgtatcctcttttatttcattaagcagtggtttgcagttctccttgaagaggtccttcacatcccttgtaagttggattcctaggtattttattctctttgtagcaattgtgaacgggagttcactcatgatttggctctctgtctgttgctggtgtataagaatgcttgtgatttttgtacattgattttgtatcctgagactttgctgaagttgcttatcagcttaaggagattttgggctgagacaatggggttttctatatatacaatcatgtcgtctgcaaacagggacaatttgacttcctcttttcctaattgaataccctttatttccttctcctgcctaactgccctggccagaacttccaacactatgtcgaataggagtggtgagagagggcatccctgtcttgtgccagttttcaaagggaatgcttccagtttttacccagtcagtatgatattggctgtgggtttgtcatagatagctgttattattttgagatacatcccatcaatacctaatttattgaaagtttttagcatgaagtgttgttgaattttgtcaaaggctttttctgcatctattgagataatcatgtggtttttgtctttggttctgtttatatgctggattacatttactgatttgcgtatattgaaccagccttgcatcccagggatgaagcccacttgatcatggtggataagctttttgatgtgctgctggattcagtttgccagtattttattgaggatttttgcatcaatgttcatcaaggatattggtctaaaattctctttttttgttgtgtctctgcctggctttggtatcaggatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagatcctgttattggtctattcagaaattcaacttcttcctggtttagtcttgggagggtgtatgtgtcgaggaatttatccatttcttctagattttctagtttatttgcatagaggtgtttgtagtattctctgatggtagtttgtatttctgtgggattggtggtgatatcccctttatcattttttattgtgtctatttgattcttctctctttttttctttattagtcttgctagcggtctatcaattttgttgatcctttcaaaaacaaccagctcctggattcattaattttttgaagggttttttgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagagcgtctttatttctgccttcatttcgttatgtacccagtagtcattcaggagcaggttgttcagtttccatgtagttgagtggttttgagtgaaattcttaatcctgagttctagtttgattgcactgtggtctgagagatagtttgctataatttctgttcttttacatttggtgaggagtgctttacttccaagtatgtggtcaattttggaatagccgtggtgtggtgctgaaaaaaatgtatattctgttgatttggggtgcagagttctgtagatgtgtattaggtctgcttggtgcagagctgagttcaattcctgggtatccttgttgactttctgtctcattggtctgtctaatgttgacagtggggtgtgaaagtctcccattattaatgtgtgggagtttaagtctctttgtaggtcactcaggacttgctttatgaatctgggtgctcctgtattgggtgcatatatatttaggatagttagctcttcttgttgaattgatccctttaccattatgtaatggccttctttgtctcttctgatctttgttggtttaaagtctgttttatcagagactaggattgcaacccctgtctttttttgttttccatttgcttggtagatcttcctccatccttttattttgagtctatgtgtgtctctacatgtgagatgggtttccttaatacagcacactgatgggtcttgactctgtatccaatttgccagtctgtgtcttttaattggagcatttagtccatttacatttaaagttaatattgttatgtgtgaatttgatcctgtcattatgatgttagctggttattttgctcgtttgttaatgcagtttcttcctagtctcgacggtctttacattttggcatgattttgcagcggctggtactgattgttcctttccatgttaagcacttccttcaggaactcttttagggcaggcctggtggtgacaaaatctctcagcatttgcttgtctgtaaaggattttatttctccttcacttatgaagcttagtttggctggatatgaaattctgggttgaaaattcttttctttaagaatgttgaatattggcccccactctcttctggtttgtagagtttctgccaagagatccgctgttagtctgatgggcttccatttgagggtaacccgacctttctctctggctgcccttaacattttttccttcatttcaactttggtgaatctgacaattatgtgtcttggagttgctcttctcaaggagtatctttgtggcgttctctgtatttcctgaatctgaatgttggcctgccttgctagattggggaagttctcctggataatatcctgcagagtgttttccaacttggttccattctccccgtcactttcaggtacaccaatcagacatagatttggtcttttcacatagtcccatatttcttggaggctttgctcgtttctttttattcttttttctctaaacttcccttctcgcttcatttcattcatttcatcttccatcgctgataccctttcttccagttgatcgcatcagctcctgaggcttctgcattcttcatgtagttctcgagccttggttttcagctccatcagctcctttaagcacttctctgtattggttattctagttatacattcttctacatttttttcaaagttttcaacttctttgcctttggtttgaatgtcctcccatagctcagagtaatttgatcgtctgaagccttctctcagctcgtcagagtcattctccatccagctttgttccgttgctggtgaggaacagcgttcctttggaggaggagaggcactctgctttttagagtttccagtttttctgctctgttttttccccatctttgtggttttatctacttttggtctttgatgatggtgatgtacagatgggtttttggtgtggatgtcctttctgtttgttagttttccttctaacagacaggaccctcagctgcaggtctgttggagtaaccggctgtgtgaggtgtcagtgtgcccctgctggggggtgcctcccagttaggctgctcgggcgtcaggggtcagggacccacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagtttgagcttcccggctgctttgtttacctaagcaagcctgggcaatggcgggtgcccctcccccagcctcgctgccgccttgcagtttgatctcagactgctgtgctagcaatcagcgagactccgtgggtgtaggaccctccgagccaggtgcaggatataatctcctggtgcgccattttttaagcccgtcagaaaagcgcagtattcaggtgggagtgacccgattttccaggtgccatctgtcacccctttctttgactaggaaagggaactccctgaccccttgcacttcccgagtgaggcaatgcctcgccctgcttcggctcgcgcacggtgcgcacacccactgacctgcgcccactgtctggcactccctagtgagatgaacccggtacctcagatggaaatgcagcaatcatgcgtcttctgcgtcgctcacgctgggagctgtagaccagagctgttcctattcagccatcttcgcctttgagtcttaagaaatcctggcacctcattttcaatcttaaaattaacatactgtactcaaatatttatcattaatatttggcttgttttacaagtttcttggtaattaatgccatttgtatctgttttctcctaagagaaactctgagtgtaccaggattttgactgttttattcccttccttgggccacctcttacagctgctggcacaaagaaggtgctcatttatttattgaattaatggatgtctctaaaaaaagctttggtgcatcctacaaattttattctataattagtatgaaaatgatgcaaaaggatggcagtcaaataaaatgcaattttcaggtattcattattgtgttttctagtgtcactttttattttgacttgcatatgggaaattacacttaaactttcatttgtcccagcacagaggtatatctgcatgagagtcctagtcactacttacatttataatataactctgggttgcaatatttataggtttatttatgtcactattttctattttaatgtaattgttgtttgaccccaccacccaactccccacacataagcatcctccacaaggcaaggattttttttaatttcattcaaagttataaccaaggtttctaaaacagtgcctgccactgagtatttattgaataaataaatgaattacaaactctgtagcttaaaaccacagaacatttagggtattgacaaacttcctagataagatagtcttgctgtgggtataacttgcatttcccttcaaattactaaacgtgttgagcatctcttaccatgttcatttgctactgctgtttctttcacgtgaaatatgctgttcatgtctttgcccgtttttctaaccggttgtatgtctttttcttatttacatagttctttatatcattcattctaatccttcaagttataagctggcaaataccttctctttgtctttccactctatgctgtccaagtacagatgctcttgattttaacgcagctgaatttaatctttttaatgcagctgaattcaatcttttcattcctatgtatggccttttgtgtcttctttttaaaataaattcttccctacactgagataaagatatttcttccccaccacctcaagctgttatagtttaactttcacgtttaggttggtgtttgtgtacggtaagaggcaggtatcccaatttcctttttgtctgcatgagcacgagcatcatctattgcacacactctccttttcccaaagttttgcaaagctacttctttcacgtgacaaatccaaaatatggatgggtctgtttctgggctctctattatgtttcacttgttaacttgtctgtttctgtagaaacagcactgacttggttatggcttaataacaacccttggtatctgatagggcaggcccctggctccttacagttcttcaggaatgtcctggatattcttaggcctttgctctttgatataaatttgagactcagcttgacaaattcctcaaaaaaaccaggtgggtttttttaatggcattgaatctctatcaccaatttggagagaaggtacatcttttctatactgagtcttctttaaagccttctaacaaattttgttaagctgctcttatgaatgcattgattgtggtatattttttaaaatggctgattcagtttgctaatattttctttaaatttttacatataagtcataggtatcttggcctctaatttccctgtttcatatactgtctgcttttggtgttataatgatctcctagaaaggataggacagtgtacttctacactctggaaatgtttgtacatctgttctttaatcatttgcaagaaccatctggggctaacgttttgtttatgagaaaattttaaattactgacccaatctcttcaattgcttaggtactataagctgttgcttcttcattcagtcccagtaagttatatttttctagaaattcacctactttgtctgttttcaaatttattggcattaatgattcatattattttattagttttttaaaagtccttatgtgcctatttataactgaacatgatttatttacatctcatttctcttttttcttcatcaatctttccagaggcttgtcttttccaacagtttctggctttgttgatcctgttactgcatctttgctatatattctttattatctccttcctcctaccttcttcgagattattccattttctctcccctaacttagcacattaattttcagacttaattcttttctaataaaagctttcagactataaaattcatacaagttccatcttagaaatattccataagttttaatgttttcaagtcaacgtgtccttgaatttccacttacgatttcctttgacccataagttgagaagtgtatatcacactttaaaatattggcatttttataatttatgtctgtaattaacttctattttaatgcatagtggtcagagaaagcagttcttgtgataccagttctttgaaatgtgttgaacctggctttatggcctactatgaaatcaatttttatacatgttccataaatacctaagaaaaaatattttttctaattttttgatgctaggtcctattacatgcccattaaatcaagcttatgtatttagaagtttttgtcttcactaaagtttttctctgcttgacctatcaaatacaggaagaattgtgttaaaatctctcaccactatgatggatttgccaattaatccccagaattttatcaaccagcttaaaaattgtatatcctcatactgaattttaaaatgtagtgacactctatttttattaatgtttttactatataatctattattaatagattattaataataattaacagttgatattaacatagctaccccagctttttttcagtaagacttttattttgcttgttctttcatctgacaatctctgccttctgatgaaatttacattaatttttattaattgaagactaaactgagaaagtcctaactgatcagaaggtgattatcttctaacttactcgtcacccacctcaaacccccagggaaacaggataagaactctatttaggctgccccatttgagaatggggatgaagggaaatcatgccccaacattactgcagggcacattttagtggagttttactgtacttgaatttatttctcacatcttacctattgctttctaattatctcattctttctatgtttttccctcttctctctactcttcattggattgtttcaatcttatgtttatgtatttattttcttattccatttctttcccccctgatttggaagttatatactcaactactacagtttcaatggtttaccttgaaattttaccacatatatataacaaagtctaaagttaatgtctgaccccatcatcctaaataaggtaagaattttagaacagtttaatacaaatcatccccttccctcctaacttacatactattattgtctagtattgtagttgtcctttttcttagaacccacaaatgggtcattattatcatattcatggatgtttccaacagactgctgaaataatccataggccactagctaagaggtggcccactatggtctagagagtaccaagaaacactgtgtgacccattccccatatatgctgcctccagggctgtatatgtcctttcccctacctaccttccactcacccttttcagtagcataattctactcattctttaacatattcttcaatattttctgagagtccattattgcaacgtggtggacatagaactgttaaccagatacacatggtctgtgccctcagtgggaacaacaggcatggcactaaacaaaagcaagcaatactcaatattcattgagcatttgccaggcattgttctaagtatttcacatgttaactcatttaatccttaaaacaagcccatgtatttactatactctccattttacagacaaagagaggctaagaattttgttatagtcacaagactagtaagtagagtagaattaagagtttcaacccaggcattctaactccaaactgtactcctaaccactgagctatacaaacaagtcaaggattacaaaccataagtgccatgaagcacagaaacaaattgcatagtcaaagaataactggagtgaagggttccaagcttctgaacaattctggagaaagaaatgtaaagatatgaaaatgagagtaaacaggggaaatgagatggagacaaaagcctaaaagaaaaatgagagcagaagataattatgacatatgtgaaacacatgtttcagagggaatgcctgcttcagctacttcatatctacagcttctactgaacaggtgtaagtaggaggctatatttcaactcagtgactcctctcttacaccctgatgacccagtcacagctgtttcaatcaacactgtgttagtctgttttgtgttgttttaaacgaacacctgagactcggtaatttataaagaaaagaggcttatttggctcacagttctacagactgtacaagcatggcaccaacatctgctcagtttctggtgagacctcaggaagcttttactcatggctgaagaaaaaaggtgagcaagtgtgtcagatggtgagagaaggacaagagaaatgagatgccaggctcttatcaacaaccagctttcatgaactaatagagttcacttattaccaagccattaatgaaggatccactctcgtgacccaagtagtccctacttccaacactggaggtcatatttcaacatgagatttggaggggacaaatatccaaaccatattaagcaccattcagatgtttttcccatgaattcaagtttgggacacaaagagacagtgaaatggaagaaaacaagctgacatttggagtgacatgagtaacactaatggcttagcacttgagggaaggtccatgatggttatataactacaggaaactctggtcacattctgcctttaaaaattgtttctaacacttttactgaagaagtataaacactagtaataataataataataataacaatatcccaaaagtacaaaaaaagtcactagccatgaaagaaatataaatcaaagccatgagatatcacttcataccaattatatattagtcagggttatctagagaagcagaaacaatggatggttaaaatcaaaagaaatcaaaagacagttcagatatggtggctcatgcctgtaatcccagcactttggtagggcaaggtgggtggattgcttgagcccaggatttcgataccagcctagatgatatggtttggctgtgtccccacccaaatctcatcttgagttgtagttcccataatttccatgtgtcacgggagacagctggtgggaggtaattgaattatggggggtggtcaaccccatgctgctgttctcatgatagtgagtgagttctcacgagatatgatggttttatagggcttttccctctttgctcagcacttcttcttcctgccaccatgtgaaggacatgtttgcttccctttctgctatggctgtaagttatctgaggcctccccagccacgcgaaactgtgagtcaattaaacctctttcctttataaaatacccattctcaggtggttctttatagcagcgtgagaatgaactaatacagtaaattggtactaggagttgggtgctactataaggatacccaaaaatatggaactgactttggaactgggtaacaggcagaggttggaacagttaggaaggttcagaagaagactgggaaagtttggaacttcttaaaaatttggagagctcagaagacaaaaagaggtgggaaagtttgtaagttcccagagacttgttgaattgctttgaccaaaatgctgatagtaatatgggcaatgaagtccaggctgagatgatctcagatggagatgaggaacttgttgggaactggagcaaagatgactcttgttatgctatagcaaagagactggtggctttttgcccctgccctagagatctgtggaactttgaacctaagagagatgatttggggtatcaggcagaagaaatttctaagtggcaaagcattccacaggaagcagaggacaaaagtttgtcaaatttgcaccctgatgatgtgacagaaaagaaaaatctattttctgaggaaaaaattcaagccagctgcagaaatctgcataagaaacaaggagtgaaatgttaatcactaagacaatggggaaaatgcctccagggcacttcagaggtcttcaggaagggccctcccatcataggcccagaggcccaggaggaaaaaatggtttcctgggccaggcccagggccttgctgctttgtgcagtctcaggacttggtgccctgcatcccagccatggctaaaaggagccaaggtacagctcaggccatggcttcagaaggtgcaagccccaagccctggcagcttccacaaggtgttgagtctgcgggcacacagaagataagaattaaggtttgagatcctctgcctagatttcagaggatgtatggaaatgcctggatgtccagacagaagtttgctgcaggggtggagcccttgaggagaacctccgctagggcagtgcaaaagggaaatgtggggttggagccttcacacagagtccccactggagcactgcctagtggagctgtgaaaagagggccaccatcctccagtacccagaatagtagatccaccgacagcttgcaccatgcacctggaaaagccacagacactcaacgccagcctgtgaaaagagccagaagggggtctgtaccctgaaaagccacaggagtgcagatgcccaaggccatgggagcccacttcttgcattagcatgaactggatgtgtgatgtggagtcaaaggagatcattttggagctttaagatttgactattccactagatttcggacttacttggggcctgtagccccttcattttggccaatttctcccatttggaacaagtatatttaatcaatgcctgtaccctcattgtatctaggaagtataataactaccttgcttttgattttacaggcttataggcagaagggacttgccttgtctctgatgaaaccttggacttttaggttaacgctggaatgagttaagacgctgagggactgctggaaaggcattattgtgttttgcaatgtgagaacatgggatttgggagggaccagggcaaaaatgatatggtttggctgtgtcctcacccaaatctcattttgaattatagttccaataatccccacatgtcacaggagggacccagtgggaggtaattgaatcatggaggaggctaccctcattctgatgttctcatgatagtgagtaacttctcatgagatctgattattttataagggtttttttccctctttgctaggcactgctcttcctgccatcatgtgaagaaggacgtgtttgcttccccttccaccatgattgtaagtttcctgagggctcctcagccaagcaaaagtaagtcaattaaacctctttcctttataaattacccagtctcaggcagttctttatagcagcatgagaatggactaatacaccaggcaacatggcaaaaccacatctctacaaaaaatataaaaattagccaggcattgtggtacaatgcctgtagtcccaggtactcaggaggtgagaggatcaattgagccagggaagttgaggctgcaatgagccatgattgtgccattgcactccagatgggatgacagagcaagaccctttctcaaaaaaaaaataaaaatcaaaaaatgaaaagacagacagtaatgagtattcatatagctatggagaaactgaaaccttcattcattgctgctgggattataaaatggtgcagccactttagaaacaatttggaagttcttcaaaatattaaagatatttaattaaatattaaagaatctctagacaggctgactgttgaagggcattctcagacaaagccagtctgcaaagactgaaataagtgcctacttcttcaaatgcacagatgtaaacacaaggccacaaacatcaacaacaatcaggaacaaatgacaccactaaagaaacaaaataaagtaccagcgaccatccctaaagaaacagagatgtatgaactgacatagaattcaaagaaagctcagcaaacttcaagaaaatacaaagaaacaattcaatgaaattaggaaaataacgagtgaccacaaagagaaaggtaataaagagatgaaataataaaagaaaaaatcaaacagaaatcatggggctgaaaaatacaatgaacaaaattaaaatgcaatatgggagcatcaactgcagaagtgatcaagaagaagaaagaaactatgaactcaaagacaggttatttgaaaatacacagaggagaaaaaagaatgaaaatgaatgaagaaagcttacaagatttatggaacagcatcaaaagagcaaagttttgagtcacaggagttgaagaaggagaaaaggaagataaaaggggtaaaaagcttaattaaagaaacagtaacagaaaattttccaaacctggagaaagaggtaaatatctacatgcaggaaaagtccaaggtctctaatcagattcaatccaaacaagactaccccaagacatattacaatcaaactatcaaaaatcaaagacaatgagaggatcctgaaaacagcaaaagataagaagcaaataacatataagacagtcccaatatggttggaaacagactggtcagcagagacctaacaggtcaggagagaaagggatgatatatttaaagcgttcaaggagaaaaataccaaccaagggtaatgtacccagcaaagtgtccttcagaaatgaaggagagatactttcccagacaaacaatagctgagggagataatcatgaccgcacctattttataagaaacgtaaaaggagctcctcaagctgaaagaaaaagatgctaatgagtaacacaaaaacatctgaaagtataaaactggctgataaaagaaagtacacaggtaaattcaaaataatactgtaatgatggtatgcaaatcacttacatctgtagtaggaaagagaaaactattaaaagtaataatagctacaataatttaagggatacacaatatgaaaagaggtaaactgtgacatcaaaaattcaaaatttcaggggattaagtaaaagtgtagatttttttgttttggggggtttttgcaataaaaattaagttatcaagttaaaataaactattataactcttaagatgttttttgtaacctcttggtaaccacaaaccaaaaaccaataggagatacacaaaaaataaaaagcaagaaatcaaaacataccactagagaaaatcacttaaccacaaaaaaaagacagcaagagaggaagaaaagaataaaggatctataaaagaaccatgaaacaataagcaaaatggtagtacaaagtccttacttatcaataattaccttgaacatgaatggattaaattatccaatcaaaaaacacagtgtctgagtggattaaaaaaactagatccaactatatgctgcccatgacagactcatttcatctgtaaaaatacacacagactgatggtgaaggaatggaaaaagatattccatggaaacagaaaccaaaggagagcaggagtaactttacttgtatcatataaaacaaactttaagtcagaagttgtaaaggagaaacaaagttcctatataatgataaaagggtcaattcaataagaggatataatagtaagttatatgaaggtacttttactccactcctcccattttaaattttcagtgtcacaatttatatattttatattgcatatcccttaataagttatgtagctattgttttttataaatatatatgaacccaacatcagagcacctaaagataaataccaaacattggccaggggtggtggctcacacctgtaatcccagcactttgggaggccaaggcgggtggatcatgaagtcaagagatcaagaccatcctggccaacatggtgaaaccccgtctttactaaaaatacaaaaattagctgggcgtggtggcatgcgcctgtagtcccagcgactcgggaggctgaggcaggagaatcgcttgaaccgtgagacgggggctgcagtgagccgagaccctgccactgcactccagcctggtgacagagtgagactccgtctcaaaaacaacaacaacaacaacaacaacaaataaaataaaataaaaaccattaatacgtctgaaaggagagagagactgcaatacagcaatagtaggggacttcaacaccctaccttcagcaatagacaaatcatctcaacagaaaatcagtaagaaacatcagacttaaactatactctagaacaaatggacagatcagacataaaacatttcacctaatggcaagagaatacacattcttctcaactgcacatggaacatgcaccaggggatatcatatgttaggccacaaaacaagtcttaacaaatttaagcagaatgaaatcatatcaagtttcttttccgaccacaataataaaaaactagaaatcaggccaggcgcggtggctcacgcctgtaatcctagcactctgggaggccgaggcgggcagatcacgaggccaggagatcaagaccatcctggctaacacagtgaaaccccgtctctactcaacatacaaaaaattagccgggcgtggtggcgggtgcctgtagtcccagctactcgggaggctgaggcaggagaatgacgggaacccgggaggcggagcttgcagtgagccaagatcgggccacagcactcaagctcgaggacagagtgagactccgtctcaaaaaaaaaaacaacaactagaaatcagtaacagaggtgcttcagcaaattcacaaatacatggaaattaaacaacatgctcctgaatgatcagtgggtcaatgaagaaactgaaagcaaaattcaaaaatttcctgagatgaaaaaaaatggaaacacataataccaaaacccatggaacacagtaaaagcaattttaagagcaaagtttatggcagtaaatgcctacataaaaacaaaaaacctcaaataaacaaccaaaaaaccccaatagacatttttcaaagacatacaaatggccaaaaagtacaaaaaaaaaaaaaaagctcgatatcactaattaccacagaaatgcaaataaaagccacaatgagatatcacctcatactacacttagaatgactattaccaaagagacaaaagataacaagtgttggcaagtatgtagagaaaagggaacttttgcaccctgttggtgaggagttaaactaatacagccattatggaaagcagtatggagttcctttaaaaattaaatatagaactaccatatgatcctgcaatcccaccactgtatgtatgtgtgtgtatacatatatatatacacatatataaaatgaaatcaatatgtcaaagagccatgtgcattcccatgttcattatagcactattcacgatagccaagatacggaatcaacctaagtgtccaccaatgcatgaagagagaaaatgtgctatatatatacaatagaaaactattcggccattaaaaaaagaaggaaatcctgttatctgtaacaatatgaatgaaataagccaggtaaagacaaataaatactgcatgatctcactcatgtggaatcagaaaaagttaatctcatagaagcagagagcagaatactttgggagtcgggtatggtttgtgttaaaggacacacaatttcagcttgacatgaggaataagttcaagagctccactatacaacatgaagactacaattaataataatatattatattcttgaaaaatactaagagaatggatgtaaagtgttctcaccacagaaatcattaagtatgagatgtatcatgttaattagctagacttagtcactccacaatgtacatatacttcaaaacatcatgttgtacatgataaatacatgtaattctgtcaatttaaaaataaataaatgttttaagtcactgaattgtatactttagaaaagtgaatttatggcatgtgaattacatctcagtaaagctgctggctaggtgcggtggctcacttctgtaatcccagcactttgggaggccaagatgggtggatcacctgatgtcaggagttcgagacaagcctgaccaatatggtgcaaacccgtctctagtaaaaataaaaaaaaatagccaggcgtggtggcgcgtgcctatagtcccaactactcaggaggctgaggcaggagaattgcttgaacctgggaggcggaggttgcagtgagctgagatcgcaccattgcactccagcctgggcaacagagctagactccatctcaaaaaaaaaaaaaagttaccataaaatatttatattaaaaattgtgtagctacttttaaatatccaaccctctgcattatcctttgctatggactgagctgtgtccctcccaaatccaaatgttgaggccctaacccaccgtgtgattatatctggagatagcatctttagggggtaaagtcaaataaagtcataagaatggaaccctgatccaacaggactatggccttataatagaaagcaagagaaagatctctctctctctctctctctctctctctctctctctctctctctctctctgccatatgacaatacagtgagaaggggtctatctgcaagccagaaagagagccctcactacaacccaaccatgctggcactctcatcttaaacttccagctcccagacctgtgaaaaactaaatttccattgtttaatgcatccagcctatggtattttgtcatggcagctaagctaatacttcttagtctattctgaagcttgggcttagaatttgcattattcctaaagctatcaaagaaaatataggaatatgatttctggcctaacagccagggaaaagccctcactttcctataagaatattactttagaagcagaatattatatgctctatatctcactgtccaaattctgtttatcttcttttcatgttttaggttttcatttcctcaggaaagcccttctcatctagtactaacaaaagtcattacgtgctcagccttgagactttgagccttcctcttgagcagctgtttgtaaaagaaattatgaagagagagaaaggatgaaaatgctattggcacagatataaaatgagataaattcaataacaaagccatttagaaagatttttagacaatgtgaggactgaaaatattcacaacaatattaatacaatataattgtcctttctgttttacgttatcataaaaaatcagttcctgccctgtgtttatagcaacagagtatttgagagcacctgggctgcagagattactgctctatcccatgaaacaaaacattaagagtataaaagtctgacttaaatagtcaaactgattgccccagacaataaggttcaaatttgcatttctgttttctgaaagtttaaacaggtatttctttgttagcttggagagcttagtaatttcccttttttccagtcacatctaggttaaataatgtgatgaatctgctagtcttcttagtttgaatcaatgagttttactgtcacattagaaatcaaatggagaaaaagcaacaccaaaactcttcagctcctcatctatggagttaaaaccttacttcctgccattccactatcctttgaggccttgaaagaaagagtccagtctgagcttacacttcccattcttacactttagataaatgtacacatacaaaatgaatgggaggaaaaaagacaaaaagatcttggatatacataatgaagactagggaggtgttttaaagccacacttacaaacacagagttctaatgcagaatattaaagtgaaagtcaattgttgaccaacatgaagagcttacctttgaagaatcaactctgcttgttgttcagaaatagtcagacccagtgtctggagagactggacaatttctgaagcctcaatttttcctttaaaaaaataaaaagggcaaaaaataaaactcagaactggtaagaaccacagaaattatgaatttcaaatctctcatttaagagaaagctttaaactgattaaggcaaaattgtgcatgtaggtgagttatagacttgcttaaatgcctatcccaacatcaatactaaaaatgtaacaaatacattaaaaaataaatacacattttttaaaattcagtaattgtaacagccttatagataaataatattcctccaaagagactgacttcacaagtggccttaccaagtaatgtaattaagaagtagcagaactaaaatccaaatcaagatattctaactccaagataaattcaattaaagtaggatctattcattttaaaagtacctatttctacatttttaataaattactagacatttactatgcaaaacatcatatatgactgagttaaagagaagtagtaaatgaggaaatagagctaaagcacagactattcttttaaaaatctggcagtaaaaggccaggcacagtgactcacacctgcaatcccagcacttttggaggctgaggcgggtggttcacctgaggtcagcagttagagagcagtgtggccaacatggtgaaaccccgtctctactaaaaatagaaaaatcagccaggcatggtggcaggtgcccataatcccagctacttgggaggctaaaagaggaaaattgcttgaagctgggaggcggaggttgcagtgagctgagatcgcgccactgcaccccagcctgggtgacagagtgagactccatctcaaaaataaataaataaaaataaaaatctggcagtaaaaataagggagcaaggataaaagaacaacaaaagacagaaaatttttaatactagggaaattagagcgtgtttgtggacagaaggagaacaatcagaagacaggaagagaaaatagaaaataaaatagaagcaataaatgtaagcactgctgtatttccttctagcagctcacaggctcatgagaatcctaagactactgtacatgaaaaagaatgaaacaaaacaaagtaagagagggtctggtgctgaagcagcataaacagctgacttctccagaaaaagaggaagaccaaaattactgttagtggtgaaaggatagactttcttggagaaaggaccctggagagatgacaggattctgagagaatcctcctggggagagggaaggagcagcatgagaatctggaccatgtaaggacagtgagaggcagcatctgttagtaaagaaattatgcaaatacccttctgaatattctcctttagaaatgcactcttaaagagatatggttaattctcattattcacagcaatcatcttccataaagttctatattcattgcaaacactgaattagcaaataccaaaccattgttcctacaggaaaaacagggttaggttcctgtgagcctctgattacaacactttcatcaactgattaatacataaccatgtcttatgtctgtttctgtttgaacgcacctcatttaatgtgtgctgttgattcactaacattgaatttggggcaaagcttatcaaacgcatatattttctccataaggcatgctatggctttcttgcacttaggaacactagacagcacttcagcactacctttggggaacattttaaaaaggaaattaccaacaaaaatacaaaaatgcaaaaactggcacaaaacagaccttgaaagggatacttgctagttaatagtatgagagctgaaacaagaaggcagagtattgccttattctactagctaggaatgtacatgctgagcaactcaagtttttcactgctctgtgcatgtccatgaatgcctgggaaagtactgtgagtatatattttggggttactttggggataaattttattgagtaggcaaatttgcaaatacagaatccccaaataatgaggatcaactgtatatgttttgcattaaggaagtctaaaaaataaaaatatgaaccaataatgccacattgttttaaaatacacaaacatgggaaattagggaaacattgtgtagatttcctacaaatataccatcaaaatttcatctttaattattgcctctggttcatttagaattttataaaatgaacaattgatatgtacactacttatgcactgggataattgacctctgattatctggcaattgatcttaaggtagctccatctctcagctactgcctgccatagcagcacacagacaatctgacctgcaagacaatctgaactgcagagggtcgatgttggaatgaaagtttgcagagaagaaagaaaactgagttttgctagaagactggactaaggctagacttaggggcatatattgtaaggcttatgggcaacaaatgttccaatagtactactttccaacccaaactcagctcttcctggctgagagtcacagatgtgaataatcttcaaaatcatctagagtttagtttgtttgtttgaaggaacttgctttgaattaaactttaatattcattgtaaatcaggggatggcaaactataaccctcaagccaaataaggtgtattaactatctttgtaaataaagttttattggaaatcagtcatccccattcatttacatattatccatggctgcttttgaggtacagcagcagagacaagtagctacaactgagaccacatgacccacaaagctaaaatatttattatctggacttctggacaaaaaagtttgctgatctcagacatgaaccacatttcctctcaatctatttgtttaacctgtttctttaataacaagtctgtaaatgaaatgaccttgactattcacaagtagggagggatttggtgctgcattataatttttataaattctctcttcctgttaaaggttacctctagtgatgagggcttcaagaccctatttccaattagaattagataaggtcttcagagtagggcccccatgatgggactagtggctttttaagaagaggaagagagatctgaggtagtgcatttgctctgtgatgcctgctagcatgttatgacatagtaagaggccctcaccagattcggctcaactttgaacttcccagcctccagaactataagaaataaatttcatttcttcataaattacccagtctgtggtactccattacagcaacagaaaacagattaagacaaactccaacctattaatcgaaatatagaagtcataatcttaaccagaaggtacacacttaaacgtttatatgctatttttccctaatttccaggatcagagatatcttctctaaattaattcttccaaaaaaactaacagatgcaagataatctgaaagttttttaaattttagatgacacaactgtcattcttctatacaaataaaaagaaatctcattttacccagaggacaagaaaatataattattatttttaacctacaggtttaactcaaatcagcataatgttccatagttaacatttacaacaggccctgcccacagtttttaattcagaaatgtaattcattacatttcaaagtaatgaaaaagaaaagctatctataagttttcttcactaaataatataaactctacataaaaatcacattactaaaaaaaagtattaacacaaataataattatcatctaaaaccagagagattaaataagcatccttttagactcttgaaagcatgataaatgcttcttcatagctggtgataaatacaaaagaaagacacaccatcattatttttgtctaaactcttaaatgccaatttcattttcttctcatggtctttaaggtacttcataaattcttcaaaatccagcttcccatctttgttgacatctccagtagtaaaaattttctataaaaaaaaattagagagaagttattgccaatatgggctgatgcactaaattatttctacacatatttcaagcagattagctgttttcctaaaagactatagtacctatttttggccagatgtatcatcattcattatcgcaaagatctataataaaagtaattccactactgcaaaaagattctgagtcttgtgttaaattttcaatcagaaaaatgatgcattgatttttataaaacatgacatttttaaagctaatctaaccataccctaaatttcttgacatgtactttataaaccccaagatagaagacaaccacttgacctaccacaggatttaaaatattgcagcactttgggaggctgatgggggaggatcacttgaggtcaggattcaagaccagactggacaacatagtgagacctcatctccataaaaaatttttaaaattagccagatgtgttggtgcatgcctgtaaatactagctacttggaggctgaggtaggaggatcacttgagcccaggaatttgaggttacagtgagcaatattgcaccactgcattctaacctggtgacagagcaagaccctgtctctaaaaaagaaagaaagaagaaagcctaaactagtgttttcccctttgatttcaaaaattaaataatcttttactaaggatgatccatataaaaagctgtcatagcaaactgtaagccctctcctaccaccacccaaaatataacctatctacctattatgacactcatagtcacccactcaaagcttacaaattctactgttctcatggtcatgctcttctgggtaaataatgccaagttgggccgggcacagtggctcattcctataatcccagcactttgggaggctgaggtgggcggatcacctgaggtcgggagttcaagaccaacctgaccaacatggagaacccccatctctactaaaaatacaaaattagttgggcatggtggcgcatgcctgtaatcccagctacttgggaggctgaggcaaaagaatcgcttgaacctgggaggtggaggttgctgtgagccgagatcgcaccattgcacaccagcctaggcaataagagtgaaactctatctcaaaaaaaaaaaaaaattaaaaaaataatgccacattgtgactggatggtttcatggtcatggtcagatctccaacctccagactgagagacagatctgaaacttgtgagctgcaactaaagctacacttagagaaagatttctggtttaaaatgcataattagaaaagaagaaagactggaaatcggtgacccatcattgaggcttatctcaatctcaagaaattattttaaaattaagcaaaaaagaagttgaaggaaataaagagcaaaaagtaatgagaaagaaaacacaccattgggaggattaacaaagccaaaagatggttctttgaaaagactaataaaattgataaactcctaaaactggcaaataaccaatgtcagaaagtaaagatggaaactactagacactatagacattaatgatattatgaaaagctttatatcaaaaatatgaaagtgagataacaaacgcctacaaaaacaacttattaaaaactgacataagacagcagaaagtctgatagccctatactcagattttaaagaaatttaaagtgtaatttgaaaacatttccatgaagaaaaatcgaggaccccatggttttaacaataatgtctaccaaactttaagaaaaaaacaccaattttccagagaacagaaagggtgggaacattttccaacccattttatgaggcgggtatacacttgattctaaaacctaacagggacatcacaaaaaaaggaaaattacaagcaatgtcaactagtgaaaaagatgcaaaactcctgtataaaatattagcaaatcaaatctcataatacacgaaatggataagacattatagatatatatatatatatattcatgcactgtatacatttcagtcaatgatagaccatatatatgacagtgatttagtaaggttatagtactatattttcaccatggaatactacacagccataaagaagaataaaatcacgtcctctgcagcaacatggatgcagctgaaggccattatcctaagcgaatcaacgcagaaatagaaaaccaaacaccacaagttctcacatacacatgggagcaaaacatggggtgcacacggatataaagatgggaaaagcagaaactggggactacaagaacggggagggaatggacaagggttgaaaaattatcgattgggtactatgctcactacctgggtgacagggttcaattgtaccccaaacctcagcatcatgcaatatacccttgtaacaaatgtgcacacaccctccaaatctcaactaaaagttgaaaaaaattaccatatttttactgtatcttttctatgtttagatacacaaatacttagtgtgttataactgcctacggtattcagtaaagtaacctgttataatccaagagaaaaatgtcacagcattctgtggcgccatttacgtactgaagtttcatctaagaggtttatattttggccaatggaaatatcagcgaacaagaatagtcaccgaccaaaaggggcttgctgcccgatgaactagaagtcaatactataataccaggtgttgagaaaagaaaagctttttattgcaaggtgacccacaagaagacaggagtccagctcaaatctgtctccctatgctggctttaaggtagttattagaaaaggtttgggggcggattctgggattagtgggtgattggtggaaggaaatggggaggtctcccaagtccttaggcatgcatagttacctcttcatgctacctcacagatcatgtgtgaaaatccggggggagttagtataaaatatgtggtggaaatttgggctgtaacatcaccaagttagttctgtgcagacttgagttggccatattcattccaaccagttttagccagttttgtgttatcttacaagtggagagattttcagtgtttcagcaagttgcttcttttttaatctgtcatcctgaaaacaagattttctcttagtcatttgttcctttcactctttggggccacagttttcactaacattttggaagtaacaagttaaaggacatccctgaccctatttttgaacagttttttttaacccatatttctgcagcatttctgatggcaaatcaagagttatgattgcctaatgagtctgacttaacaatacaatagtcctcccttatccacagtttcactctctacagtttcagttacctgcggtcaatcatggtctgaactattaaatggaaaactccagaaacaaacaactcataagttttaaattgcacaccattctgagtagcatgataaaatctctcaacattctgtgccatcctgcccaggaggtgaatgtccttttgtccagcatatccacactatagatgctacttgcctgttagtcacttagtagctgaaccagttatcagatcaaaaatatatagtctatggctgggcgcatggtggctcacgcctgtaatcccagcagtttgggaggccaaggtgggcggatcacttgaggtcagaagtacaagaccagtctggccaacttggtgaaatcccgtttctactaaaatttaaaacaattagccaggagtggtggcacacgcctgtagtcccagctactccggaggttgaggcacaagaattgcttgaacccggtagacagaggttgcagtgaaccaagactgcacccctgcactcagcctgggtgacagagtgagactccatctcaaaaaaaaaaaaaagagctaaagctaattaaagataaagtaaaaaaaaattaaaaaatatatatatatatgtatatatagagagagtatatatagggttcaatattacccacagtttcaggtattcagtgggggtcttggaaaatatgccctgcagataaaaggggactactataatatgaaagattaggaatggattcccctttaaattttcttgtatgttccttctagaaataaaagaccaatcaaatgagaaaagtaaaatctacttggcccgagtttgctatagcaagggagtcagacaccctcacttgtgtattgacagagactcaaagccaggcagaggagtgggaaagctttacagtgagaaaaagggaaggcttcaggcgtttcctgattgggggctgctggcctggggaagctgtaggagggttcattagaaacgcggcaccctatttgattagtaggtggtgcatatttagctttctctggttcgtcctaagttggaagtgaagaaaaaaattaggggggctgtcggttattaatcaaattctgaccatttggggctgttacagcagttattgcatagctttgtgtattgtctctagagatagcaacctgacttcctataagtctgacataacaggctggtttcctggtctgtttattttagataaagggctggttttctgggcagactgctgtaaattttgagtcaaagttctatttttatttatggtctgaccattatctcttcgtatatttagtttctcaactttcacaggaaaaaacaaaacaatatattgttcaaaaacagactattttcacaataaaaagttattgcttttgtatcttaacacgacaatgtaagtatcatttcttttttttttttttaatcagttgagttttgtctatataaacaaattttcctactggggaggtggagacgtgtgggaagagacctcacatcaaaacctcctaacgatgtgactgccacttgaggaaaagtcacaatggtgctcctctgaaacagaatgttctgtgtggttggtgcagaattctctggggacacccctcccttgggttttgacatgtgaaccctcctcagtcaccactaggtacacaaagcgtccttgccaaaaatgcaagacagctctacaaaccttttgtttcaataaggaagaaatgtgtttcaaaagattcgacttgatagctaacccagaatttcttatgaaaggctagtttgtatcaaataaacaaatacaacttacacttgcaaatctaaatataagagtgtctttaaacaaatatgaagaacacttaactttttttttttctttttgagatggagtctcactctgtcacccaggttggagtgcagtgatgcaatctcagcttgctgcaacctctgcctcccaggctcaagtgattctcctgcctcagcctcctgggactacacacacccaccaccacacccggttaatttttgcatttttagtagagatggggttttaccatattggccaggctggtcttgaactcctgaccccaagtgatccacctgccttggcctcccaaagtgctggaattacaggcatgagccactgcacctgaacaagaacacttaactttaaaaggagaaacactgcttttttctaggaattaaaaatccagataagctttgcagaaataacattttggactgaattggtccacagaaagtacacagtccaggcctctgatataacagatgaggataccagggtatggggcttggaatatagaatgtgctcaaactagaactgacccatgactgaatggatgcttcaatattcccaaagttcacatggctaatagaaagagttttactaaatttcaacatgacagaactcaactgacagttttttgggcacgaagtaccaattatccaaaataaactcaatagtccacatgctcatgatctcccagtctaccgggtcaaacatccaaagagcaaatatacttataaagtaattattatatacaataataaattccaaatgaaaaatgacttggaaatactgcaataggagtatgtacgaagcacaacatgctgagaaggagcctgtaggttagccttctggggaagagaagggttagcctaagctcggtactgataactagggtctatcaattaaggcatattatgaggaaacctcagcactagtgaaacccgagagtaaaagccacttccactgcccccttccaggaacagaaaccgaaacataacatcagaaaatttccaatcaccaccccactcccaaatacacgtagagtgattattccagttctctgaactggggagggcgcatctttagcctagacgcccctctgggtgactaatgacaggtgagcacattgaacaaggtgactcctaagacaaggctgtatgtagccaacatcttgagagcaatctgaagttggagattttactacagccaaggagaaaacggagaaaaatacttgagaaatgtgttagctgtgttgttattcttaataaacggtaacgctggtcaacgacctgaacactgcagtgggcccaggtcaagcttgacaacatgtaaattttgccctctctgcccaatgcctctccagggctcccagccccaacgtctctctgattacagccccagtgagacccaccttcgcttcctctagagattgaatggcccctacatcctccaggccttcctgaagctcaaaaatgtccaaggtcccatccttgttatagtccaggtaccaaaagagatctccgtagagggagtccatcgaggatgtctccctcgcagctccgcggcctgagtgagccccagcggggtggaagtgcgaccgacgaacgggatctctgcccaccacacacgtccagtgggaagaggcctaagacagcatcctcctcaggggcgccaaacacaatgcaccttcatcggttaaagctctggaaggagagggctcatcctaacggcttcagcgcaaaggcgcgagcgcgcaggacccgggacctgcgtgggaccgcactctgggctgcgctgggagaccgcggagttcctgcctcactcacgtctgatcagaagccccggctcccactccaggaagagtccagtcggggcaactcaagcccctttccccagaaacttccagggagaacccagcacagggccatctgaaagtatagcttctcttttggagagaagtaggttgggaatgttgggacatgggctattgcagcataagtgactggcggtggcggcctgccaacatttaaaaaaaattgtttggctgcacctgtctaggaatccttctttttaaaaatccttataatgattttttaaaataaaataattttattgtagattcaggggttacaccatcagcttgttacaagggtatactgtgtgatactggggtttgagctcctaatcgtgccatcacccaggttgtgaacaaagtacccagtaggaagctttccagcccttgccctcctccctccctccccccttttggagtccctagtgtctattgttcccatctttatgccccatttacccaaggtttagctccccctgtaaatgagaacacagtatttgtttttctgtttctacaataattcgtttaagttattggcttccagctgcattcatattgctgcaaaggacatgattttgctccttttttatggctgcatagtattccatggtgtgtatgtaccacattttctttatccaatctgctgctgatgggtacctacattgtgttgtaggaatccttttctaaggttgcagcactggagaattgctgtaataaagactaggaattgaatgaaaatctgcccacatgggccctttcttctgtgacacctcccctcacagttttttatcttttatcttcatccaaccactacaatggctccagggcaagcctatccttcagctgttagtggctggattggaaagatgatctcaaaataggcaaaagttcagtgatcttgggtcccagagagaagtcagcagatactcataaatactatctaaggcttcctcttaatcctcaccctccagaaccacagagggccctggcttccccagaccaacacctgtgctccctcatcctgcaccactgggaatatggaggtgcagtttcacaataaaaactctccactttttatgtaatttattttcctaaatatggagattgggtaccctaaaaagttgaatattaaaattcaaaaagaaaatttaatttagccattatctgtaagctcttgctctacactacccatcatgtcagatactggggacaaaaacagaccatcacatgtccttgaaatactcataggtttccctctgggaggaggttgcaccatggttagtcaaaaaaactactgtacgcttctcagtaaacattttcccccagagctgctgagcagtggcaaatgtctaatgctgtttcacaagatgtgctgtggcccaatcaagaatgaattctttcaaaaagagaattttatggtccacagggaatggtccttccctgtgcaacacagaaaatgtaggtagtggcaaagagccacagaaggcagatagccaggcagagaatgagccttgggttagagtctacaggaccaagcagaaaagacagaagtcgtggccagggtgataaggaaaacaggctgacagcatttaacagaattgacaggagagaacaaaccatagagttgagagtttcatctaataaaaggcaggtagttttgttgaatagctctttctgctttttgaaattaccctgttcattatttgcttattattttttattccccatgcacctacacacacacacagacctacttactatagggagggttttgagaatacaatgaagaacgctgtcagtgttgttcaccactatatccccagttcattaaacaatgtctggcactgtttgaaaacattaaatgaatgaatttactatttatgctaagttactgggtaggtcttaccattcctagttaacatttgaggcctccaggcattaaataacatgcccaaggccacagtctagcaagcggtgaaaacatttgaaccctgttctgattccacagcctataataataactattacatccactaaaacagttaatgtgtagtaaacactatgatccacgtttcagagttaggcttcaaactttctcaacaaatccttttgttttcataaatcctgtcaaatatagataccttggtggactccattcaatccttaaaaagataagatttttgaactcagcagggtcaaaagaagttaagcagtgtattacagaatgttgtcttgtggaagcttcttttgttttttctggaataccgataaagaaagtgggctaggaagattataaaggtgagttggggccttaaacaatgggcaatcatataccaggcagagaagggggaatgagagaaatctcaggcagagagaagaaaataaagggatcaatgtacatggctgtggcctagtcagggaatatggcatgttgggagtttggaaaggtgacaaaaggcttagaatgctacaaagatagaaagggtattttataccttactaaagaattcttccatttttttcattctttcagacactttatttctgcagagaaggataacatcaaatttagaatataaatcaggagagaacacaaaagatacagattttatatattttagaacatttgacagaaatgtagttggaattccattgtttttcttataccataatctttctgttgtgatgccctaaaattcaccctgtgatttcatatcatgtcttcttaatattgtgccagaaaccataacatgtctgacaattaaaatattaaggaaatgggctggccatggtagctcatgcctgtaatcttagcactttcagaggcagaggcaggcagatcactagaggccaggaattcaagaccagcctgaccaaaatggcaaaatcccatctctactagaaaatacaaaagttaaccaggtgtggtggcatgtgcctgtaatctcagctgcttgggaggctgaggcacaagaatcgcttgaatccaggaagcagaggctgcagtgagccgagatcgcaccactgcactccagccttggtgatagagcaagattctgtctccagaaaaaaaaaaaaaaagcaatattaatgaaataaaaatgaaatgaaccctctttgttaacagaggaattacttaatggagtgaaatcctgattccactcaatgcaataaacatttgctaagctactattcttctatgtgactattttttctgtgattgtaaatgtaaaaacttaaagacagaattaaaaaaatcatagaatgtaagagttagaatggcccttaaatcaggttaccagtccacccactcctctaacattgggtgatcattcagcatacacttcatacccatgggcacagaggttcctcaagaagttcaccagctagtaaatgggataccacattttaaagggttttttaacatgaactttcatattctgcaacatatgaccttgttaaaagctctgtccaggatgcaggcaagatatctgcattttaagaataagaaagtaaagctccagtaaggctcaaacttgacaaggattacacggtcaatttacaccaaggacggaactctcttgtagcttgctgcttcccttcttgctcttgataattgtcctagtccaactgggctgctatgacaaaaatactattggcttacttaaaaaataagcattgatttcttgcagttccagacactggaagtcctagatcgaagtgctaggagatttactgtctagtgaggacccactttccggttccatggaccactgttttctcactgtgtcctcacatggtggaaggggcaaggaaggtcttccaggtcacttttatacaagcactaatcccattcatgaaggctccacaggaagaaagaagatgggggtagaaggaggaagacaagagggagaaggaggtgcgtaaagagaaaataactgaagacttttaaaaggaaataggattactagacaagtataagagaattagtaatggttaaatactgtatctccttgttctcacactacattctactctcagtctatacccttatactactgagtcctaggagaacttaatgtgaattttctctaatttttaactttaatttttcactaatttcatagtgaggagatttggaacatacagaaaagaaaggtcataccagaaaaaaaaatgtagcgctttcacttccaattggttcttaattttgtctcaggacttgccttgaattcttttctcttccctggataattctggaacacttagtaatggttagctattatattccttatacctatttctacattctactcttatttctacattctttccatctaaaatctaaagaaacttaaacagaaatttgttctcttctaaatgctcaattcattacaaatgcttggaaacacggagatgagatcaaatcagatgaaaatttatagagattttgcttcaagctgagtatttggcttagatacaaactactaccttgaaactttccaccgaagagtcaccccacagttctcatttctatgctcaagtagccaatgtcctcactccttgacattacataaacccctgacatgcctctgaaattttctcccataaaggttgactgtgtaatcctaattctatcccatgtgtgatggttaattttatgtatcaactcgtctggactaagggatgcccagataactggtaaaacatgatttctgggtgtgtctgtgaggatgtctctggaggagggtagcatttgaatcagtaaaccaattaaagaagactgccctcaccaaatgggtaggcataatgcaatcctgtggaggatgtgaatagaaccaaaaggcaaagcaagtgctacgttttgtttgtccccacaaaaactcatgttgaagtctgatccctgatgtggccgtgttgggaggagggacctagcaggaggtgtcagggttacggaggcagatccctcatgaatggcttggtgtcattcttgcagtagtgagtgagttctctctctcatgagactgaattagttccctcagtaatggatcagttccctcgaggctgggttgctataaagccaggacacccctcggattttgcttcttcacacatgtccacttccactttgactttccaccatgttgtgacacagcaggaaagccctccccaggagtccagcagatgccagcaccacgcttcttaaacttcccagcctgcggaactgtgagctaaataaatgtcttttctttataaattaccctgtctcagatattccactatagcaacactaaatggactaagacaggaaatgaaaaggaatttcacctgcagaataggagactttacaaagactgataccctgaatgagcgaggatgtggagaagcaagcactgtcagtcaaaagagtgaaaatgggtctaaggtttccgaaaggcaatacgtatcccagtttaaaatgtgtgttaccttcagactcagcaatgtccactcctcaaaatttatcttacgaaagtaactggaccagaatgagaaaatgaatacaaaggacatccattgcaatttcacttacaatcgtttttaaactatcaataaagtaaaaggtgatttaaaaagaattggtaacatatactatgacacaaacatataacagaatatgatgcagttacgtaaaaatggtgatacagcagcaattctcaagctttttgatctcaggatccctttacaatcttaaaaatcattgagcactccaaagagcttttgtatattgtagggaccatggagttgtaccactgagatctcccttcaaaggcacctactgtgaggaacacagttgacttccactctctagcctctaaccctggcatctgctgatgcactgcagcaaggtcgtccctttcctgggctgcttccagccaatgattggacatggtggggaactccaactgggccatttctgggacaatcagcacaaagtaccaaaagttggttccttcaaagtatgaataaaatacacaaaactttggcaagattgaaggggagaaaaggatagatatgaggaatgaaatagagaacctacctacagattcagtcagaagtgttataaaatcatcggtgagtattatgaaccttggacagaacaggcagtttcaaaaaaaattgtaacttactaaatctgactctagaagaaacagtaaactgaagaggcctataactaccaaagacattaaaagagaagtgaaatataactatataacagttgttggccctcatagtaacctaatcactttccctctttggataagagaatgccagtgtcagggaacgcttcaacagggttggagaagttccacatatctccaccctactaaaggggcagaagttcaggggcacagttaagatgactcagagaaaatgaaattgctcagtcgcaggtcaagtcaacccttcagatcaatttatgtacctagggcattaacctaggaatgtcttaaacaatggaatgccgccattccttctcaacaggaagtgggggaaacacgcgattggttttcaaacagttttcaaacagtagacaatacacatagctgctgtaacaaagcagcttcgaaagagatcgaatgtgtgcgcctttatacaaaacttgggacccactgaagtctgacagctaaaacggattacatgtctgcaaggtattaaaacagaaaacaaagaacctgggatggattcaggacaaaagtgtcttaaaaatttaacagtgcccgtgggccagagtgtccacaacactcattttatctggacaaataccagtagactttcgtattatgacccacttctgttaccggggtcgccggtcgcggccccacgcccgagtttctgaagccaccggagcgctgggcgccacagttcctccttcctctcctggcaacgcctcaagccgccgccctcctcggtcctcgcagtgtccccagcgcccgcagccctccctacgctcaggcggcgccccggcggcgacccacctcctcggcgtcctggcccagagggatgcccaggttcctgagcccctcctgcagctcgccgatgtccaccactccgtccccattgcggtccagtgcctggaagagggtctcgtagcgcgtcggctgctccgcgtcctggcaggccgcggtgggcagcacgaagtcccgcagccagcgcaacatggtcccagaggcgcaggcggcctggccgaggaagtcacgggagatcgagggctgcggggcgagaccgggaccagcgcgaggccgggctgggcggggcgcgcggcgcaacagcgtttggggcgccgtcggggttgcggctgcggcgcgcagggcgcagggcgcaggagcggagaccccacccgagcccgcgcggagcgcagggtgtggccgtcccgccgct

SEQ ID NO: 524 - DNA, 58089 bp, Homo sapiens
gtaggatacaatttttgctttatttataatttttttttttcaattaggaaactgagacttaagaattttctctaaaaaaaataaaaactggaaaacaagtaattttagaaacaaatatatatttttgatagaaactgtaagtaaatattcagtactaccagaaatatactatcttcaactctcggcttttttccaaaagatacagaatcattttttggaaaagatacaagatgtacagacaaatcacattcataccttacaatttaaattcataatgaacaatgaatattttcatattttccagaagtttgaaatttcaaagttgttagcaaaattattcatttccataatttttacgagtaaaaatagaaagagctgatcatgtaccttaatattgtcactttatatattactcaaaagtacaaataaccctaaaagtagaatcccaggcttatcatattataaaaatactgagacatttatcaaacataactaatataaatgaaactacatttttaaaaatgtttcacaaacaccagtccatctttctctttggttcagaaaataaaagaggtaggttcaaataaagaaaatgcctattacatcattagattttcattaaaatgctggaaatttataacagaaattattagaagtgaaatgagtttaagaactaaattaaaaactgataataacttcaactagtaaatatttttctaagttctaatcacacaaataagaaaagatagttgactataaaaatggctttagtaaaataaaaaaatgctctcattattataaattaagtctcctatatcctaacatgttcctaaaacttggggcaagagagaatatgaatgtatatgtttacaaattgggcctttcatttaaatataggtatctaatgtataagagtaatacatactactattaatatgtatctctcacctttgtgctgcccatattgaaaacagcaagttcaaagatattcaacagtgagggagaaataagcacatcatttgctcatgatcaatccacttcatgcaattaaaaaagaaatttcaggttactaagaatggtcccaagaagtcttcctgactaaaacggaatctgattcaaaaggtaggaaacaaaggacaaaggaaaacaaagatgctctgcagaagctgatacaagtcaaaggatttcgtttcctgctgcttttcaaagcaatggcaggataaacggaatctttcaaataaattgccttgtgttggtaatttaacagtaatatactgaaaattagtgtataactccaggaaccaaataatggtacagtggtaaaatggaaaagtgcccactgaaataaatataatttcatcacttcccttcagaaattccaccactgtgttcattcgtattcagctgaaagaaaaataaggacataaaccctatacttatttggatgcttttgctgtaaggtatattttaaatgtaatgattttctattaatggttctataaggaaatttaaagaaatctataaagacattcaaaatatataaaacaagaaatttaaatataaaggaactggcataaacgtaaaccacccgaaataaagattaatgatttataactctaacacacaaaacaaattttgttcaagccagtacattttcagatttcggattcagggcagagatttgcaggattattaagaaaagataaagtataattgtgtggccttttcaaaacacattaaaactatgattttgaacatttctgtgtacatataatttagcccaaaagtttgaagtgaccattgttaccatcttcccttttgtgaaaaaaatgcagcttcttttgccatagacttgtttcaattcgaggagaaaaagtcactccagagattgttgaaagtttcaattatcaggctaaagcaaaaaatgcaacatcatttctgggttactcctaaagtttgcttcatattttcataaaccacataactgatgcctacagcagggagcaccttcatgaagtttggggtgatgcctctgtaaagtcctggtattccttctttggaaataattcgtcgaaagaggccaaccatattcagctgtggggaaccttctaacatggctaaaaaataaaaaaagagggtaatttaatattcaagtatgtttcattattatgacaacaaacaattatgacccagaatgatattctaaaatacagtaaaaggacaacatttattccaagaagcccaagacaacatcccttttatgatcctctttgtatagcacctaacagtgagtgtcctaactatagtaatgatggtaataatagttatttattaattactatgttctaaatactgggttaattaccttccataccaatcttgcaaggtaaatgttatatcaattttgtaagtgagcaattggaggcttagaaagatggagaaatttgtcctaaaaaaatctaagtagaaaatggtagggctgagatccaatggtctgactctaaagctggtacactttccaccaccccacagtgctgctgctgcctccttcttactagacaagcgctgaagagagaacagttaaatctcaggaagtaaggggagtatggaagaagctctgggaagcttgggaaaaagcacaaagacctgggccttggaaatgacctcaacaagcaggaagagaaagcgaaaaccagtgttgctggcacaaccaagacaacgggaggagtaccatgtgctatggagatgcagccaattgttgtatgtggttattacacagagagtgaacaaagtggggctagattattaaaggctttgaaattcccactaacaactttggaactgacaccgaaaggctgcaaagatgtctgaacagatgtaaaatgatcagacttttaggtcagaaatgacagtctatcagccatagacaatctatcagccgtatcagtcatgcaaagttctggatcagagctggcagacaggagggttagaatcagactgcatgtgtctgaatttcagtcccactatttaccacaggtataatcttgtgggagttacttaaattctctctgccccagttgctcatctgaaaaatggggataatgttagtattcccatccccaagatggttatgatggtgaaatgagagaatacacaagaaacgtgtagttcactactttgtgtttttctctacagccatgactgtctctcagctccttaaatacaccatgttggtgcctgcctcagtgtcttcacacatgctttccctcaactggaatgttttctgttcccactccactggcctgtgcccagctaactcccactcatctttccagtctcagcttcactgacagcattctgcagcgcccaagttaggttatagctccttgctctgtgctcccctaacaaaagaggagttggtttaaccaggttgtttacttgctggacataacgtcttctctactctacactggcggggccacacctgacttgttgactgctctacccctagcatctggcagtgtctagaatgggacaatggctcagggagtatttgccaattagttactgactgcttggctggggttgctgtggctggcacttggaagggaggttgggaatagagctgtagatgcccaaggtgtactacttaagaaaacaatggataagactgaccagggaaagcatcaaagagaaaagaaaggcatttgaatgcatactttaatagagtggggatagcaataaaagccagcaaatggtaaaagttatcaatgggctggcagaacaaccaggatggtacagtgtaatcaaagccaacaatggagactgtcacagtgaggaggaatcacagctcaaaacttgtagggtctacgcaacactaaaaaatgattccaaccaccatttaccaaaaatttaacaaacccaagatgctttatttatattgttggtaattcttacaacactgtacaattttcattcccattaaaaaccccaagaagtctgaggcaaggatctgaacccaaatccatcagatactaaagcttataatcttaaaacgtgcatgtaacacagtcaaaaaaaatagtactctgtttatctataaggcatatgtatgcatacagtacatatgcaatgcttctgtcgcattaaaatttcatgacgagggagcatttagaaaaagaatttctgaaaagattccttaaggaggcaataatgaaaaaaaggttgagaaatactgtcttaaaactacagtctgcatcttagtagaacttggagttctaaaagcacattactggtgcagcacttttatcggtgtggttctgtaatcaaaaattcaccttgagcctgcatgcgagttctcaccaaagccaatgggtagctggccagctgaccacaggtgctggataaggcaccgcatcccagcaacaccatgactccagggtttacagaatcttttgcaaaattatccagccaataggacttcaagagctgccagagaaataaagaagaaaataattaacgaactctacaacttcaacgtaaacattttcacagctattctcaacctcatgagaagccccgtttctgcaggatgaggccacgcatttgcagaagcagcaggcactgcaggaggcggtgactctgtggagaggtgggaggccactgggggtgcggaacacatgaggtttgcaccggttactgacattcttctaaacaaacgtgaactgcgcagcaaacgctgcaggatctaaagaacacctcttatggtgagtattaataaaataatataattctactaattgtatctcattttacacgttacatatatttcatttgagccttacagaaactcttacataaatctattattctgattttagaaatgagaaaaattcatctcagcggagtttttgtttgtttttttgagatggagtctcgctcttgtcacccaggctgtagtgcagtggcccaatctctgcctcccaggttcaaacgattcttctgcctcagcctcctgagtagcttggattacaggcacccaccaccacgcccagctaatctttgtactgttagtagagacagggtttcaccatgctggcaaggctgatctcaaactcctgacctcaggtgatccgcccgcctcggcctcccaaagtgctgagattataggcatgagccaccacaccaggcccagagtttttttaagaaggactcagaaccaggcgtgctgatcaaaaggccatactttatccctgttactctaggtccctgtatttcattagaaggcaataattaggagaaactgtataaaatatatatgataatcaactttttaaacataagatactttaagtataaaatacatgttaatatgttatataacaagtttaactttttaattttttaatcctgtaagactaaaaattttaaatcctacaggattaaaaaattatctcaatggattaaaaaatccattgagtgcatttctcaatggaaatcttgcaggttagaaggaaatggaatgttatattctatgttttgaaacttaaaaaaactgccaaacaaaaatactgtatgggcaaaactgcccttcaaaaaaggagaaattaagactgtccctgacaaacaaaagctgatacagcttatcaccactagaccggccctacaagaaaggctaaaaggagaaacaaaaggatgataaatagcaacacaaaaccacaaaatatgaaactctatggtaaaggtcaatatttagaatattataaaatcctatagtattgtaatgaaggtatataaataacttgaaaatctaaatttcaaaaacaaaatttaaacagaatttaaagaagaaaagcataaaaagtaactataaatctatgttaaggatatacaatatcaaaagacataaagtttgtggggaggaggtgaaatatgtaaagaaatagagttttatataccactgaagttaagttgtaaacagcttaaaataagttgctataactttagtatgctttatgtagttgcaatggtaaccacaaaaatagcatctatagaatgcacacaaagggaaatgagaagggaatcagaacatatcactacaaaaaaaaaaaaaaatcaacaaaacacagaagaagccaggaagagaggaagggaaaaacagaaaagccacaggacaaagataaaaaggtagctagccaaatgacaacagtaagtccttccctatcagtaactgctttaaatgtaaatggattaaatcccctaattaaaagatataaattgctgagtgaataacacatacagaatcaactataccttatctatgagactcactttagatctaaggacacacataagctgaaagtgaaaggatggaaaaagatattccataaaaacgggaacccaaagagaaaaggggtggccataattacatcagacaaaatagactttaagacacaaactgtcacaagagacaaagatggacattacataatgataaatgggtcactttaccaggaagaaattataacttcatatggacctaatattaagctcctaaatatatgaagcaaacacttacagaactgaagggaggaataaacagcaacacagcaatagtagtagaccaccaccccacttaatggtgttggggaggacatggagaaattggaatcttggtgtacattgatagaaatgttaaaaaacaaaaaggtctagttactatggaaaatgacatggaggttcctcaaaaacttaaaaatagaattaccatttgacccagaaattccacttctgagtatatgtcaaaaagaactgaaaacagtatcttgaagagatatttgcacaaccatgttcactgcagcactattcacaatagtcaagatgtagaaacaatccaaatgtccatcaacagatgaataaagaaaatgtgatatatatacccaacaaattattattcagccttaaaaacaaaaaagtcctgttgtatgctatcatatggatgaatcatgaggaaactatgttacatgaaataagccagtcacggaaagagaaataccacatgatttcacttatacaaggtatttaatgtagtcaaactcataaaacgagaaagtaggttacacagcgctggggtgaaggggaaattgggagctgttgtttaatgactatagagtttaagttttgagaagtgaaaaagttctagagatctgttgcacaacaaaccacaaacagttaacacttactgtactatatatttaaaaatggttaaaatcataaactttatgttatgtgtttttaatcacaattttttaaaaaactcagcacaagaagtaaagtcctgaaccataccacctcacacctaagaggacggccataataaaaataagcttttttaaaatggaaattaagtgttaataaggacgtggaaaaactggaacctttgtatgttgctggtgagaatgtaagtgcagccactatggaaaacagtctgatagttcctaaaagctaaacacagaatgaccatatggctcagcaattccattctgagatatatacccaaaggaattgaaggcatagactcgaacagatacgcagatgccaatgttcactgcagcattattcacaatgttggaaaagtagaaataatccaaatgctcttcaacagatgaaggactaaacaaaatgtggtatatacacataacggaatattactcagccatgaaaagaaatgaagttctgatacatgctacaacatgaacaaaccttagagacattatgctaagagtaataaatcagacacaaaaagaaaaatactgtatgattctacttataagatatcttgaatgggtaaattcctagacatagaaagcagattagaggttaccaaaggtttgagttacggagggtaggaagttattgcttaaaggttaaggtgtttctgtttggagtgaggaaaaggatttggaaatagtgttgatggttgcacaatattgtgaatgtaattaatgccactgaattgtacacttaaaattagtaaaatggcaaattttatattttataataatttttaaaaattatgtaagaagccaaaaaccatttgcttgtacacttcaaatgagtgaaatgtaaggaatatgaactaaatctcaataaagctctttaaaaaaaaaattcgactcttcttttcattacacattccactcttcctctacgctgtagcttaggtctcatcctaacatgcaccctggctcatgtctgtcgcagcacagataaccacgctgagttttagtcgtttgtctcccccaccagaccttcagtttcttcaaggcacacattgagtcctttgaatccccagatccagtgtctaacctagtggtttgtatagtgtgtgctcaataattgtttgtgagattcataaattattaaatgatttagattgcagggttgatccaagatttgtattcttccgtacaaggaatgaaactgtattactcatgttagtcacattagtcacttggcttaatgtcagatttttgcaaatccaaaacaaaggaaaaaatctctagaaacaccttttaaggtgaacaactatacctaactttgagtctactcttcattaacaaaagcaattcccaagaaaatctaatacaaaagtgaccccatgcatattcacactcaagttacttgaaagttcaaataacacatgcttgaatttacttctggtcacacactgttttctggtatatatctacttcttcatataaagtccaattctaacaagatctaactgcattttccaattcaaaagatttctacaaactcacctcatacacagcaagatctatgcctgcataaggtatgatacctaataaattgggaacatagcctttgtaaaaagctcccaagccttcatgtttcaaaatcttcttggcacaatcatatattccagagtactgcccagttttgcctacagccagcctggttttcataacctggatataaaaaaaaacaaaatatgattgttcatattaactctatcatcatgggattcaaatgaagtaattttacatggaacaaatacctagcacatattgtcactcaaaagactgtacaatttgttgatacattctctttcatgtattacctctattggggggctaagaccaaagccagagagacccgtttactgcaaggaggatctgatgaaggaagtgaccaaggaaatggaagcaagataatctattgatgtcttaacaaaactgactggtgaccacctgcatctggaaggtgagggaaatggtagtataaaggataaccccaatacttctagcttggaacacaggatggggcagtggggagttgggaaggtgatactattaactgatatggaggatatgagaggaaaaataggtattaagtttttttgagaggtgtgtggagtaatataaacaatcatattaagatgcttaaaaaaagctgtattagcatgcataccacatatcggtgaaaattgtatttatcttgcttaagtcatcagttactaaaaacccctctgctatatcaataaattccacatctacaatattatttttgctataaagcagtagttggaaaacttttcctgtaaagactaaatagtaaaatatctgtcgttgcaagcctaaaatattaggtctcggttgtatattacttttcttttcttttgtttttgcctactttttaaaaattgtactttaagttctgggatacatgtgcagaacgtgcaggtttgttacataggtatacacgtgccatggtggtttgctgcacccatcaacctgtcacctacattaggtatttcttctaatgctattcctcccctagcccctcatccccaaaaaggccccagtgtgtgatgttcccctccctgtgtccatgtattctcattgttcaactccaacttatgagtgagaacatgtggtgtttggttttctgttcctgtgttaggttgctgagaatgatggcttccagcttcatccatgtccctacaaaggacatgaactcatccttgtttatggctgcatagtattccatggtgtatatgtgccatattttgtttatctagtctatcactgatgggcatttgggttggttccaagtctttgctattgtgaacagtgctgcaataaatatacgtgtgcatgtgtctttatagtagaaaaatctataatcctttgagtatataaccagtaatgggattgctgggtcaaacggtatttctggttctagatccttgaggaattgccacactgtcttccacaatgcttgaactaatttacactcccaccaacagtgtaaaagcattcctatttctccacatatttgccagcatctgttgtttcctgactttttaactaactggcgtgagatggtatgccattgtggttttgatttgcatttctctaacaaccagggatgatgagccttttctcacgtttgttggctgcataaatgtcttcttatgagaagtgtctgttcatatccgtcacccactttttggtgggtttttttttcttgtaaatttgcttaagttccttatagattctggatattagccctttgtcagatggatagattgcaaaatttttctcccattctgtaggttgccggttcactctgatgatagtttcttttgctgtgcagaagatctttagtttaattagatcccatttgtcaattttggcttttgttgccattgcttttgtgattcagtcatgaagtctttgtccatgcctgtgtcctgaatggtattgcctcggtttttttctagggattttatagtttaagtctatgtttaagactttaatctatcttgagttaattttttttttataaggtgtaaggaaggggtccagtttcagttttctgcatatggctagccagttttcccaacaccatacattaaataaggaatcctttccccattgcttgtttttgtcaaagatcagatggttgtagacgtgtggtgttatttctgaggcctctgttctgttccattggtctatatatctgtttggtaccagtaccatgctgttttggttactgtagccttgtagtatgtttgaagtcaggtagcgtgatgcctccagcttcgttcattttgcttaggattgtcttggctatacaggctcttttttagtttcatatgaaatttaaggtagttttttctatttctgtgaagaaattcaatgttagcttgatggggatatcattgaatctataaattactttgggcagtatggccactgattcttcctatgatatgatattgattcttcctatccatgagcatgaaatgtttttccatttgtttgtgtcctctcttatttccttgaggagtggtttgtagttctccttgaacaggtccttcacatcccttgtaagttgtattccgaggtattttattctctttgtagcaattgtggatgggagttcactcgtgatttggctctctgtttgtgtattattggttaataggaatgctagtgatttttgcacattgattttgtaccctgagactttgctttaagttgcttatcagcttaaggagatttggggctgagacaaggaggttttctaaatatacaatcatgtcaactgcaaacagagacaatttgacttcctcttttcctatctgaatacgctttatttctttctcctgcctgattgccttggccagaacttccaatactacgttgaataggagtgctgacagaggacatccttgtcttgtgccggttttcaaagggaatgcttccagcttttgcccattcagtatgatattggctgtgggtttgtcataaacagctcttattattttgttatacattccatcaataactagtttagtgagagtttttaacatgaagtggtgttgaattttatcgaaggccttttctgcatctattgagataatcatgcggtttttgtcactggttctgtttattgatgaattccgttatattgatttgcatatgttgaacagccttgcatcccagggatgaagccaacttgatcatggtggataaacttttggatgtcctgctgcattcagtttgccagtattttattgaggattttcacattgatgttcatcagggatattggcctgaaattttctattttggttgtgtctctgccaggttttagtatcagaatgatgctgccctcataaaatgagttagggaggaatctctctttttctattgtttgaataatttcagaaggaatggcatcagctcctctttgtacctctggtagaattcggctatgaatctgtctggtcctgggttttttttggttggtaggctattaattactgcctcaatttcagaacatgttattggtctatacagggattcagcttcttcctgatttagtcttgggagcgtgtatgtgtccaggaatttatccatttcttctagattttctagtttatttgcatagaggtgtttatagtattccctgatggtagtttgcatttctgtgggattggtggtgatatcccctttatcattttttattgtgtctatttgattctcctctgttttcttctttattattctggctagttgtctattttgttaaacttttcataaaaacagctcctggattcaatgatttttggaagggtttttcgtgtctctatctccttcagttctgctctgaccttagctacttcttgtcttccgctatcttttgaatttgtttgctcttgcttctctagttcttttaattgtgatcttagggtgtcgattttagatctttctcactttttcctgtgttgcccactttttaaaaatgtaaaaggcattcttaggtcaagggctgtatgaaacagtccgtaggtctgtgttttgccaacctatgcactaatgaaaggatgtctaattaggataatcaccatataatcaaatcctgagattccattattaaatttatggtacagaaactctttggacaggaatggcagccagcctctaaagtggcagccagcctctaaagtgacccccagtgatatttgtctccggttattaacaccattataccagcccctcctacactctaccagggttggtctgtgtgatcaatggaatacagcagaagaggcaaaagataccagctttcatcttaggcactctctctctctctctctgttggaccactgactctagggaagccagctactgtgttttgaggatactcaggcagcctacagaaaggctcacgtgataaggaactgatgtttccagccaatagccagtgaggcctggcagcaacatgagtgagcttggaatccgcctccagctgattccaagctctgactaccatcttgactgtgggctgtgaaaaaccctgagccagaggcacccagctaagctgcttccagattcctgacccagagaaactgtgcgatgataaatgcttgttttaaactgttaattttgggataacttgttagagagcaatagacaaccaacacgaacaccatcacacagtcagacttgacaatggtactcacctccattggatatataaaagtctgtgcagttgctccagccatggaaccagaaataaatctctcaaatgttcctattttttgtccttcttcagtaagtaacttcttgtactgtataaacaagttttaaaatgcacattactacctgctgtggactgagctgcacccccaccaaattcatatgttgaagctgtaacctcccatgtgatggtattaggagatgaggcttctggaggtaattagggttatgaggtcatgaggatggagccctcatgacaggatcagtgttcttgtaagagcagacaccagagagcccactctctctctcccccttcacatgtgcaccaagaaaagaccatgtgagcacataccagctgtctacaagctgagaagagaacgctcactagaaatcaaactggcttggcccttgatcttaggctttcccgcctctgaaactgttagaaataaatttccgttgttgattccacacacactgtggtattttatggcagcccaagccaactagacaatcctagaatacaaatcagctcctagaaatcaataaattgacaaatgtgatgatgtgtctcgaaatgtatacactacattaataatacatagcagaagagcaaggcctaaatgctaatacacgcagtgactggacagtggttttcaagtcagatttccacaaaacacagatgtctcccagattggaccaagttgctcctttgctgaaacagcataacagcatccctccccaggtgtacagaaaatacaaggttaatcaagttttcacaatgtttggatattttccccacagtttttaaaagatgagtttattttcaccagtgcaaataaaatgaataaataggtgacaaacaaatattaacaaaacaatttataaaaacagtttctgtaggtaatacatagaattatactaacctatcaagcccagcatctccctggctatcagtactaaagtgacccaacatagctaactggaccaagggtataaatatgaccccaatacagccaaaatagtgactggccagtatattaatatcatgggattgagagtcaggcagacctgagctggaactccagagccacgtggcctcgagcaagttcatgaacaggtccacattgtggtttccttgtctgtgataacagtacttacctcacagggttatggaaaggattacaaaaaaataatacttgtaacacggttagtgcaggtctgaacacctagcaaatgttcagtagatgttattattattattaatatatgaatacactatctttacacaacttgctaagacattctgcccaaacatagaccatgggaattagccaggcaagccagattccttctctcagaaatgtgagggggtctccagaggtaagcagctgctgtcaccagagggacaaggggaaagtcaacagagagaagtggactcatgcatggagaagggaagggggaagtctcacctcctggacttctccagggatccttcccctacatgatccatccccacagtgatgcccattcctgtgccagccagtttctgttccctgggatctaaagtgcccaatgcaacaacatacgatgactttctcctagcaaatctgtgttttgctgctcatgataaaaattaagtatattatcatttcatgagattcccaaataccagacattcctccccagagagatcactgcttccaagggctctgtttcctgaactacagagtgttacataaaactcctcttctgcataggccctattaattttcctgcatgtcagattgtcaaaatcattaaacataatttgcttaaaaaccttcctgcactttaacagtaactttgaaggtaccttttataccttggacccccacagcacctatcaaaagtacagagtaaacgtttagtgactgatggaggataaatatttaaaggataagtgcttgaggctcctattccccgaaacataccatatacaaagggaagacttcaggacagagccaaaaagtcaggcactgtgcctggtatgtaaaactatgtcaccaagcttagtccccatcttagagatgaggtaatagtcacagagactttaagtaacttgccaaggctacagaactgaaccttcctaaaggagacttaactgagccctcaaaaccaccctgaaatccttttgtctatctcagttctctcccatttgttagactaaccattttgatcttctccattctcctccagcttccaataccacttcctccctcattctcagatcacatcctttctcaggagctcaaggaagagtagagaggccaccaggcagaatatcttggtattctgcccacctcctgcaaaattatccatagctactcacatattttttcttcccaaacacgtataagaagagttcttcttgtaatcaaagactaatccttttaacagtctctggatagaacctgtctcccccagcccctttccatctcccactccctttccctacacacaaactcccttgaaacacctaccgggttaatcaacctctcttacctatgttttcaacttctttatttgtattgacatgcttccttcagcaacaggcacattaaagtcaaatcaaaatcctccctccaggccaggcacggtggctcactcctgcaatcccagcatttcgggaggctgaggcaggaggaccacttgaggtcaggagtttgaaaccagcctggccaatacggtgaaacctcacctctactaaaaatacaaaaattagctgggtgttgtggtgcactcctgtaatcctaactactcaggaggttgaggcagaagaatcacttgaacctaggaggcagaggttgcagtgagatgagattgcaccactttactccagcctgggtgataaagtgagactccatctcaaaaacaaacaaacatacaaacagaaaaaaaacaaaaaaacaaaaaaacaaatcccctccacccaacatctttcttatctatcaccctctccctcttctagtttccttctcttcactgtcaaactccctaaaaatgtgtctctactgtccaagtttcttcacctcccattcactttaagctcatttcagcatggtttctcatttcattacttcacagaagcatttatactaagcttacctatctctgggttgagaaatcctaaaagatattcttattatattcactacccagtagtactgacccccatgaaaccgtttccttccactgactcctatgccatccctctctctggattttctcccatccctcgagctatttcttctcagtgtcctttgcaagtttcttcttttacttctccctttggacttattcctagaattcttctcatttataagctcttcttgagtgatcctgcccattccaatggctcaactcagcaacaacctctctatcaaagatctctctcttaatggctagctgatatacccaattgcttactggacagctccctgtacatgtcccacacatctcaaactcagcatgcacaaaatggaacctgatattgtattctctttgaatgcagtcactcaagttagaaattagaatatcattcttgactcttctctttctcacctccatatccagtcagtcagtgagttctgttgattctacttccaaaatatttctcagttcattcccttctccattccttaaagacatcaccttatactggtgttcatcatttcttacctcaattatttaaatattctccctgcctctagtctacctcactctcccccaacaatgtctccactcttttttcaggttgatattccttaaatgtgaatgtactcatttcacttccctatataagatgctacaatagcccctaccatattcagaataaaatccagactcctattacatttggcccctgtttatctgtccagctctttcatcattatctttccggaaacacactccaccagtcttgaggcacagtgaaccaccttcagtctcttcagtgagtgatgccttcttgtgcctacatttctgtccacatgctgctccttctgtttccaatccttatcttcccctttatttatttatttattttttttttgagacaaggtctcattctatcacccaggctagattgcaatggtgtgatcccagctcactgcaacctctgcctctcgagctcaagtgatcctcccacctcagcatcctgagtacaggcacacacccccacgcccaactaatttttatattttttgtagaaatggggttttgccacgttgcccaggctggtcttgaactcctgggctcaagcaaactacctcctaaagtgctgggattagaggcgtgagccaccacgcccggctccccttcatcttaatggcttgagattgaggcaagcttgagctctaattccagtctgtcagttctgtcttttcatttacttaataagggtttcctggcactgggcaaggtgctaagaatacaagtagctactgcctaaggaagctcacagtctcacaaagcagataagtacagagaacgtcagaattcaatgtgaaagtgctgtaacaaaaggaaactagaacagaaggcttcccagaggaactaactcctgagtaagtactaaagggcatttcccaccatatgacatatagaaagaggaagggtgtctgtctgtgttgctggagcagggtcaggagacagggagtagcagaaagatgaccatgcatggtggccatattgagtgggaggcactcctgggtcatgcaagcagagatgctgaaacacacagtacacaggtagacctacagtgttgagataaagaggaagatgttggagtggaaagcagtcagtacagagatggcagctgaaaccacaagaacactaccccacactattacactgtcaatgatacaatgacactactatggtaatgacaacccacagagaacacaggtttaccccatactgatgatgtgtttgacagagctacataccaggttgaaaagatctttttcttagtttcctaaagtactagctattcaaggaacaaaatctatctgaatctaaaagtgacctagttacatactctgggaaatttgagaatatatacagcctatttaccccgaagtaatttacaatccactgggaaaacaatgggttttccatcatccaatgaaaaatgggatattctgcaattcagcactcgagggaggctggacaggggaggaactggctttgattgagatgcttagtatatgcttgtcacaggaaggtggcttttagagagccccgagggatgaatggaccttcagcaggaggagagaaaacagcaccataggtccagagcccataagaacactacaccacactgtgtagacagctttctcttcatgtctaagaaagttagtgtgcagaaatcacaatactataaagaggtctcaggaaggagcttgggtggacagaagcagaggatgcctgttggtggtatccaaggtaagaatctgacaaatggcataaagcaaaatgtgcatatttgcttgcaatacccatggactttttcaaaaataccaaacttcttgcatactgaaataactgcattgagtatttatttattttaggctgtggctttcctatcataaaatccaagtatgtggtcagaataacctaagggtatctcaaacattagcccttaataatcatgatttgaatcttcaaaccttcatataaggaaaatagccttcccaaggataggttctaattaaaatcctggagactagattttctttaattttttttttttttttgcttctctatttcctaggcaaagaaaaggataccactggacttcgtaaacttctcaagagtattctcttgctcaagaacaaaacactctccagaataatctaaaatctacatggaataatacaaaaactatggggggggagttgaatttcaaggcccttacagtccttgataaacaatgatggaataaataatggaaaacataatctgtggctgctcaactagacagttctgctaatgaccataaagagaacccaaactctaaaacttacctctgtatttcccctttacattgagttaggctgaagcaatagctcaaataatccaagttaacaaaagccgacagagaagtgattcagaggtaaatgcatttgttcattcattgactcattcaacactcgcttgaaacttatcacatgccaagctctgtctaggtgctggagtacatggggaagaagccacgcccctgccttcatggaggtgtcactccaaactcagctcaattttacagcaacgtcaaattacacaaaggacttcaacttatagttttccttccagaggttagattgtgacactttcataaaacttatgttagtgtgctgcttctgctcaggattcagaatgaataaactaaaattctacccttcctttaagaactacttagaaaaaaaaaactttataaataatatgatgaattaagaatcccataacttggtcatgagaaatctctgattttatttagtctaatctcctataagtgatcctccttatggagtatatgtgaaagattatcatgtattaaaacaagaatcccaaaagcattatacattaacatttattgaatccgtttactaactcctctttgttaataaattccacgggtgataacaattacctgttcatatgcccagaatttaacagctgtctcaggagcaattttgatgacgtttgtaccatttcccctccaaagcgagcggatacctccttcttttaccatctgtcgaaagccaccaaatatgttcattttgtctgattttgaaccgtgaacctaaaaataaaagcagaatgatataaaatgctggtggcatattactattactttttctagaacaaccacacaatctttttcaataccctttctaactgcaagaagatatatttgaaaataaaatatagaaaggttgaaaaatatatataatgatgagagggagtattgccatgattttagaggcctgtctctgactctaaaactaagaataattggtatcttcagtgtgagaaagcagagagagaagacaagaagagtattaaaattatgaacaaccttcataagataatattaactaaattatgtatcaggcaatggaacaccctttgaaacatgaacaggctcagttaaagggaaataaaaaagtatactgcagataataatattatattattacatataatttaatgtatgtatattattacatataatttaaagtaatatgttactccctctcctcaagaagtagtacagacatgaactgtaaatgggtctgaaatggtttggatattgtgtatatcagggctaccaacactggaatgcatacagcctgaaaccaaaaataaaaattgcaccctctttggcatattttgaggccctctctaggcaataaattcattacaacatgtacccatcctgtgagtactgataaattacttggcttatactacagatgtggtagtcacttaaaaatactgtaccttatgaccacctacagataaaaactgattaagtccaatacaccaaaaataattaaacaaatcagctattcttctgattgtttcagctcacataaaaggggtgactaccactaaacacacacacacacacacacacacacacacacactcacagaacgggttgaattctgaaggccagccatgtggccagtatgaaaacgggccccaataagaactctgcacaccaaaggctcaggtgagcttccctggttggtctgcaatattccatgcctagtgccacataacagtgccaggaaagtaagacatggagactccacagggagaggacaacagaagctctgccctatgtgcttctttacttgactgattttcatccgcatcttttccccgtaataaaccataaccaggggtaataagctttcagtgagttatgtgagtctttctagagaagtatcaaacctgaaggttgactttggaaactcctcaaatttgcagaaactaaattccagagaaatccattttattttaaataaataaacttcacaataaaataggacaaaggaaaaaataaatgcttattcaagttctctaaaagtcaagttactactgttcctaaagaaaaacacacaccaatcccctctcctttttctttaaagcattagctttgcccctaaataaattttgagatttgggtacattctgaaggaatgctggcttaaaacagtgtcagaatctttttgtacagaaatctacagacaaatataaaaagtgttgaccataagtataacaaagttttaaaaatattttgtaaacaactactatgttccaataggttattccagtgtaccagacattatcacatacctgatattgcttgattcttaaaccattcttattagatattcttatccccatcccagaatgaaggaaaatgagacctcagaggtttcatgcagcatgagaaccaggagcactggaggcaaagatactgcattccccctctcatttgttgtaaaggaaaagtcaattctctgggcctcagattccccctggaaaaatgataaaatacctacttcactgggctgctgcaaggattaactgggttaccacagtgagcaaatacatattaattcttttccattccctctttccactctggccagcccaatgctacactgctagtaaatagcaaagtcagtctataaagccagatctttttctgctaacctcagctttagaataattttcaaaattacattgctgctctaagattctagatttcaaaaatactttacttttgataaagtatattaaaaagaaggaaactataaatcaggagaatcctacaacaatagctagagatattttttgaattaaatgtttgaatagtcatagaatgccaaagattaaaagttcattacacacatgtactaacaatttaaggtttggtacactgccatacttacatggactgaatttagagttaacagcaacaaaatagatttattttttagggtataaaagattattactgagaaattttaaaacttctttttcaaagcaccacatttctcattgttttagaatatttagggcaaacctggacacacgataataaagctcacctgcatcatgattttcagacggtccaaaggggcagtgcttgttcgagagacagcaccagcaatgcctcctgccaaaagctgcctccaccattgtccggattttttttcgtcttccgtgaattcatctggaatagttaagctatcccctatgtcaattccctgtaaaaatgaaaaaaagatccccatgcgccttagttaaaaataatcccagaagacgttttgttttagagaagaatcatgttattttacagttaatatgaacttcattccctagaatttatactaaaccaatttgagtacatagattataagttgtctactcacaatgaacaaagtacagtatcagttcacaagaaatgaaaataaacagtaattacaaatatacaaaaccaacagttacaactttctttcattcatcatagattcacagtatgttttctcttggtctaggttaaaatgaaagggcagcattttatcatagtcaatcttttttattgcaaccatttttcataaggctagaaaaccaactggtgatgacatcttttaagaaattcgttcatcaattcttaaacaatacttcctttatctcaaatttatatccacatcatatttataccatgatatgttttaaatatgtaaataaaaattaaaactgtatgtgaatacccctaaactcatttcctactgtttataaaaatatttttataaatctgacttatcatttaaaacatgcaatagattctatataaaatttagctaatggagaggtattgtttcaaatcatcaccccttcaacctattctacattactatagtttgagagaaacaattctataataatatttttacaattctattatctaaattgttttggcagaaaaatttttacaggcaagagtgcaacggggaggagctctcctatggtagtaaccctcccttccttcattttactatcaataaaatggagatacaattgtagtctcaactgttatcaactaccttaaaaaataccgtaagaattatgtaaataaaacttcacatagtgtacaatttatctaggcaactgaactactagtataatattatcttatactcatagctgagaaggcactaatcaccaacaattttataatgctttatgtaagcttaggcattgttactagtggcaatgtgaactcctgacttcatttaatgcatatttaatttagtcaaatctgaagtgtagaagacaagcccataaagaaaaaaaaaaaaaaaaaggccgggcacagtggctcacgcctgtaatcccagcactttgggaggcgaggcgggcggattacaaggtcaggagatcgagaccatcctggctaacacggtgaaaccccgtctctactaaaaatacaaaaaaaattagccaggcgcagtggtgggtgcctgtagtcccagctactccggtggctgaggcaggagaatggcgtgaaccccggaggccgagtttgcagagagccgagatcgcaccactgcactctagcctgggcaacagagcaagactccgtctcaaaaaaacaaaacaaaaacaaaaacaaaaacaaaaaataaataaaactccttcagagagttcctaagggtttcaggagcagattgcacaataatagaacttggtttacatcagtatgcagaatattaatgaaacaatcaaaatttgaaagtttggtggaaaacaaactggtatgaaatgctaagcagatgaagcaaaaagattctgtaacctttaatgaatattgttaagtgccttatgccagagataaacataatctgaccaaacaaggacacagatccttagcaaccatgaggtgctgagattatttggacaatatagtacctataaaaagtaaaagcctacaacttttacacttccctatggcagaatacttaaatgccaataaaagctagacagcttattcatcaaggtggtacttcttccaagttttcagaatggacatttatgcagtcttgggttgtttttttttttttttttttaattgatcattcttgggtgtttctcgcagagggggatttggcagggtcacaggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcctgctgccttcaagcatctgtttagcaaagcacatcttgcaccgcccttaatccatttaaccctgagtggacacagcacatgtttcagagagcacagggttgggggtaaggtcatagatcaacaggatcccaaggcagaagaatttttcttagtacagaacaaaatgaaaagtctcccatgtctacctctttctacacagacacagcaaccatccgatttctcaatcttttccccacctttcccctttttctattccacaaaaccgccattgtcatcatggcccgttctcaatgagctgttgggtacacctcccagatggggtggtggccgggcagaggggctcctcacttccctgtaggggcggccgggcagaggcacccctcacctcccggatggggtggctggccgggcggggggctgacccctccacctccctcccggacagggtggctgccgggcggagacgctcctcacttcccagacggggcggctgccgggcggagggtctcctcacttctcagacggggcggccgagcagaggcgctcctcacatcccagacggggcggcggggcagaggcgctccccacatctcagacgatgggcggccgggcagagacgctcctcacttcctagatgggatggcggccgggaagaggcgctcctcactttccagactgggcagccaggcagaggggctcctcacatcccagacgatgggcggccgggcagagacgctcacttcctagacaggatggcggccgggcagagacactcctcactttccagactgggcagccaggcagaggggctcctcatatcccagacgatgggcggccaggcagagacgctcctcacttcccagacggggtggcggctgggcagaggctgcaatcttggcactttgggaggccaaggcaggcggctgggaggtggaggttgtagcgagccgagatcatgccactgcaccccagcctgggcaccattgagcactgagtgaacgagactccgtctgcaatcccagcacctcgggaggccgaggctggtggatcactcgcggtcaggagctggagaccagcccggccaacatagcgaaaccccgtctccaccaaaaaaatacgaaaaacagtcaggcgtggcggtgcgcgcctgcaatcgcaggcactcggcaggctgaggcaggagaatcaggcagggaggttgcagtgagccgagatggcagcagtacagtccagctttggctcggcatcagagggagaccgtggaaagagagggagagggagaccgtggggagggggagagagagggagagggagagggagagctgtttttttttgtttaatactctataaatctatgcctaatagaataaatagaactctacaggttaaggagctactgggactcaggtatcctggcccataagtgttacagagtgttcttgggtgataactgtacctatggtttatagctccaaataagtataaatacataaagtagacttactgtagaatgtttccagaaacggataatttcctcaatgtctgtaacaggattaaataagaagtagtctctccattcattccagtccactgtcattgtcccatcaacatcaatgctgaaattttaaaaaaatgatcaaagtacaaaactaaattgataaataaaactaacattattggccactttacagaatgacagtttcttttctaacataatattctcattaaattaaaaaaccccatccacaaatataggttgttggaaatggcagcaagcattttatggtcctgtcagatagttttaattatctagataaaaatgggcccaaaaattacagccagctcactaaagaatactttcagcactctgtcaaactctgccaatgagctacaaaacacaaaaacttgaagataaaatattaaacgatggtaatgaatagattcattatccatttttttcatgcacttagtggatcatgaagataattcttaatgttctattgcaacatttgaatgtagttttgaaatatactcaaaacatgctatcaacttcctcgaagttaggaaaattaacagctattataaaaaatcaaactgtcagtgactgtgcctttgagtcttttttttttattattatactttaagttttagggtacatgtgcacaatgtgcaggttagttacatatgtatacatgtgccttgctggtgcgctgcacccactaactcgtcatctagcattaggtatatctcccaatgccatccctccccctccccccaccccacaacagtccccagagtgtgatgttccccttcctgtgtccatgtgttctcactgttcaattcccacctatgagtgagaatatgcggtgtttggttttttgttcttgtgatagtttactgagaatgatgatttccaatttcatccatgtccctacaaaagacatgaactcatcttttatggctgcatagtattccatggtgtaaatgtgccacattttcttaatccagtctatcattgttggacatttggcttggttccaagtctttgctattgtgaatagtgccacaataaacatacatgtgcatgtgtctttatagcagcatgatttatagtcctttgggtatatacccagtaatgggatggctgggtcaaatgatatttctagttctagatccctgaggaattgccacactgacttccacaagggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttctttcgagaagtgtctgttcatgtccttcacccactttttgatagggttgtttgtttttttcttgtaaatttgtttgagttcattgtagattctggatattagccctttgtcagatgagtaggttgcaaaaattttctcccattttggaggttgcctgttcactctgatagtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctaggggttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattggtctatatctctgttttggtaccagtaccatgctggtttggttactgtagccttgtagtatagtttgaagtcaggtagcatgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattgccttgggcagtatggccattttcacgatactgattcttcctacccatgagcatggaatgttcttccatttgtttgtatcctcttttatttcattaagcagtggtttgcagttctccttgaagaggtccttcacatcccttgtaagttggattcctaggtattttattctctttgtagcaattgtgaacgggagttcactcatgatttggctctctgtctgttgctggtgtataagaatgcttgtgatttttgtacattgattttgtatcctgagactttgctgaagttgcttatcagcttaaggagattttgggctgagacaatggggttttctatatatacaatcatgtcgtctgcaaacagggacaatttgacttcctcttttcctaattgaataccctttatttccttctcctgcctaactgccctggccagaacttccaacactatgtcgaataggagtggtgagagagggcatccctgtcttgtgccagttttcaaagggaatgcttccagtttttacccagtcagtatgatattggctgtgggtttgtcatagatagctgttattattttgagatacatcccatcaatacctaatttattgaaagtttttagcatgaagtgttgttgaattttgtcaaaggctttttctgcatctattgagataatcatgtggtttttgtctttggttctgtttatatgctggattacatttactgatttgcgtatattgaaccagccttgcatcccagggatgaagcccacttgatcatggtggataagctttttgatgtgctgctggattcagtttgccagtattttattgaggatttttgcatcaatgttcatcaaggatattggtctaaaattctctttttttgttgtgtctctgcctggctttggtatcaggatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagatcctgttattggtctattcagaaattcaacttcttcctggtttagtcttgggagggtgtatgtgtcgaggaatttatccatttcttctagattttctagtttatttgcatagaggtgtttgtagtattctctgatggtagtttgtatttctgtgggattggtggtgatatcccctttatcattttttattgtgtctatttgattcttctctctttttttctttattagtcttgctagcggtctatcaattttgttgatcctttcaaaaacaaccagctcctggattcattaattttttgaagggttttttgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagagcgtctttatttctgccttcatttcgttatgtacccagtagtcattcaggagcaggttgttcagtttccatgtagttgagtggttttgagtgaaattcttaatcctgagttctagtttgattgcactgtggtctgagagatagtttgctataatttctgttcttttacatttggtgaggagtgctttacttccaagtatgtggtcaattttggaatagccgtggtgtggtgctgaaaaaaatgtatattctgttgatttggggtgcagagttctgtagatgtgtattaggtctgcttggtgcagagctgagttcaattcctgggtatccttgttgactttctgtctcattggtctgtctaatgttgacagtggggtgtgaaagtctcccattattaatgtgtgggagtttaagtctctttgtaggtcactcaggacttgctttatgaatctgggtgctcctgtattgggtgcatatatatttaggatagttagctcttcttgttgaattgatccctttaccattatgtaatggccttctttgtctcttctgatctttgttggtttaaagtctgttttatcagagactaggattgcaacccctgtctttttttgttttccatttgcttggtagatcttcctccatccttttattttgagtctatgtgtgtctctacatgtgagatgggtttccttaatacagcacactgatgggtcttgactctgtatccaatttgccagtctgtgtcttttaattggagcatttagtccatttacatttaaagttaatattgttatgtgtgaatttgatcctgtcattatgatgttagctggttattttgctcgtttgttaatgcagtttcttcctagtctcgacggtctttacattttggcatgattttgcagcggctggtactgattgttcctttccatgttaagcacttccttcaggaactcttttagggcaggcctggtggtgacaaaatctctcagcatttgcttgtctgtaaaggattttatttctccttcacttatgaagcttagtttggctggatatgaaattctgggttgaaaattcttttctttaagaatgttgaatattggcccccactctcttctggtttgtagagtttctgccaagagatccgctgttagtctgatgggcttccatttgagggtaacccgacctttctctctggctgcccttaacattttttccttcatttcaactttggtgaatctgacaattatgtgtcttggagttgctcttctcaaggagtatctttgtggcgttctctgtatttcctgaatctgaatgttggcctgccttgctagattggggaagttctcctggataatatcctgcagagtgttttccaacttggttccattctccccgtcactttcaggtacaccaatcagacatagatttggtcttttcacatagtcccatatttcttggaggctttgctcgtttctttttattcttttttctctaaacttcccttctcgcttcatttcattcatttcatcttccatcgctgataccctttcttccagttgatcgcatcagctcctgaggcttctgcattcttcatgtagttctcgagccttggttttcagctccatcagctcctttaagcacttctctgtattggttattctagttatacattcttctacatttttttcaaagttttcaacttctttgcctttggtttgaatgtcctcccatagctcagagtaatttgatcgtctgaagccttctctcagctcgtcagagtcattctccatccagctttgttccgttgctggtgaggaacagcgttcctttggaggaggagaggcactctgctttttagagtttccagtttttctgctctgttttttccccatctttgtggttttatctacttttggtctttgatgatggtgatgtacagatgggtttttggtgtggatgtcctttctgtttgttagttttccttctaacagacaggaccctcagctgcaggtctgttggagtaaccggctgtgtgaggtgtcagtgtgcccctgctggggggtgcctcccagttaggctgctcgggcgtcaggggtcagggacccacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagtttgagcttcccggctgctttgtttacctaagcaagcctgggcaatggcgggtgcccctcccccagcctcgctgccgccttgcagtttgatctcagactgctgtgctagcaatcagcgagactccgtgggtgtaggaccctccgagccaggtgcaggatataatctcctggtgcgccattttttaagcccgtcagaaaagcgcagtattcaggtgggagtgacccgattttccaggtgccatctgtcacccctttctttgactaggaaagggaactccctgaccccttgcacttcccgagtgaggcaatgcctcgccctgcttcggctcgcgcacggtgcgcacacccactgacctgcgcccactgtctggcactccctagtgagatgaacccggtacctcagatggaaatgcagcaatcatgcgtcttctgcgtcgctcacgctgggagctgtagaccagagctgttcctattcagccatcttcgcctttgagtcttaagaaatcctggcacctcattttcaatcttaaaattaacatactgtactcaaatatttatcattaatatttggcttgttttacaagtttcttggtaattaatgccatttgtatctgttttctcctaagagaaactctgagtgtaccaggattttgactgttttattcccttccttgggccacctcttacagctgctggcacaaagaaggtgctcatttatttattgaattaatggatgtctctaaaaaaagctttggtgcatcctacaaattttattctataattagtatgaaaatgatgcaaaaggatggcagtcaaataaaatgcaattttcaggtattcattattgtgttttctagtgtcactttttattttgacttgcatatgggaaattacacttaaactttcatttgtcccagcacagaggtatatctgcatgagagtcctagtcactacttacatttataatataactctgggttgcaatatttataggtttatttatgtcactattttctattttaatgtaattgttgtttgaccccaccacccaactccccacacataagcatcctccacaaggcaaggattttttttaatttcattcaaagttataaccaaggtttctaaaacagtgcctgccactgagtatttattgaataaataaatgaattacaaactctgtagcttaaaaccacagaacatttagggtattgacaaacttcctagataagatagtcttgctgtgggtataacttgcatttcccttcaaattactaaacgtgttgagcatctcttaccatgttcatttgctactgctgtttctttcacgtgaaatatgctgttcatgtctttgcccgtttttctaaccggttgtatgtctttttcttatttacatagttctttatatcattcattctaatccttcaagttataagctggcaaataccttctctttgtctttccactctatgctgtccaagtacagatgctcttgattttaacgcagctgaatttaatctttttaatgcagctgaattcaatcttttcattcctatgtatggccttttgtgtcttctttttaaaataaattcttccctacactgagataaagatatttcttccccaccacctcaagctgttatagtttaactttcacgtttaggttggtgtttgtgtacggtaagaggcaggtatcccaatttcctttttgtctgcatgagcacgagcatcatctattgcacacactctccttttcccaaagttttgcaaagctacttctttcacgtgacaaatccaaaatatggatgggtctgtttctgggctctctattatgtttcacttgttaacttgtctgtttctgtagaaacagcactgacttggttatggcttaataacaacccttggtatctgatagggcaggcccctggctccttacagttcttcaggaatgtcctggatattcttaggcctttgctctttgatataaatttgagactcagcttgacaaattcctcaaaaaaaccaggtgggtttttttaatggcattgaatctctatcaccaatttggagagaaggtacatcttttctatactgagtcttctttaaagccttctaacaaattttgttaagctgctcttatgaatgcattgattgtggtatattttttaaaatggctgattcagtttgctaatattttctttaaatttttacatataagtcataggtatcttggcctctaatttccctgtttcatatactgtctgcttttggtgttataatgatctcctagaaaggataggacagtgtacttctacactctggaaatgtttgtacatctgttctttaatcatttgcaagaaccatctggggctaacgttttgtttatgagaaaattttaaattactgacccaatctcttcaattgcttaggtactataagctgttgcttcttcattcagtcccagtaagttatatttttctagaaattcacctactttgtctgttttcaaatttattggcattaatgattcatattattttattagttttttaaaagtccttatgtgcctatttataactgaacatgatttatttacatctcatttctcttttttcttcatcaatctttccagaggcttgtcttttccaacagtttctggctttgttgatcctgttactgcatctttgctatatattctttattatctccttcctcctaccttcttcgagattattccattttctctcccctaacttagcacattaattttcagacttaattcttttctaataaaagctttcagactataaaattcatacaagttccatcttagaaatattccataagttttaatgttttcaagtcaacgtgtccttgaatttccacttacgatttcctttgacccataagttgagaagtgtatatcacactttaaaatattggcatttttataatttatgtctgtaattaacttctattttaatgcatagtggtcagagaaagcagttcttgtgataccagttctttgaaatgtgttgaacctggctttatggcctactatgaaatcaatttttatacatgttccataaatacctaagaaaaaatattttttctaattttttgatgctaggtcctattacatgcccattaaatcaagcttatgtatttagaagtttttgtcttcactaaagtttttctctgcttgacctatcaaatacaggaagaattgtgttaaaatctctcaccactatgatggatttgccaattaatccccagaattttatcaaccagcttaaaaattgtatatcctcatactgaattttaaaatgtagtgacactctatttttattaatgtttttactatataatctattattaatagattattaataataattaacagttgatattaacatagctaccccagctttttttcagtaagacttttattttgcttgttctttcatctgacaatctctgccttctgatgaaatttacattaatttttattaattgaagactaaactgagaaagtcctaactgatcagaaggtgattatcttctaacttactcgtcacccacctcaaacccccagggaaacaggataagaactctatttaggctgccccatttgagaatggggatgaagggaaatcatgccccaacattactgcagggcacattttagtggagttttactgtacttgaatttatttctcacatcttacctattgctttctaattatctcattctttctatgtttttccctcttctctctactcttcattggattgtttcaatcttatgtttatgtatttattttcttattccatttctttcccccctgatttggaagttatatactcaactactacagtttcaatggtttaccttgaaattttaccacatatatataacaaagtctaaagttaatgtctgaccccatcatcctaaataaggtaagaattttagaacagtttaatacaaatcatccccttccctcctaacttacatactattattgtctagtattgtagttgtcctttttcttagaacccacaaatgggtcattattatcatattcatggatgtttccaacagactgctgaaataatccataggccactagctaagaggtggcccactatggtctagagagtaccaagaaacactgtgtgacccattccccatatatgctgcctccagggctgtatatgtcctttcccctacctaccttccactcacccttttcagtagcataattctactcattctttaacatattcttcaatattttctgagagtccattattgcaacgtggtggacatagaactgttaaccagatacacatggtctgtgccctcagtgggaacaacaggcatggcactaaacaaaagcaagcaatactcaatattcattgagcatttgccaggcattgttctaagtatttcacatgttaactcatttaatccttaaaacaagcccatgtatttactatactctccattttacagacaaagagaggctaagaattttgttatagtcacaagactagtaagtagagtagaattaagagtttcaacccaggcattctaactccaaactgtactcctaaccactgagctatacaaacaagtcaaggattacaaaccataagtgccatgaagcacagaaacaaattgcatagtcaaagaataactggagtgaagggttccaagcttctgaacaattctggagaaagaaatgtaaagatatgaaaatgagagtaaacaggggaaatgagatggagacaaaagcctaaaagaaaaatgagagcagaagataattatgacatatgtgaaacacatgtttcagagggaatgcctgcttcagctacttcatatctacagcttctactgaacaggtgtaagtaggaggctatatttcaactcagtgactcctctcttacaccctgatgacccagtcacagctgtttcaatcaacactgtgttagtctgttttgtgttgttttaaacgaacacctgagactcggtaatttataaagaaaagaggcttatttggctcacagttctacagactgtacaagcatggcaccaacatctgctcagtttctggtgagacctcaggaagcttttactcatggctgaagaaaaaaggtgagcaagtgtgtcagatggtgagagaaggacaagagaaatgagatgccaggctcttatcaacaaccagctttcatgaactaatagagttcacttattaccaagccattaatgaaggatccactctcgtgacccaagtagtccctacttccaacactggaggtcatatttcaacatgagatttggaggggacaaatatccaaaccatattaagcaccattcagatgtttttcccatgaattcaagtttgggacacaaagagacagtgaaatggaagaaaacaagctgacatttggagtgacatgagtaacactaatggcttagcacttgagggaaggtccatgatggttatataactacaggaaactctggtcacattctgcctttaaaaattgtttctaacacttttactgaagaagtataaacactagtaataataataataataataacaatatcccaaaagtacaaaaaaagtcactagccatgaaagaaatataaatcaaagccatgagatatcacttcataccaattatatattagtcagggttatctagagaagcagaaacaatggatggttaaaatcaaaagaaatcaaaagacagttcagatatggtggctcatgcctgtaatcccagcactttggtagggcaaggtgggtggattgcttgagcccaggatttcgataccagcctagatgatatggtttggctgtgtccccacccaaatctcatcttgagttgtagttcccataatttccatgtgtcacgggagacagctggtgggaggtaattgaattatggggggtggtcaaccccatgctgctgttctcatgatagtgagtgagttctcacgagatatgatggttttatagggcttttccctctttgctcagcacttcttcttcctgccaccatgtgaaggacatgtttgcttccctttctgctatggctgtaagttatctgaggcctccccagccacgcgaaactgtgagtcaattaaacctctttcctttataaaatacccattctcaggtggttctttatagcagcgtgagaatgaactaatacagtaaattggtactaggagttgggtgctactataaggatacccaaaaatatggaactgactttggaactgggtaacaggcagaggttggaacagttaggaaggttcagaagaagactgggaaagtttggaacttcttaaaaatttggagagctcagaagacaaaaagaggtgggaaagtttgtaagttcccagagacttgttgaattgctttgaccaaaatgctgatagtaatatgggcaatgaagtccaggctgagatgatctcagatggagatgaggaacttgttgggaactggagcaaagatgactcttgttatgctatagcaaagagactggtggctttttgcccctgccctagagatctgtggaactttgaacctaagagagatgatttggggtatcaggcagaagaaatttctaagtggcaaagcattccacaggaagcagaggacaaaagtttgtcaaatttgcaccctgatgatgtgacagaaaagaaaaatctattttctgaggaaaaaattcaagccagctgcagaaatctgcataagaaacaaggagtgaaatgttaatcactaagacaatggggaaaatgcctccagggcacttcagaggtcttcaggaagggccctcccatcataggcccagaggcccaggaggaaaaaatggtttcctgggccaggcccagggccttgctgctttgtgcagtctcaggacttggtgccctgcatcccagccatggctaaaaggagccaaggtacagctcaggccatggcttcagaaggtgcaagccccaagccctggcagcttccacaaggtgttgagtctgcgggcacacagaagataagaattaaggtttgagatcctctgcctagatttcagaggatgtatggaaatgcctggatgtccagacagaagtttgctgcaggggtggagcccttgaggagaacctccgctagggcagtgcaaaagggaaatgtggggttggagccttcacacagagtccccactggagcactgcctagtggagctgtgaaaagagggccaccatcctccagtacccagaatagtagatccaccgacagcttgcaccatgcacctggaaaagccacagacactcaacgccagcctgtgaaaagagccagaagggggtctgtaccctgaaaagccacaggagtgcagatgcccaaggccatgggagcccacttcttgcattagcatgaactggatgtgtgatgtggagtcaaaggagatcattttggagctttaagatttgactattccactagatttcggacttacttggggcctgtagccccttcattttggccaatttctcccatttggaacaagtatatttaatcaatgcctgtaccctcattgtatctaggaagtataataactaccttgcttttgattttacaggcttataggcagaagggacttgccttgtctctgatgaaaccttggacttttaggttaacgctggaatgagttaagacgctgagggactgctggaaaggcattattgtgttttgcaatgtgagaacatgggatttgggagggaccagggcaaaaatgatatggtttggctgtgtcctcacccaaatctcattttgaattatagttccaataatccccacatgtcacaggagggacccagtgggaggtaattgaatcatggaggaggctaccctcattctgatgttctcatgatagtgagtaacttctcatgagatctgattattttataagggtttttttccctctttgctaggcactgctcttcctgccatcatgtgaagaaggacgtgtttgcttccccttccaccatgattgtaagtttcctgagggctcctcagccaagcaaaagtaagtcaattaaacctctttcctttataaattacccagtctcaggcagttctttatagcagcatgagaatggactaatacaccaggcaacatggcaaaaccacatctctacaaaaaatataaaaattagccaggcattgtggtacaatgcctgtagtcccaggtactcaggaggtgagaggatcaattgagccagggaagttgaggctgcaatgagccatgattgtgccattgcactccagatgggatgacagagcaagaccctttctcaaaaaaaaaataaaaatcaaaaaatgaaaagacagacagtaatgagtattcatatagctatggagaaactgaaaccttcattcattgctgctgggattataaaatggtgcagccactttagaaacaatttggaagttcttcaaaatattaaagatatttaattaaatattaaagaatctctagacaggctgactgttgaagggcattctcagacaaagccagtctgcaaagactgaaataagtgcctacttcttcaaatgcacagatgtaaacacaaggccacaaacatcaacaacaatcaggaacaaatgacaccactaaagaaacaaaataaagtaccagcgaccatccctaaagaaacagagatgtatgaactgacatagaattcaaagaaagctcagcaaacttcaagaaaatacaaagaaacaattcaatgaaattaggaaaataacgagtgaccacaaagagaaaggtaataaagagatgaaataataaaagaaaaaatcaaacagaaatcatggggctgaaaaatacaatgaacaaaattaaaatgcaatatgggagcatcaactgcagaagtgatcaagaagaagaaagaaactatgaactcaaagacaggttatttgaaaatacacagaggagaaaaaagaatgaaaatgaatgaagaaagcttacaagatttatggaacagcatcaaaagagcaaagttttgagtcacaggagttgaagaaggagaaaaggaagataaaaggggtaaaaagcttaattaaagaaacagtaacagaaaattttccaaacctggagaaagaggtaaatatctacatgcaggaaaagtccaaggtctctaatcagattcaatccaaacaagactaccccaagacatattacaatcaaactatcaaaaatcaaagacaatgagaggatcctgaaaacagcaaaagataagaagcaaataacatataagacagtcccaatatggttggaaacagactggtcagcagagacctaacaggtcaggagagaaagggatgatatatttaaagcgttcaaggagaaaaataccaaccaagggtaatgtacccagcaaagtgtccttcagaaatgaaggagagatactttcccagacaaacaatagctgagggagataatcatgaccgcacctattttataagaaacgtaaaaggagctcctcaagctgaaagaaaaagatgctaatgagtaacacaaaaacatctgaaagtataaaactggctgataaaagaaagtacacaggtaaattcaaaataatactgtaatgatggtatgcaaatcacttacatctgtagtaggaaagagaaaactattaaaagtaataatagctacaataatttaagggatacacaatatgaaaagaggtaaactgtgacatcaaaaattcaaaatttcaggggattaagtaaaagtgtagatttttttgttttggggggtttttgcaataaaaattaagttatcaagttaaaataaactattataactcttaagatgttttttgtaacctcttggtaaccacaaaccaaaaaccaataggagatacacaaaaaataaaaagcaagaaatcaaaacataccactagagaaaatcacttaaccacaaaaaaaagacagcaagagaggaagaaaagaataaaggatctataaaagaaccatgaaacaataagcaaaatggtagtacaaagtccttacttatcaataattaccttgaacatgaatggattaaattatccaatcaaaaaacacagtgtctgagtggattaaaaaaactagatccaactatatgctgcccatgacagactcatttcatctgtaaaaatacacacagactgatggtgaaggaatggaaaaagatattccatggaaacagaaaccaaaggagagcaggagtaactttacttgtatcatataaaacaaactttaagtcagaagttgtaaaggagaaacaaagttcctatataatgataaaagggtcaattcaataagaggatataatagtaagttatatgaaggtacttttactccactcctcccattttaaattttcagtgtcacaatttatatattttatattgcatatcccttaataagttatgtagctattgttttttataaatatatatgaacccaacatcagagcacctaaagataaataccaaacattggccaggggtggtggctcacacctgtaatcccagcactttgggaggccaaggcgggtggatcatgaagtcaagagatcaagaccatcctggccaacatggtgaaaccccgtctttactaaaaatacaaaaattagctgggcgtggtggcatgcgcctgtagtcccagcgactcgggaggctgaggcaggagaatcgcttgaaccgtgagacgggggctgcagtgagccgagaccctgccactgcactccagcctggtgacagagtgagactccgtctcaaaaacaacaacaacaacaacaacaacaaataaaataaaataaaaaccattaatacgtctgaaaggagagagagactgcaatacagcaatagtaggggacttcaacaccctaccttcagcaatagacaaatcatctcaacagaaaatcagtaagaaacatcagacttaaactatactctagaacaaatggacagatcagacataaaacatttcacctaatggcaagagaatacacattcttctcaactgcacatggaacatgcaccaggggatatcatatgttaggccacaaaacaagtcttaacaaatttaagcagaatgaaatcatatcaagtttcttttccgaccacaataataaaaaactagaaatcaggccaggcgcggtggctcacgcctgtaatcctagcactctgggaggccgaggcgggcagatcacgaggccaggagatcaagaccatcctggctaacacagtgaaaccccgtctctactcaacatacaaaaaattagccgggcgtggtggcgggtgcctgtagtcccagctactcgggaggctgaggcaggagaatgacgggaacccgggaggcggagcttgcagtgagccaagatcgggccacagcactcaagctcgaggacagagtgagactccgtctcaaaaaaaaaaacaacaactagaaatcagtaacagaggtgcttcagcaaattcacaaatacatggaaattaaacaacatgctcctgaatgatcagtgggtcaatgaagaaactgaaagcaaaattcaaaaatttcctgagatgaaaaaaaatggaaacacataataccaaaacccatggaacacagtaaaagcaattttaagagcaaagtttatggcagtaaatgcctacataaaaacaaaaaacctcaaataaacaaccaaaaaaccccaatagacatttttcaaagacatacaaatggccaaaaagtacaaaaaaaaaaaaaaagctcgatatcactaattaccacagaaatgcaaataaaagccacaatgagatatcacctcatactacacttagaatgactattaccaaagagacaaaagataacaagtgttggcaagtatgtagagaaaagggaacttttgcaccctgttggtgaggagttaaactaatacagccattatggaaagcagtatggagttcctttaaaaattaaatatagaactaccatatgatcctgcaatcccaccactgtatgtatgtgtgtgtatacatatatatatacacatatataaaatgaaatcaatatgtcaaagagccatgtgcattcccatgttcattatagcactattcacgatagccaagatacggaatcaacctaagtgtccaccaatgcatgaagagagaaaatgtgctatatatatacaatagaaaactattcggccattaaaaaaagaaggaaatcctgttatctgtaacaatatgaatgaaataagccaggtaaagacaaataaatactgcatgatctcactcatgtggaatcagaaaaagttaatctcatagaagcagagagcagaatactttgggagtcgggtatggtttgtgttaaaggacacacaatttcagcttgacatgaggaataagttcaagagctccactatacaacatgaagactacaattaataataatatattatattcttgaaaaatactaagagaatggatgtaaagtgttctcaccacagaaatcattaagtatgagatgtatcatgttaattagctagacttagtcactccacaatgtacatatacttcaaaacatcatgttgtacatgataaatacatgtaattctgtcaatttaaaaataaataaatgttttaagtcactgaattgtatactttagaaaagtgaatttatggcatgtgaattacatctcagtaaagctgctggctaggtgcggtggctcacttctgtaatcccagcactttgggaggccaagatgggtggatcacctgatgtcaggagttcgagacaagcctgaccaatatggtgcaaacccgtctctagtaaaaataaaaaaaaatagccaggcgtggtggcgcgtgcctatagtcccaactactcaggaggctgaggcaggagaattgcttgaacctgggaggcggaggttgcagtgagctgagatcgcaccattgcactccagcctgggcaacagagctagactccatctcaaaaaaaaaaaaaagttaccataaaatatttatattaaaaattgtgtagctacttttaaatatccaaccctctgcattatcctttgctatggactgagctgtgtccctcccaaatccaaatgttgaggccctaacccaccgtgtgattatatctggagatagcatctttagggggtaaagtcaaataaagtcataagaatggaaccctgatccaacaggactatggccttataatagaaagcaagagaaagatctctctctctctctctctctctctctctctctctctctctctctctctctgccatatgacaatacagtgagaaggggtctatctgcaagccagaaagagagccctcactacaacccaaccatgctggcactctcatcttaaacttccagctcccagacctgtgaaaaactaaatttccattgtttaatgcatccagcctatggtattttgtcatggcagctaagctaatacttcttagtctattctgaagcttgggcttagaatttgcattattcctaaagctatcaaagaaaatataggaatatgatttctggcctaacagccagggaaaagccctcactttcctataagaatattactttagaagcagaatattatatgctctatatctcactgtccaaattctgtttatcttcttttcatgttttaggttttcatttcctcaggaaagcccttctcatctagtactaacaaaagtcattacgtgctcagccttgagactttgagccttcctcttgagcagctgtttgtaaaagaaattatgaagagagagaaaggatgaaaatgctattggcacagatataaaatgagataaattcaataacaaagccatttagaaagatttttagacaatgtgaggactgaaaatattcacaacaatattaatacaatataattgtcctttctgttttacgttatcataaaaaatcagttcctgccctgtgtttatagcaacagagtatttgagagcacctgggctgcagagattactgctctatcccatgaaacaaaacattaagagtataaaagtctgacttaaatagtcaaactgattgccccagacaataaggttcaaatttgcatttctgttttctgaaagtttaaacaggtatttctttgttagcttggagagcttagtaatttcccttttttccagtcacatctaggttaaataatgtgatgaatctgctagtcttcttagtttgaatcaatgagttttactgtcacattagaaatcaaatggagaaaaagcaacaccaaaactcttcagctcctcatctatggagttaaaaccttacttcctgccattccactatcctttgaggccttgaaagaaagagtccagtctgagcttacacttcccattcttacactttagataaatgtacacatacaaaatgaatgggaggaaaaaagacaaaaagatcttggatatacataatgaagactagggaggtgttttaaagccacacttacaaacacagagttctaatgcagaatattaaagtgaaagtcaattgttgaccaacatgaagagcttacctttgaagaatcaactctgcttgttgttcagaaatagtcagacccagtgtctggagagactggacaatttctgaagcctcaatttttcctttaaaaaaataaaaagggcaaaaaataaaactcagaactggtaagaaccacagaaattatgaatttcaaatctctcatttaagagaaagctttaaactgattaaggcaaaattgtgcatgtaggtgagttatagacttgcttaaatgcctatcccaacatcaatactaaaaatgtaacaaatacattaaaaaataaatacacattttttaaaattcagtaattgtaacagccttatagataaataatattcctccaaagagactgacttcacaagtggccttaccaagtaatgtaattaagaagtagcagaactaaaatccaaatcaagatattctaactccaagataaattcaattaaagtaggatctattcattttaaaagtacctatttctacatttttaataaattactagacatttactatgcaaaacatcatatatgactgagttaaagagaagtagtaaatgaggaaatagagctaaagcacagactattcttttaaaaatctggcagtaaaaggccaggcacagtgactcacacctgcaatcccagcacttttggaggctgaggcgggtggttcacctgaggtcagcagttagagagcagtgtggccaacatggtgaaaccccgtctctactaaaaatagaaaaatcagccaggcatggtggcaggtgcccataatcccagctacttgggaggctaaaagaggaaaattgcttgaagctgggaggcggaggttgcagtgagctgagatcgcgccactgcaccccagcctgggtgacagagtgagactccatctcaaaaataaataaataaaaataaaaatctggcagtaaaaataagggagcaaggataaaagaacaacaaaagacagaaaatttttaatactagggaaattagagcgtgtttgtggacagaaggagaacaatcagaagacaggaagagaaaatagaaaataaaatagaagcaataaatgtaagcactgctgtatttccttctagcagctcacaggctcatgagaatcctaagactactgtacatgaaaaagaatgaaacaaaacaaagtaagagagggtctggtgctgaagcagcataaacagctgacttctccagaaaaagaggaagaccaaaattactgttagtggtgaaaggatagactttcttggagaaaggaccctggagagatgacaggattctgagagaatcctcctggggagagggaaggagcagcatgagaatctggaccatgtaaggacagtgagaggcagcatctgttagtaaagaaattatgcaaatacccttctgaatattctcctttagaaatgcactcttaaagagatatggttaattctcattattcacagcaatcatcttccataaagttctatattcattgcaaacactgaattagcaaataccaaaccattgttcctacaggaaaaacagggttaggttcctgtgagcctctgattacaacactttcatcaactgattaatacataaccatgtcttatgtctgtttctgtttgaacgcacctcatttaatgtgtgctgttgattcactaacattgaatttggggcaaagcttatcaaacgcatatattttctccataaggcatgctatggctttcttgcacttaggaacactagacagcacttcagcactacctttggggaacattttaaaaaggaaattaccaacaaaaatacaaaaatgcaaaaactggcacaaaacagaccttgaaagggatacttgctagttaatagtatgagagctgaaacaagaaggcagagtattgccttattctactagctaggaatgtacatgctgagcaactcaagtttttcactgctctgtgcatgtccatgaatgcctgggaaagtactgtgagtatatattttggggttactttggggataaattttattgagtaggcaaatttgcaaatacagaatccccaaataatgaggatcaactgtatatgttttgcattaaggaagtctaaaaaataaaaatatgaaccaataatgccacattgttttaaaatacacaaacatgggaaattagggaaacattgtgtagatttcctacaaatataccatcaaaatttcatctttaattattgcctctggttcatttagaattttataaaatgaacaattgatatgtacactacttatgcactgggataattgacctctgattatctggcaattgatcttaaggtagctccatctctcagctactgcctgccatagcagcacacagacaatctgacctgcaagacaatctgaactgcagagggtcgatgttggaatgaaagtttgcagagaagaaagaaaactgagttttgctagaagactggactaaggctagacttaggggcatatattgtaaggcttatgggcaacaaatgttccaatagtactactttccaacccaaactcagctcttcctggctgagagtcacagatgtgaataatcttcaaaatcatctagagtttagtttgtttgtttgaaggaacttgctttgaattaaactttaatattcattgtaaatcaggggatggcaaactataaccctcaagccaaataaggtgtattaactatctttgtaaataaagttttattggaaatcagtcatccccattcatttacatattatccatggctgcttttgaggtacagcagcagagacaagtagctacaactgagaccacatgacccacaaagctaaaatatttattatctggacttctggacaaaaaagtttgctgatctcagacatgaaccacatttcctctcaatctatttgtttaacctgtttctttaataacaagtctgtaaatgaaatgaccttgactattcacaagtagggagggatttggtgctgcattataatttttataaattctctcttcctgttaaaggttacctctagtgatgagggcttcaagaccctatttccaattagaattagataaggtcttcagagtagggcccccatgatgggactagtggctttttaagaagaggaagagagatctgaggtagtgcatttgctctgtgatgcctgctagcatgttatgacatagtaagaggccctcaccagattcggctcaactttgaacttcccagcctccagaactataagaaataaatttcatttcttcataaattacccagtctgtggtactccattacagcaacagaaaacagattaagacaaactccaacctattaatcgaaatatagaagtcataatcttaaccagaaggtacacacttaaacgtttatatgctatttttccctaatttccaggatcagagatatcttctctaaattaattcttccaaaaaaactaacagatgcaagataatctgaaagttttttaaattttagatgacacaactgtcattcttctatacaaataaaaagaaatctcattttacccagaggacaagaaaatataattattatttttaacctacaggtttaactcaaatcagcataatgttccatagttaacatttacaacaggccctgcccacagtttttaattcagaaatgtaattcattacatttcaaagtaatgaaaaagaaaagctatctataagttttcttcactaaataatataaactctacataaaaatcacattactaaaaaaaagtattaacacaaataataattatcatctaaaaccagagagattaaataagcatccttttagactcttgaaagcatgataaatgcttcttcatagctggtgataaatacaaaagaaagacacaccatcattatttttgtctaaactcttaaatgccaatttcattttcttctcatggtctttaaggtacttcataaattcttcaaaatccagcttcccatctttgttgacatctccagtagtaaaaattttctataaaaaaaaattagagagaagttattgccaatatgggctgatgcactaaattatttctacacatatttcaagcagattagctgttttcctaaaagactatagtacctatttttggccagatgtatcatcattcattatcgcaaagatctataataaaagtaattccactactgcaaaaagattctgagtcttgtgttaaattttcaatcagaaaaatgatgcattgatttttataaaacatgacatttttaaagctaatctaaccataccctaaatttcttgacatgtactttataaaccccaagatagaagacaaccacttgacctaccacaggatttaaaatattgcagcactttgggaggctgatgggggaggatcacttgaggtcaggattcaagaccagactggacaacatagtgagacctcatctccataaaaaatttttaaaattagccagatgtgttggtgcatgcctgtaaatactagctacttggaggctgaggtaggaggatcacttgagcccaggaatttgaggttacagtgagcaatattgcaccactgcattctaacctggtgacagagcaagaccctgtctctaaaaaagaaagaaagaagaaagcctaaactagtgttttcccctttgatttcaaaaattaaataatcttttactaaggatgatccatataaaaagctgtcatagcaaactgtaagccctctcctaccaccacccaaaatataacctatctacctattatgacactcatagtcacccactcaaagcttacaaattctactgttctcatggtcatgctcttctgggtaaataatgccaagttgggccgggcacagtggctcattcctataatcccagcactttgggaggctgaggtgggcggatcacctgaggtcgggagttcaagaccaacctgaccaacatggagaacccccatctctactaaaaatacaaaattagttgggcatggtggcgcatgcctgtaatcccagctacttgggaggctgaggcaaaagaatcgcttgaacctgggaggtggaggttgctgtgagccgagatcgcaccattgcacaccagcctaggcaataagagtgaaactctatctcaaaaaaaaaaaaaaattaaaaaaataatgccacattgtgactggatggtttcatggtcatggtcagatctccaacctccagactgagagacagatctgaaacttgtgagctgcaactaaagctacacttagagaaagatttctggtttaaaatgcataattagaaaagaagaaagactggaaatcggtgacccatcattgaggcttatctcaatctcaagaaattattttaaaattaagcaaaaaagaagttgaaggaaataaagagcaaaaagtaatgagaaagaaaacacaccattgggaggattaacaaagccaaaagatggttctttgaaaagactaataaaattgataaactcctaaaactggcaaataaccaatgtcagaaagtaaagatggaaactactagacactatagacattaatgatattatgaaaagctttatatcaaaaatatgaaagtgagataacaaacgcctacaaaaacaacttattaaaaactgacataagacagcagaaagtctgatagccctatactcagattttaaagaaatttaaagtgtaatttgaaaacatttccatgaagaaaaatcgaggaccccatggttttaacaataatgtctaccaaactttaagaaaaaaacaccaattttccagagaacagaaagggtgggaacattttccaacccattttatgaggcgggtatacacttgattctaaaacctaacagggacatcacaaaaaaaggaaaattacaagcaatgtcaactagtgaaaaagatgcaaaactcctgtataaaatattagcaaatcaaatctcataatacacgaaatggataagacattatagatatatatatatatatattcatgcactgtatacatttcagtcaatgatagaccatatatatgacagtgatttagtaaggttatagtactatattttcaccatggaatactacacagccataaagaagaataaaatcacgtcctctgcagcaacatggatgcagctgaaggccattatcctaagcgaatcaacgcagaaatagaaaaccaaacaccacaagttctcacatacacatgggagcaaaacatggggtgcacacggatataaagatgggaaaagcagaaactggggactacaagaacggggagggaatggacaagggttgaaaaattatcgattgggtactatgctcactacctgggtgacagggttcaattgtaccccaaacctcagcatcatgcaatatacccttgtaacaaatgtgcacacaccctccaaatctcaactaaaagttgaaaaaaattaccatatttttactgtatcttttctatgtttagatacacaaatacttagtgtgttataactgcctacggtattcagtaaagtaacctgttataatccaagagaaaaatgtcacagcattctgtggcgccatttacgtactgaagtttcatctaagaggtttatattttggccaatggaaatatcagcgaacaagaatagtcaccgaccaaaaggggcttgctgcccgatgaactagaagtcaatactataataccaggtgttgagaaaagaaaagctttttattgcaaggtgacccacaagaagacaggagtccagctcaaatctgtctccctatgctggctttaaggtagttattagaaaaggtttgggggcggattctgggattagtgggtgattggtggaaggaaatggggaggtctcccaagtccttaggcatgcatagttacctcttcatgctacctcacagatcatgtgtgaaaatccggggggagttagtataaaatatgtggtggaaatttgggctgtaacatcaccaagttagttctgtgcagacttgagttggccatattcattccaaccagttttagccagttttgtgttatcttacaagtggagagattttcagtgtttcagcaagttgcttcttttttaatctgtcatcctgaaaacaagattttctcttagtcatttgttcctttcactctttggggccacagttttcactaacattttggaagtaacaagttaaaggacatccctgaccctatttttgaacagttttttttaacccatatttctgcagcatttctgatggcaaatcaagagttatgattgcctaatgagtctgacttaacaatacaatagtcctcccttatccacagtttcactctctacagtttcagttacctgcggtcaatcatggtctgaactattaaatggaaaactccagaaacaaacaactcataagttttaaattgcacaccattctgagtagcatgataaaatctctcaacattctgtgccatcctgcccaggaggtgaatgtccttttgtccagcatatccacactatagatgctacttgcctgttagtcacttagtagctgaaccagttatcagatcaaaaatatatagtctatggctgggcgcatggtggctcacgcctgtaatcccagcagtttgggaggccaaggtgggcggatcacttgaggtcagaagtacaagaccagtctggccaacttggtgaaatcccgtttctactaaaatttaaaacaattagccaggagtggtggcacacgcctgtagtcccagctactccggaggttgaggcacaagaattgcttgaacccggtagacagaggttgcagtgaaccaagactgcacccctgcactcagcctgggtgacagagtgagactccatctcaaaaaaaaaaaaaagagctaaagctaattaaagataaagtaaaaaaaaattaaaaaatatatatatatatgtatatatagagagagtatatatagggttcaatattacccacagtttcaggtattcagtgggggtcttggaaaatatgccctgcagataaaaggggactactataatatgaaagattaggaatggattcccctttaaattttcttgtatgttccttctagaaataaaagaccaatcaaatgagaaaagtaaaatctacttggcccgagtttgctatagcaagggagtcagacaccctcacttgtgtattgacagagactcaaagccaggcagaggagtgggaaagctttacagtgagaaaaagggaaggcttcaggcgtttcctgattgggggctgctggcctggggaagctgtaggagggttcattagaaacgcggcaccctatttgattagtaggtggtgcatatttagctttctctggttcgtcctaagttggaagtgaagaaaaaaattaggggggctgtcggttattaatcaaattctgaccatttggggctgttacagcagttattgcatagctttgtgtattgtctctagagatagcaacctgacttcctataagtctgacataacaggctggtttcctggtctgtttattttagataaagggctggttttctgggcagactgctgtaaattttgagtcaaagttctatttttatttatggtctgaccattatctcttcgtatatttagtttctcaactttcacaggaaaaaacaaaacaatatattgttcaaaaacagactattttcacaataaaaagttattgcttttgtatcttaacacgacaatgtaagtatcatttcttttttttttttttaatcagttgagttttgtctatataaacaaattttcctactggggaggtggagacgtgtgggaagagacctcacatcaaaacctcctaacgatgtgactgccacttgaggaaaagtcacaatggtgctcctctgaaacagaatgttctgtgtggttggtgcagaattctctggggacacccctcccttgggttttgacatgtgaaccctcctcagtcaccactaggtacacaaagcgtccttgccaaaaatgcaagacagctctacaaaccttttgtttcaataaggaagaaatgtgtttcaaaagattcgacttgatagctaacccagaatttcttatgaaaggctagtttgtatcaaataaacaaatacaacttacacttgcaaatctaaatataagagtgtctttaaacaaatatgaagaacacttaactttttttttttctttttgagatggagtctcactctgtcacccaggttggagtgcagtgatgcaatctcagcttgctgcaacctctgcctcccaggctcaagtgattctcctgcctcagcctcctgggactacacacacccaccaccacacccggttaatttttgcatttttagtagagatggggttttaccatattggccaggctggtcttgaactcctgaccccaagtgatccacctgccttggcctcccaaagtgctggaattacaggcatgagccactgcacctgaacaagaacacttaactttaaaaggagaaacactgcttttttctaggaattaaaaatccagataagctttgcagaaataacattttggactgaattggtccacagaaagtacacagtccaggcctctgatataacagatgaggataccagggtatggggcttggaatatagaatgtgctcaaactagaactgacccatgactgaatggatgcttcaatattcccaaagttcacatggctaatagaaagagttttactaaatttcaacatgacagaactcaactgacagttttttgggcacgaagtaccaattatccaaaataaactcaatagtccacatgctcatgatctcccagtctaccgggtcaaacatccaaagagcaaatatacttataaagtaattattatatacaataataaattccaaatgaaaaatgacttggaaatactgcaataggagtatgtacgaagcacaacatgctgagaaggagcctgtaggttagccttctggggaagagaagggttagcctaagctcggtactgataactagggtctatcaattaaggcatattatgaggaaacctcagcactagtgaaacccgagagtaaaagccacttccactgcccccttccaggaacagaaaccgaaacataacatcagaaaatttccaatcaccaccccactcccaaatacacgtagagtgattattccagttctctgaactggggagggcgcatctttagcctagacgcccctctgggtgactaatgacaggtgagcacattgaacaaggtgactcctaagacaaggctgtatgtagccaacatcttgagagcaatctgaagttggagattttactacagccaaggagaaaacggagaaaaatacttgagaaatgtgttagctgtgttgttattcttaataaacggtaacgctggtcaacgacctgaacactgcagtgggcccaggtcaagcttgacaacatgtaaattttgccctctctgcccaatgcctctccagggctcccagccccaacgtctctctgattacagccccagtgagacccaccttcgcttcctctagagattgaatggcccctacatcctccaggccttcctgaagctcaaaaatgtccaaggtcccatccttgttatagtccaggtaccaaaagagatctccgtagagggagtccatcgaggatgtctccctcgcagctccgcggcctgagtgagccccagcggggtggaagtgcgaccgacgaacgggatctctgcccaccacacacgtccagtgggaagaggcctaagacagcatcctcctcaggggcgccaaacacaatgcaccttcatcggttaaagctctggaaggagagggctcatcct

SEQ ID NO: 525 - DNA, 102488 bp, Homo sapiens
tagatggaactggtagtcagctggagagcagcatggaggcgtcctgggggagcttcaacgctgagcggggctggtatgtctctgtccagcagcctgaagaagcggaggccgaagagttgagtccgttgctaagcaacgtaagtgggctgtgttcgcttccccgcgctgacgccctccggcttccctcaagtgcctgccaaataagacccagaaaaggaggaccgcaccgggacaggggagatgctggagcctgaaccctgggggatggggtctgaaggcagccgccgagattcagatgagattggcgcagttatgaacgtgatagcagcctagcatactctagaaagaaaagatgaaaagcgtcgggtggaagagatgcagcgttgagtggaagctgcgaacatgatgggatgagcggccctaggattatgtactcactgctgttagttagtatttttgtcaccttattttctccaccagtctcgtgaggtctttgcaagagtcacaggattttcctcttccgacttagtcatggggggagggaaaataataaacattttaatacagaaattcttagcggtagaatggaagtggcttggtagtaagtgcatagcacgttcctgaccctaaagcctgtgcagtgggcactccgctttttaactcgagtcctagacactgttcccaggactttgttcccggtgctgtttgtggggagggggatgttttcagggatactgccagaacaacgtgaattgcttctgtttataatattgtcattgcaagatattcctgaccatccttccagtttggtagaactaattcattagatatataagtagagattagttgtgcagtcctagtaattgaggagaaacaactgcccacagcagtcccaggttgactcagcaattctttagtaatcacatgagctgaggccttatccctcctctctctccccactccattcccatcctatcttcatctcttgcagtcacaaggttagtcatggcccttcctgaactctgcctgtcttgtgtactggtggaaatcattttcctaagaaaccctagattcctggagctgcagtagtgggaggtgggaaggaaaggaaaggaaattagtgttggttaagcaacgagtgtgtcatacaaaccctggtggtttgcagcttttttccataatctttcatttatggaatttctttacgaaattttaacttcaccgtccaaacatttaacactactaaatttgtgtgcttacaggaacttcacagacagcgatccccaggtgtttcatttggtttatcagtgtttaatttgatgaatgccatcatgggaagtggcatccttggcttagcttatgttttggctaataccggtgtctttggatttaggtgagtcttcatattttagcatcaaatttttttttccattttgataatatacggagaagtagagagatagattccagaagctgctattatacaatttctagttagttatttctggggttttagcatttttcttgttattcttgttgctagtgtgtaccttggagggctactacatagcttcttaaatacacagaagtgtgactagtttttaaaaatgggaacttgatccacatttcatttataatgaaatatgacacttaagagtggcatattcattgtatctccttggccaaagtgaatcaaagccatgcagattaacttccaaatagcaattttgtgagtgcaaatacaacacataatcttttcattcctcgctgtctctttgtattgttaagtagtcttatttcactttcagaggccagacatgtgttttgtgcctgttcttttttatgtttcaggacttagcttgtaggccagtttgcccaaaatagaagacaatcctggatattctgtgctttcatagtactttgtatattcattctgttattataattgttacaatgatatgtttggaaattaatgttcccactaaactgaaatcctttacaactggaggtcaaggcaggcggatcactggaacccacgagtttgagaccaacctgggcaagatggtgaaaccccatctctgcccaaaatacaaaaattagcctggtatggtggagtgcgcctgtagtcctagctacttgggaggactgcttgagcctgagaggttgaggctgcagtgagccatgattgggctactgcactctagcctgggtgacagagtgagatcctgtctaaaaaatttaaaaaatagaaaaatcctttataactggaccttattcttagcatctagcaccacatggctaatagaatgaattaacaaattggctttgtcagtagaagcagatctatttactaggaaatttaaaatgcctagggagtctcttttatgtttatttcctgcttttattccaaattttttgataagcaaagcaacttttaagtaacccaacttgcttttattatggaatgtactcacaaactttcattatttttaaaattaaaaactatatgtgacaccttaagcaagacatagtcagaggactttttttttgattctctttgaaaaatcataatttatgcaccagggtcttacatgcagatatatactgctgaatgtgtgctcacccagtcatagcaaccatcatttttggtgatgctaaagtgttattttgtgaagttcctgatgtcagtttaatgacatttgtacttttacctctcaattttatttattaacaagtattaactggaccacagagagaaaatttcttcaatgactggggcagttcactggggatagctgtatagaagcttgtcctgctggtgtcttcctaaaaatgaataggaaattatctaagttttttctttcacactgttggtgagaggacctcaatcattacattgtttgcacatttttcaaattgcatcattagaggtgtgttaactacattattttaatttagtttggtttggagagtgtgtgcgtttaatagatgctagaaaatacagcctaaataaatcttaagtacaccttaataagatgaaggtatgataaggaggtcaatatcactggaagtagagggaggaagggaaaaagagaagacaatgagattgcataagtaaaacttctgtttagacttaaaataagaagaaaaccagtcataaaaaggaaatattacaagattatttaatggctgattcagcagtcagcagacaagactgcaaaatgaggaagtttgcttgtatttttaaaaaagtttggtttttatttttttttattttaaaatcagtatattttcatttaaataaaattggtaaatacaaaaaagtagaaaagtatcttcttaatttccttaatgaacataattctgctactcagagatagttcctgtgaatatttgactgttaagcaatttgtttttgtaatgagacaccatacaaaagacaaacttttgggaggttttgaccaggtgttcttttatgttttagcttcttgctgctgacagttgctctcctggcttcttactcagtccatcttctgcttagtatgtgtattcagacaggtgagtaaaaatgttatgctgcttcatttaataaaggagtctcttgagtttgtatctacatatagaactggatgtctcaaatctaatatccagtgagcatacatttttattagatagggtgatcggaatggagaatttgaaaaaccaggatatacagacccaatactgtgggggaatatccaagcacaggatgggaggaggtaattagcatttttacctgctttcctccacaacacaacctaattttctggagtagagtagatcatgggagggtctaaaaggtgttcaaaggatccaaaccttatgcttatggagaaatcattttctcaaggagagaacaccttctcagagctactgttgccttccctgcccccatctgcctgctagtcagaggtagggatggcagaattaggattgtaggaagtaaggtcacaaagctttaatttatttagacacattttgtatttttaattgcaagtctagaatagggtagttttttcctaagagaaataagtatgtgcagttaattcaatatatttgtgtatatactttttcccatttggaattttattatgcaattcagtcatgtattgaataagttcttttaggatccagtaaataaaagtatatgaattatagaagtgcttttctaagattttccttttgtcattaacaaatattctatgttcatcagtcctggtctttttatctgtctagtctcttttgtctttggattaggtcagctttgatgccaaaatcatgggtttaattcttatatggatgagttcgttttgctttatctggccttgtgatgttcagattttaagaagaaaagtagatacacaaaatagataaaaatggatttcttaattcatttagtgtttctataaaagaatacctgaggctgcataatttataaataaaagaggtttattttgctcatagttctacaggctctgcaagaagcatggcccttcttatgaggggcttttctgctccatctgcatctagtaaggggctcaggctgctttcattcattgtggaaggtgaaggggagctaggatatgcagagatcacatggcaagagaggaagcgagagaggaggggcatgccaggttctttttaacaaccagctctcatgaaactaataaaagtgaaaactcactcattaccccaaggaaggcaccaagccattcatgagggatctggccccagggcccaaacacctcccctttggccctacctccaacactggggatctgatttcaacatgagatttggaggggtctgacaaaccaaactatatcagtgagactattctgtgctgaaacaggtgagtgaagcccagtgatgtttcttaagaattttaagactcttcagaataattctgaagccactgctctagtttgttttcctaaaacctgtccatcatcagaaatactcatagatctttttatacacagagagctctaagcctcagggattctaatttcaaaaatctgaggtgagactcaagaatatgtttttaacaaggcaaaaccagtttaggatccatagtttatagctctaacttgtaccagtgctttggccagccagtgccagatatgtttttaacaagtcctccaagtgattcttatgcaaatctagtttaggattcatagtttatagccacaacttctaacagtgctttggccatccagtgcacgcctttgctctcaaggggcttgggtgaatgtgcagacagatgaaaatactaggaagcagtacaaatattaatcctaaagtaacaggttgttcataaaagcatcctgaatttaggaataatagctttagataaatatatttgtaaatcctgctgaaacttgaattttaattgcatgtattgaaattttgctgaatgtgaaaaaaattttacttaattgtgatactttaacatcttggtagattctttcaattcattctgttaaaagattaatactttagtcaactatgtggcaattatgtctttcaagcttcattttaaaacttcattttagttttaatttaagtaaaatgttttatttcggttatgtgggagtagtattcagtgtgtggagatttctaagtaattttaattttttactccttcggttcacatgtatttaactttaagattctgacactgtgtttgttcttttctgtaactctggggcgtatgaagtgaatatatctgtttctcttcttttttctttttctttgatttctgtagcctacttgggcccatgaactaactacttcatggttctgcctgcacattgactcacctgtcttccgttgattgaattccttcaatctttgtaaaattctctgtggaggtaggcttttccttttttttttttttttcaatacatacattcatatataaagactagagtataatacgtaactaactctctcccaacagtttgttggactgtcataaaggattattatgctcagattgaattcattggtaagagaaagagctatcatgagtttttatgaaataacttcttcatttatttgctggtggtaaagggtaaagagaaattttcatctttataaaagtaaaggatttcttcacatgaaattctactttagattttatggagcgtttggggtctatcaggacttttcatgggagctgaggtggaatgtaaagaaccttattctctctagccttcgtttgtcatctgtaaaatggcaatgataacacttccttcttggaattgttctgagagtgaaataaaataatgtatatgaaatgtcaagtccttggcaaatgagtgctccctggggcaaaaatgcccactggggcaaaaatccctaaagattgcagggtgttgtacacactactatctcagaaatagttggttcgttgccattcttttggaatacttctcatgctctgatactaaacccacagctcccctccactggcttccatgtcactgtcaactggagagagtgagagtcctagaactctgcatacctctggccgaaccacaactccctagtcgttgatccctactactcactggattgtcaccattatttgccttgagaccatttggattatgacattataccatctatctcaatttgtgttagtcatttcaagtatattaggttatctttcatttctcagactcatcccatatggctgtcatctgtttctgacctcgtcttccactgctctctaactcctgaaacccttccactgtgctctctggaactcacagtcaatcatcagcaaaactcacatgtctctaattctcttctgaacatttctgtctgtttcttacactacgagaacctcctctgaggcttccctgtagttctctcaagtggtcagtcttttctctttatgtctctcatactaatttgaagatggtataggtgtcctgtttgtcccacatttctgcttctcaaccatcttcctctccttgaaccccccagcttttaatctcatgaatgtataccatctacggctctccttactattgtcatctatagactcctagaccatttcctgtcatttcatgaaagttttagctaaattttagcttctactcaccttttagttctcttcagtattacccctgttataattctggatgatttcaatatgcatgtagctaatccttctaatgctttcagttcctgaacctcttcttctctaatgatcatattctctacctacactggccacttattttctcctatggtcataccactgatcttgtcattaccaaaatagcatttgttagtatctgcccatctgccaccaccatctcctttgtttctaactcaccctctcaagtacttcaactctgacagttttcacccctaccaagacttctatcaattcattgattctaccacctttgcactgaccccccacactcattcttacttccctctttatccagttgaggttttgtagtatgttatttaatcccttgcctatcccttgaaccatcatatttccctggtaaaattccaaccatagttaaatataactctgcctgcttcacatttgcacccatgcatttgaatcttcctgaggaaaagcacaaccatgcagactgatatcactataattcaacgtctagtgtacctatgatgctatcacacaattctggttcacttctttggttcatcacttcatttagctcattcatctgctatctaggagattgcttttttatatcttctcctgtcaaaccttcgacacttttttctttgatttcacccataactgatattcttcgctttctgtttcactgaaaaaatagaagcaatcataaaagaattttataagctcttgccaccacttatttatctgtgcctatatactctgttccttgggatgaattctttgtgtttatttctaaggcctaccccccaacttgtgctatgatcccacctgctcttgcctacatcactccagccactttctcccttctttcttatttcttggcccttttctaccatttccttcctatcattttacaaatagtctaatttctgtcatcataaaaatctcttttactttgcatcttttgaatatgcctcatgtcttcatgacagcactccttaaaataattgtctaaaccaggccaggtgtggtgtctcatgcccgtaatcctagcacttcgggaggcagacccaggaggatcacttgaagtcaggagtttgagaccagcctgggcaacatggtgaaaccccatctctacaaaaaaaaatacaaaaatttgtgtgaggtgacatgagcctgtagtcctagctactggggcagctgaggcaggagaatcacttgagccagggaggcagaggttgcagtgagctgagatcatgctgttgcacttcagcctgggggacgggagtgaaaccctgtctccaaaaagaaaaagaattatctaaaccagatgtctccagttcctctcctcccactcctatcaggcttttccactgaaactgttgtagcagtgacttccacattgctaaatccaatgatcagttctcagtcagcagcatgtgacagagctgataactccttgctctctgaaagacaagtcacgctttcctagttcttcctgtttcatcaaacactccttttctcttctgttgaattctcttaatctccccatcctctaaacattggtgtacccctgggactattcctctgatctcttttcttttcccttcttttcttttttttttgagacagagtctcactctgtcacccaggctggaatgcaatggtgtgattttggctcactgtaacctccgtcctgcagggttcaagcgattctcctgcctcagccgtctgagtaggtgggattatagatgtgtgccaccacacccagataagttttgtatttttagtagaaacagggttttgccatgttggccaggctggtctcaaacttctggcttcaagtgatccacccaccttgtcctcccaaagtgctgggattacaggtgtgagtgatctcttttcttttacactcattatcgggctcatggtgattctgaaatttatatccctggcctggaactctcccctgaatttcagtctcatctccagctgcctccgtgacatctccacttggatgtctaacagctcagatttgtaaaactccccatctttatactaccaatctacactttctactgttcccatctaagtaaatggtaatgtctttcttctaattgcttaggccaaagatctttaagttattctgtatctcccctttttcccctcatcctgcatgttcagtccatgccatactgttcccttcacttcaaaaaaaattttttttcgagatagtgtcttgctgtgtggcccaggctggaatgtagtggcgtgaacatagctcactgcagcctcgacctcctgcctcagcctcccgggtagctggtaatcacaggcacacatcaccatgcacgtcaccacacctaactaacctcagcctcctgagcagctggtactacaggctatgtgcgtcaccacacctggctcattttttaattttttgcagagatgggctcttaccacgatgcctaggctgttttccaacaccagctcaagcaatcctcctgccttgacctcccagagtgcttgggattacaggcatgagccatcgtgcctggccaaaaaattaataatctgataattttctcatttaattgctaccacccatcttcagttactattaccaccatcaaaagtaatagtttatctttttgtttttacttccactcttacttcctgcagtctattcttaacaaaacaaccataatgatctgttaatgtaagttaggtcatagcattcctttgctcaaaatcctccagttgcttcccagttcaatcaaagtaaaagcaaaaatcattacaaagtccaacacaagtcttctgccctttttatctccttgatttatcttccagtactccctcactggtttcagtcacacttttaatttttatcttatgtaacatatacttatatagcacttagcatcattctaaggactttatgaatatgaatattcatttaatcttcataataatattatgaggtacgtatcaatattatttccattttttgaaatgaggtaactgtggcacagagaggttaaagtaacttgtccaagagaggtgaaagtaacttcccagttaggaagtataggagccaggattcaaacccacacagtctggctctaaaattgtgctcactcttccccagtcgtgctgggtagtctcctgcttccatacctttgtgctttctgtgctcttcttggacgtttcttcccccagtttcccacatgactttgctcactcatcaccttcaaggctttgacaaatcttacctcttctgtgaggtctttttatacaatctcatttaaaattacaaacagcaacggttgatctacagtgtcatcaaggaaggaggatctacctttctgttccattattcttgtgtgtgccttccccatccttgaggtctaggacgacttgtggagtgcagacatcgcatccgtgttctagagagcagaaagagagaaagggatgcctaccagctgaatctcacttaagactccattttcttgttgccagaacttaatatgcccgatggccatactaaattgcatagggacctagaaaatgtagcgtttattaaaggtggcaatgagcccaactaaaagtcagggttctgttactcaggtagaagaagggaagagacaaccagcagtctctaccccaccagggttccatctttatccgtacttgtactttactatctttgaataacattataaacttttatagcttagctaccaaaaataggttgacgactctcatccatgctgccgaaacatatcagctacctctgatattggagatctccatttagatgttccagaggctttgtgagctcaacgtgtttaaaattaaacttatctttcatctttaatggctcaaatgtgctcctcttcctgtaccgtacctccgtgaatggtaccaccagtttatatctccttcacctcgtacattcacccagttataaattaattttgtaaatatttctcggatctgcctaattctccttccttattgctactgtgtagatcacgccataacccctccccaggattacagtagagttaaatcataacaggtatttaagttcatgtcattttaattcatacagttcaaaagtggggaagaaaataactttaaatagtgctgggtaatcctgcctgtattctactcagtgaacatatattcatctggggactgagtgtgaggtgggaaatataataatgttgctccctctgttatattttttttctttaaagataacttttttttttttaagacaaagtctcgctctgttgtccaggatggagtgcagtggcgcgatctagccaaaccgcaacctccgcctcctgggttcaagcaattctcatgtctcagccctctggcatcttaagagacttcctatgagttcctgcctccaaacttttttttttttttttgaggcagtcttgctctgtcgcccaggctggaatgcagtggtggatctttgctcgctgcaacctctgcctcccgggttcaagtgattctcctgcctcagcctcccaagtagctgggattacaggcacccaccaccacatccggctgatttttgtattttttagtagagacggggttttacagcgttggccaggctggtatagaactcctgacttcaggtgatctgcccacctcggcctcccaaacggttgggattacaggcgtgagccaccgcacctggccagataacattttttagcatactgtcttcatggtgctgttttaagagatttgcatgtattattctcacaatagcaatgtgaggtagaaattgttacatccactttagagataggaaactgaggcactgagtgattaactagcttgcttaaggttgcacagctagctagttagaagagctaatattcgatttaggcaagctaactccagagtccactttcataacactgtgctgccatttccccactattataggaacctggaagcttattttctggagaaggtaaactaaaaggactcagcaatcatagatattaggtgtagttaaggccaagatcaccttactgaaaacagggagattaagtgaaagtctactaactgaaggagagtcccagttagtaggagttctgagactgctggcagcaagtcttctactttcacttaagggattggaggaatattttcaacagaatttctcctgcccaagagaaaagacctacaggtaaaaatagttgagggcccttcaagaaagagctgagtacctcctgtttaatcatcatatagttaagcataccactcaataagcctcttctgtgtacacagagcttgtatttagtcttttaatgcatcacacttacgtcaagaaatagccaagtatcaccagatatttcaggaaaacctttaatgtgaaagatatatactaaaacagccacatacacacacacaagccaataatgagatacctctacacatgtattagaatgacaaaaatctgaaacactgacaataccaaatactggcgaggatgtgggacaacaggaactctcattcattgctggtgggaataagaaatggtacagctactttggaatacagtttggcagttttttaaccaaactaaatataatctcatcataggatccatcagtagtgctccttggtatttacccaaatgagttcaagacatatttctacacaaaaacctccataaagatgttaataacagccttatatttaccaaaatctggaagcaactaaaatgttcctcagaagtgaaagaattttaaaaactgatatatttgtacaatgggatattattcagcactaagtagaaatgaggtgccggagccttggctcacgcctgtaatcccagcactttgggaggccaaggcgggcggatcacctgaggttgggagatcgagaccaacctgaccaacatggggaaaccctgtctctactaaaaatacaaaattacctgggcgtggtgctgcatgcctgtaatcccagctactcaggaggctgaggcaggagaatcgcttgaacccgggagttggaggttgcggtgagctgagatcaagccattgcactccagcctgagcaacaagagcaaaactccgtctcagaaaaaaattagctgggcatgatggcgggcacctgtaatcccagctagttgggaggctgaagcaggagaatcgcttgaaccccggaggcggagactgcagtgagctgagatcatgccattgcactccagcctgggcgacaagagcaaaacctcgtctcaaaaaaaaaaaaaaaaatacccagcatggtggctcacgcctgtactcccagcactttgggaggccgaggtgggcggatcacctgaggtcaggagatcaagaccagcctggccaacatggtgaaaccccgtctctactaaaaatacaaaaattagccaagtgtggtgacacacacctgtaatcccagctacttgggaggctgaggcaggagaatcacttcaacccaggtgatggaggttgcagtgagctgaaatcgtgccactgcactccagcctgggcgacagagcaagactccatctcaaaaaaaaaaaaaaaaaaaaaagaagaagaaatgaggcatcaagccatgaaaagtcatggaggaatcttaaatgtatactgtcaagtgaaagaaaccatgtgatccagcaattcctcttctgggtttatacccaaaggaaatgaaattggtaccttgtagagatatctatgctcccatgttcattgcagcattattaacgatagccaagttagagaaacaacctaagtgtcagtaagtgagtatataaaaaattgtgatatgtacgtacagtgcaatattgttcagacttaaggagatcctgccattttcaacaacatgcatagacatggagaacattatgctaaatgaaatgagccagacacagaaggaaaaatactgcatgatctcacattcatgtggaatctaaaaaagtcaaatacatatgaacagagtagaacagtggttatgtgggggatgggaagatgttcatcaaagggtataaagttgcagttatgtagaatgaataagtctacagagctaatgtacagcatgatgactatatgtaatattgtttactgaaaatttgccaagagagtagatttcaggtgcttttaccacaaggaaggaagaaagggaggaggaagggcaagagggaaggaagggagggaggaaagaaaagataactgtgagagggtagatacgttaatttgcttgactctagtaatcatttctctgtgtatatcaaaacatcatgttgtacaccttaaatgtatataataaaacaaaaaaatctgaaaaggctacatactgtatgattccaagtatgtgacattctggaaaaggcaaaactatgcagaaaataaaaaagatcagtggttgccagagtttagcagagggagcgtgaataggcagagcaccctcacctttaggacagtgaaatgaatctgtatgatactataaagtggacacgtgtcattatatatttgtcaaaacccatagaatgtacagcactaaaagtgaaccctataatgtaaattatggactttgtgtgataatgacatgttaatatagatacattgattgtaacaaatgtaccactctggtgcaggatgttgattgtaggggaagctgtgcatgtgttgggggcaggaggtatatgggaactctgtactttctgttcaactttgttgtgaacctaaaactgctcctaaaattattaaagaaaacacaaggaaagaaacagactcagaggaaaagaggaaacagacaatacaagaccagatgaaaacttaaaaagctacatttaataactttagagaactaaaagaagatcctgcattcttgaaacaaaaataaggaattataaaaagggtatattcagaaaaccaaaagtcctagaagtcaaaattagttcaattgttgggttgggagagttacagaagtttcctgggggtggaaaaaaagagaaagcttgaaaatgggagagaaaagataagaaaattagaagatcagtccaggaagtccaacatgcaaataatagaaattctgcaacaagaaaaaagtaaaagggatggtagaaaattattaacaaaataatacaaaaattgatgtaactgaaggaaattagtttcaagattaaaagttttcctcccggtatccagtataatacttgtaagataattgttacccaagacatactgtgaatgatcagaaatccagttatatagataatattctaaaagcttacagagagaaggaacaaacaacacaaaaaaaattcctgcaaagaatcaagaaccacagtagtgaaagtcttcctaggagcaatactgtaaactagatgactataaaacaatgccttcaaaattcctggggggaaatgattttaatatagaattctataactagccaaactgttgcttaagtgtgaagtttgaacaatgacattttcatatatacaaggtctcaaaaatttttattcacccttacttagtgaacaatagagtataccctttaccaaagttagagagtaacaaagaaacaaggaatcaggcacaggaaagaagtggagggaattcccaggacataactaagcagcagatctaagcaccatctacagattggagttgtgaggttttttgtggttttgggagggggtgtttagatgggatctcactctgctgcccaggctggagtgcagtggtgtaatcttggctcactgcaacctccacctcccaggctcaagtgatcctcccacctcagcctcctgagtagcttcccacctcagcctcctgagtagctgggactacaggtgtgcaccaccacacctggctaatttttgtactttttgtagagatggggtttcaccatgttggtcaggctgatctgaaactcctaagctccagcgatttgcccacctcagcttcccaaagtactgggattatagatgtgagccactgcctggctggagttgttcttttcacaaaggcacagtcctcgctccaggtcatgcctgccctctggattgtgttcaggatggaaactcttttcttattcctctgagtaaagggattgtctttctcatttgtcggtctaactcttaatttgtgttaacagtgcttgagtagattagcagtcaggccgggctgttaaaaaagtcagaataaaatagggattgaaccaaggtagtaataaggtgaataaaagaaagaaacaggttaacaaatggtggggtgcagcagagttccagttgagaggagctgatatctgagtaaatgtggacaataaaggagaagtagatgtctggtgtatctcccaggtttccggcttgagccactggattaatgatagtgtcatcaatgaagataggaacacagtaggaggaggttgttcaaaataaaaatgagttcagttttagacttatatgtaggtggacaaggcttagaactgaagcacaggctagaaattcattcattcaatactcttgtctactaataagaaagagataaataagagccagttacttccctgaaaaagctcatagtctaataggggaaacaaatacataagcaaataatttatatctagtatgataaatttaacagtttaaatatgtataaggcatagtgatatcttagaagagagagtgactttgatatgggcaggaggcagggaaatactgggtagaagagggtggttccccagcaaaggcccccaccccccaagcctggaaacccatggccctaattgggaacaggcatttctgttttcatgtccaaatgttgccttctgcctgccatccccgcatcctgtacccatataaaccccaaattccaggtccacaggcaggagagcagacaaacagaggagcagaagaggagcacagtaaaggagagaagagaaggagtgtttgaacgtcaaggagaggtcggttggggacagctggagaggagattggccatgggacagcagaactccaggggaagatcatcttcccactccatcccctttccagctccccatccatctcactgagagccacctccatcacctaatacaattcccacattcaccatccttcaaatccgtctgtgacctgattcttcctggacacaggaaaagaatctgggtacgaagagggcactgggctggttaatacttaagcaatctgtggaaggcagagctaaaagagcactgtagcatgcccactggggcttcaggagttgcaggcatgtattcctagatgctgctgtggggctggagcccaaaagcgctctccccgccccctacacctgccggtctgcgagctccgcctcctgtaaggggtttgagagtgcagcagccgaacagaacagacaagccacagccctgtcgcaggccctgcccttcgtgggggatcaggggactctcccgtttcaactttcccttagttggagggtgagggtcagtaaatgttcatggacaactaagctgaaaaggaatttgactagcagacaaggcaagagagaatattccagcatgtgcaaggatacaaagccatatactacctattgtattcaaagtaccaaaaatagtttactgttattagtagtacataaagtacaaaggagaaaattaaactggagagttagacaagtctcagatcccaaggaatttgtagtttttgctgaagcagtgagaagccactgaggttgttgaaaaagagtcaaagtagatactggaatccactgttggttgcttccaaaaagaattttggtcctttctagtgcccagaacataatctctttctctggcaaagaaaacgtagtcttctgtcttccttttcctaaagaaggttacaattattttatgaagattgtaattttgagtaatgataatggaataaagaaggagtgaaatggcctttgtgtgctcctcattttttttcttttttaaggcaaaaaggttttaaaaccctctggagcactgattctgaataccttctttttataacattttctaaatgctccctttactatatgaaatgaaattcccataggtattataccctactgcagtgagctgagtaatgcttcccgaaaaggtagccacatcctagtccctgaaacctgtaattgttaccttatatggcaaaaaagaactttgcagatgtgactgagttaagatgttgagatggagagattatcctggtggactctaaattcagtcacatgtatcatggagggaatatcatagaggagatgcaggcaacatgacctctgaggcagagattggaatgacatgaccacaaatcaaggcatgccagcagctaccagagactgcaagaggcaaggaatggattctttctagagctttcagaagagtggccctgtggacaccttgatttagacatcgtgaaactggttttggatttctggactttagaactgagaaagaataaatttctgttgttttaagccatgaagtttgtgataatttcttacagcagccttaggaaactaatacactacttacataatataatgccataacaatgaaataaagaagacacaaaaagtaaatgttagtgatgtgactttccatttaggaaacaattttttgcaaagttccaaacaaaacaaattatagtcttttctgcatttacatggtaattgtatttctggaaaatttaatatatattcaaaccattaaccaatgtttgtagcatctgccatgtgcttgacacacagagagtatttaataaaagctggatacatgggtgatgaatagatggatgtattaaagctacaaagagagtacataagttccaaaataaacatgcaaggcaaaaattatgtgtagtcaaacgtatctttaaaaattcttgggcaggcccagtggctcacgcctataatcccagcactttgggaggacaaggcaggtggatcacgaggtcaggagttcgtgaccagtagcctgcccaacatggcgaaacccatctctactaaaactacaaaaaattagccgggcgtgatggcgggcgcctgtaatcccagctactcgggagcccgagtcaggagaatcgcttgaacccgagatgcagaggttgcaataagctgagattgccaccactgcattccagcctgggcgacaagagtgaaactccacttccaagggaaaaaaaaaattctttacatagcttatcaaatacagtgttcaatatctacatgacgtactggacactgacacataccatttctcaataaagagctgacagccctctctccccattccctcagcatcgtttgggtatcttatgaaggacatgagttgttttagggatgtaatgaattccattcagcactatgaggtactctcaccgacaatcacagaagaattaaaactgactgaaaggcaatagatatgtttcccatttcaaagctcactgtggacattttcttatggtttggaatggttgtgagctgtccaaactatattttgatgtgtttttcttcttttgatcagggatcatagttcagtaaacccacagttaaactaagtgggctgatcgtatgggtctatctaaagtgaatttgtgtacttgtctcatccttcttattaatgagtggttctaaactggacttggtttttctcccatggggcatttggcaatgtctggaggcatttctgattgtcacagccggggattggggagggcagggtgaggcaaggggctattggcaggtagtgggtaaaggccaggaatgatgctaaacattctgcaatacacaggacagcccccaacaacaaataatgatctgggcccaaaagtagtggcaaggttgagaaaccctggcaacattatgtgtgtgctccccttgtgtagtgattcctttgtagtgtttgccttgacattagattaagtgttcccttaagcagaagctgaattttttgttattgagttgcagtgaaggatgggtgtgaatctctgcagggttaaacatttttacattaacctttcctttttatttttatcaaaagtaatatatggttacatgtatgtgtgcatgtgtgcacacacttatgcagaacttagaacagttccccacccattcttccctagttttatcgcatttcccagagttagcaacatgtaaagagttttgtttttaatttttttggtgattgcctctctaagtctaaataatagcttttggttatctattgatttaagagattatctattgactcttcactgcagaaggttagcaaaagctcagctacactaatccctccccttcttccttctaatattcattagtttatattcgattgtcctttcattgattattttgtaattctaaattaaatacatataaacatttaattttgttccatcaactttagtcagtatctttttatcttctgcctttattatactagcgcttctgttctttcaccttccttattcctatttcctatagtctgtctgctgtacctttacattgtcagattgacaatatttactttctgttttataattatatttgtttgtttttatccataggttgaagccaaaagttgaaaactattaccatttataggatataactgtaaatattgttcactgaagagctaagtagtatactgagatcccagaatcatctctatatatgcaatatcacatcctctgtgccatgagaaagaatgttcctagtattctagcattctgttttctgtgttgagtgttttaaaatcatgccacattcagttggcacactggcatctaaacacatactaagaaagatcagaagtgtcaatgaaattgcatagtgaatattcaaaaaatgaatgacctgcatgggcaaataatacaaaaaaaaaagatcagaggaaaatgatagaaaacacaagaaagacaagaatttcaaaataataagggtacattcccaatggccagctttctgagagttgaactgtatttgaataactcatgtccctcaacccagatccaaagataatattgctgctgctgaaacctgggctctttactatgaccagagtttattaattgtcctatttcattgaggaaaaaatgcaaaacagaacactggaatgactagctggaaatattccactatttcatgggaagcaggtttctaaacgattcctgtggaggccaaactcttgctctcgccaaaatattatagcattaaagtgtgccttgatggtacattaaggaagaaattttccccgaatttacttaagatttatagcctttctgctctcacaaaacgtagcattgatttctttaatatcaaaaaaagtttcctaaaataaactgctaatgattgctttcagtcatttgtttacttgaggtcagtcatgccaagtactgtttgtatcaattcttgtaaaagactcaattaattttgtaattgtcataattactgttattcctgttctgtaggaatatgctattaatgtaactggacatcaccacatcttatttttgtatctctcaaaacatctttcataaaactttgatggtaggaaagagctgaaaaaaaatctcctgttagtagaccaagtagtacttcaattactaaacaccagagaaaattaaaattacaccttaaataaaaccaaccagatatttggtagagaaaatggaactgtacaaaaatatggtttttaaaaataaaattctaccacttgtattatattcattatagactattggaaaccgttccctgccaaaaaaagaaagaaaaagaaaaaagtttgtgaccatttgtaattcattttagtctttttatgtatttttttcacctaaaataatatgggcatttaaatattttaaatatagttttaaatggctacatattattctatcaaaaatacctaccataatttatgtaaccactttctcattgttgagcatttaggttagttttgtttttccagttgaaacaataccccctgagtatctttgcatataatgatttctcttgattttagttttaagacaagctcttaggggtcaaatgttttaaatattttaaaggttcattgttcaaattgcatttcaacagtcaataccagtttacactgttttcagcattttaagaaattgcccaaatgacagagcagaattttaaaagtatttccctagtgttgatttggtttatatgctgagatgctgcagattttttgttgttaaaaagtgagtatgtggagatcaaacatttggctgactgtgtacacattttatttagtaaagcctcaatgttaagcaagaagccattactcatattcatgttgtctcaggaatggaaaagtgcttctaatttttgcaacaaaagaagtctgatggcagtgacagaaaggaatgactagctagatatgctgaccggaaagctagaattaggatttgaccattgtagtcagtctccatttaagagcctaatggttttttcttctcaatttggaagtttgctgcatttagagatattcttataaaactaaaaaaaatagacccagggagcaagtttgaggttactaaaatgtatcccattattgtcagagttgcatttcaaactgtcttcattaaactgttagtttgattacattttctcaaacagtaactgttgtgttttaattttttaaattaaaaataagttttaaatttcaggtaattgaaagaccaattctttttggaatctttcagtattatggttttggttcacagcgaaggtatttgcttgctacatttgctaaatatactatctatacttcattttgttgcataaaaataagacatactccggttagcctttttgatgggtattaccttgatgacttgctcactgacagagaaactgatgtaaaataggtcatttgaaaagcaggtgtttgatatatccccatatgtaacactgaaaagccttcttgctctagatttttggaaggaaagctttcttaagaaagaacggaaaagagagaagaaccaaatagacgcaataaaaaatgataaaggggttatcaccactgatcccacagaaatacaaactaccatcagagaatactacaaacacctctacgcaaataaactagaaaatctagaagaaatggataaattccttgacacatacaccctcccaacactaaaccaggaagaagttgaatctctgaatagaccaataacaggctctgaaattgtggcaataatcaatagcttaccaaccaaaaagaatccaggaccagatggattcgcagccgaattctaccagaggtacaaggaggaactggtaccgttccttctgaaactattccaatcaatagaaaaagagggaatcctccctaactcattgtatgaggccagcatcatcctgataccaaagccaggcagagacacaaccaaaaaagagaattttagaccaatatccttgatgaacatggatgcaaaaatcctcaataaaatactggcaaactgaatccagcagcacatcaaaaagcttatccaccatgatcaagtgggcttcatccctaggatgcaaggctggttcaatatacgcaaatcaataaatgtaatccagcatataaacagaaccaaagacaaaaaccacatgtttatctcaatagatgcagaaaaggcctttgacaaagttcagcccattcatgctaaaaacaataaattaggtattgatgggacgtatctccaaattagaagagctatctatgacaaacccacagccaatatcatactgaatgggcaaaaactggaagcattccctttgaaaactggcacaagacagggatgccctctctcaccactcctattcaacatagtgttggaagttctggccagggcaatcatgcaggagaaggaaataaaggatattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaagtacctaggaatccaacttagaagggatgtgaaggacctcttcaaggagaactacaaaccactgcttaatgaaataaaagaagatacaaagaaatggaagaacattccatgctcatgggtaggaagaatcaatatcatgaaaatcgccatactgcccaaggtaatttatagattcaatgccatccccatcaagctaccaatgactttcttcacagagttggaaaaaactaaagttcatatggaaccaaaaaagagcccgcattgccaagtcaatcctaagccaaaagaacaaagctggaggcatcacgctacctgacttcaaactatactacaaggctacagtaaccaaaacagcatggtactggtaccaaaacagagatatagatcaatggaacagaacagagccctcagaaataatgccgcatatctacacctatctgatctttgacaaacctgagaaaaacaagcaatggggaagggattccctatttaataaatggtgctgggaaaactggctagccatatgtagaaagctgaaactggatcccttccttacaccttatacaaaaattaattcaagatggattaaagacttaaacattagatctaaaaccataaaaaccctagaagaaaacttaggcattaccattgaggacataggcatgggcaaggacttcgtgtctaaaacatcaaaagcaatggcaacaaaagccaaaattgacaaatgagatctaattaaactaaagagcttcttcacagcaaaagaaactaccatcagagtgaacaggcaacctacaaaatgggagaaaattttcacaacctactcatctgacaaagggctaatatctagaatctacaatgaactcaaacaaatttacaggaaaaaaacaaccccatcaaaaagtgggcgaaggacatgaacagatacttctcaaaagaagacatttatgcagccaaaaaacacatgaaaaaatgctcaccatcactggccatcagagaaatgcaaatcaaaaccacaatgagataccatctcacaccagttagaatggcagtcattaaaaagtcaggaaacaacaggtgctggagaggatgtggagaaatagaaacacttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacatatgtttattgcggcactattcacaatagcaaagacttggaaccaagccaaatgtccaacaatgatagagtggattaagaaaatgtggcacatatacaccatggaatactatgcagccataaaaaatgatgagttcatgtcctttgtagggacatggatgaaattggaaatcatcattctcagcaaactatcccaaggacaaaaaaccaaacaccacatgttcttactcataggtgggaattgaacaatgagaacacatggacgcaggaaggggaacatcacactctgaggactgttgtggggtgggaggaagggagagggatagcattaggagatatacctaatgctaaatgacgagttaatgggtgcagcacaccagcgtggcacatgtatacatatgtatctaaccttcacattgtgcacatgtaccctaaaactttaataataataaaataaaataaaataaaagaacagaccagatgcagtggctcacaccagtaatcccagcactttgtgaggccaaggtaggaggatggcttgagtccaagagtttgagattaacctgggcaacatagtgaaaccctgcctatacaaaaagtaaaaaatgaaaagttagcctgggcctggtgtatttgcatgtgcctgtggtcccagcaactccaggggctgaggcaggaggattgcttgagcccagtagttcaaggctgcagtgagctgtgattgtgccagtgcactctagcttgggttacagagtaagaccctgtctcaaaaaaataagaatgtacatatttaattgtaatatgaaacggatgctgaaaatgaacaccgatataagtgacatatcagagatgctctggagacttggttcatataatatggaacaaaattaccttctcaatgccaaattagaaaatgatatgtacataattttcaggtttaaaatatatataccaaggctttgggatgttaaatataaggaatgttgcccatgtataacattatcaattaagcttaagaatattaaagatttgttgattaaaataattactaatttttgtgatagcttttactttagaatatgtgatttgaaaaaaaagaatgttgacatttcacatagttggaaaaaattctagttcttagttttgtaacttaattttatgttctaaaatatgtctcaaatccacccttgtaaaattattagtcttttattattaaagcataaagtttgctactcataaatcaaattatatatctcaaattcaaagctaaattgcccttgtgcattgtttagcagtatgtaaatacattttagaaaagggctgtatcattcatgaagtttccaaattcgttgatcaattctgataataaagttaaaatttttgttcttaattagtagatctcattattttttcagcattccactgacttctttctaactttgtagtaatgataggtaaagactgtatctggcttaaaaaatgcttatttttacatacatgtaggtctttgattatgaaagtaccgaggagttcttttgtttatacagtggcagttgaaagaaaacccatgtatatcttgagaagatttattggaactagctttgagaaatgatgagccatatctttaactcaataaaagatatgtattgctgtaccaagccttggtatctgctattctctttagtgtaagcacttttcaaactataggattatacaaatagtagcatcactagttaaaacataaagctatatgatctaaagacatagttttggttattttttgagccatttaattttcatcttttctgtgaccacatttattaaacatgtgacatgaaaatggaatactcttttatgatgacaaaagaaagtatatgcccagccaattatgggataagagtattattttttgtgaacacattatcatcattctagacacctggagaagtgaatatctctgaaagtatcatacatttatactttaactttatttacatatccagttttcagaaaccattgccaatgaaacatttggacaatgtggtatgcaagtactgtatagtaagaagtagggatgttcttgagtaattgttccatttgaattaatccagcatgggtagttgttagacaaccatgaaatgtgctaagctttacctattctaagaggactctattcttacagaccataagcgttcaaaagttttccaagaaaaaaaggttacttctttaaatttagtctgcccattcaaaagctacaataaggcaggtggattaaactgctaggagttgcaatgttagtattgagagcatttaagcaatttaaaatctttcagaatgcctaagatcacaaatttacccctgatcagcctacacagattaacttaaaatacatacagagagatgtcagatagctagagggtcataaattagtgaccaaaattacatcaatctgcatgttgacattgtttaccttatattgattagaaacttttgcttaggaaaaaggggaaataacttttattttaaattatactttaagttctagggtacatgtacacaacgtgcaggtttgttacatatggatacatgtgccatgttggcgtgccgcacccattaactcatcatttagcattaggtatatctcctaatgctatccctccccctcccccaccccacagcagggatgtgtgatattccccttcctgtgcccatgtgttctcattgttcaactcccacctatgagtgagaacatgtggtgtttggttttttgtccttgggatagtttgctgagaatgatggtttccaatttcatccatgtccctacaaaggacatgcactcatcattttttatggctgcatagtattccatggtgtatatgtgccacattttcttaatccagtctatcattgttggacatttaggttggttccaagtctttgctattgtgaatagtgccacagtaaacatacgtgtgcctttgtctttatagaagcatgatttatgttcctttgggtatatacccagtaatgggatggctgggtcaaatggtatttctagttctagatccctgaggaatcaccacactgacttccacaatggttgaactagtttacagtcccaccaacagtgtaaaagtgttcctatttttccacatcctctccagcacctgttgtttcctaactttttaatgattgccattctaactggtgtgagatggtatctcactgtggttttgatttgcatttctctgatggccagtgatgatgagcattttttcatgtgttttttggctgcataaatgtcttcttttgagaagtgtctgttcatatccttcgcccacttgttgatgcggttgtttttttcttgtaaatttgtttgagttcattgtagattctggatattagccctttgtcagaagagtaggttgcaaaaattttctcccattttgtaggttgcctgttcactctgatggtagtttcttttgctgtgcagaagctctttagtttaattagatcccatttgtcaattttggcttttgctgccattgcttttggtgttttagacacgaagtccttaacagcccatgcctatgtcctgaatggtattgcctaggttttcttctatggtttttatggttttaggtctaacatttaagtctttaatccatcttgaattaatttttgtataaagcgtaaggaagggatccaagttcacctttctacatatggctagccagttttcccagcaccatttattaaatagggaatcctttccccatttcctgtttttctcaggtttgtcaaagttcagatagttgtagatatgcgacattatttctgagggctctgttgtgttccattggtatatatatctgttttggtaccagtaccgtgctgttttggttactgtagcctcgtagtatagtttgaagtcaggtagcgtgatgcctccagctttgttcttttggcttaggattgatttggcaatgcgggctctttttcagttccatatgaactttaaagtagttttttccaattctgtgaagaaagtcattggtagctcgttggggatggcattgaatctataaattaccttgggcagtatggccattttcacgacattgattcttcctacccatgcgcatggaatgttcttccatttgtttgtatcttcttttatttcattgagcagtggtttgtagttcttgaagaggtccttcacatcccttctaagttggattcctaggtattttattctctttgaagcaatggtcaatgggaattcactcatgatttggctctctgtttgtctgttattggtatataggaatgcatgtgatttttacacattgattttgtatcctgagactttgctgaagttgcctatcagcttaaggagattttgggccgagatggtggggttttcgagatatacaatcatgtcatctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaatgggctgttgaattttgccaaaggccttttctgcatctattgagataatcatgtggtttttgtctttggctctgtttatatgctggattacatttattgatttgcgtatgttgaaccagccttccatcccagggatgaagccgacttgattatggtggataagctttttgatgtgctgctggattcagtttgccagtattttattgaggatttttgcatcgatgttcatcagggatattggtctaaaattctctttttttggttgtgtctctgccagactttggtatcaggataatgctggcctcatacaatgagttagggaggattccctctttttctattgattggaatagtttcagaaggaatggtaccagctcctccttgtacctctggtaaaattcggctgtgattgcatctggtcctggactttttttggttggtaggctattaattattgcctcaatttcagagcctgttattggtctattcagagattcaacttcttcctggtttagtgttgggagggtgtatgtgtcaaggaatttatccatttcttctagattttctagtttatttgcatagaggtgtttatagtattctctgattgtagtttgtatttctgtgggatcggtggtgatatcccctttatcattttttattgcatctatttgattcttctctcttttcttctgtattagtcttgctagcggtctatcaattttgttgatctgttcaaaaaagcagcttctggattcattgatttttttgcagggttttttgtgtctctatttccttcagttctgctctgatcttagttatttcttgccttctgctagcttttgaatgtgtttgctcttgcttctctagttcttttattgtgatgttagggtgtcaattttagatctttcctgctttctcttgtgggcattttgtcctataaagttccctctacacactgctttgaatgtgtcccagagattctggtatgttgtgtctttgttcttgttgatttgaaagaatgtctttatttctgccttcatttcattatttacccagtagtcattcaggagcaggttgttcagttgccatgtagttgagcggtgttgagttagtttcttaatcctgagttctagtttgattgcactgtggtctgagagacagtttgttatcatttctgctcttttacatttgctgaagagtgctttacttccaactatgtggtcagttttggaataggtgtggtgtggtgctgaaaagaatgtgtattctgttgatttgggttggagagttctgtagatgtctattaggtccacttggtgcagagctgagttcaattcctggagatccttgttaactttctgtctcgtggatctgtctaatgttaacagtggggtgttaaagtctcccattattattgtgtgggagtctaagtctctttgtaggtctctaaggacttgctttatgaatctgggtgctcctgtattgggtgcatatatatttaggatagttagctcttcttgttgaattgatccctttaccattatgtaatggccttctttgtctctttttatctttgttggtttaaagtctattttatcagagactaggattgcaacccctgcctttttttgttttccgtttgcttggtagatcttcctccatccctttattttgagcctatgtgtgtctctgcacatgagatgggtctgctgaatacagcacactgatgggtcttgactctttatccaatttgccagtctgtgtcttttaattggagtatttagcccatatacatttaaggttagtattgttatgtgtgaatttgatcctgtcgttatgatgttagctggttattttgctcgttagttgatgcagtttcttcctagccttgatggtcttcacaatttggcatgtttttgcagtgactggtactggttgttcctttccatgtttagtgcttccttcaggagctcttgtagggcgggtctggtgatgacaaaatctctcagcatttgcttgtctgtaaaggattttatttctccttcacttatgaagcttagtttggctggatattaaattctgggttgaaaattcttttctttaagaatgttgaatattggcccccaatgtcttctggcttgtgaagtttctgccaagagatcagctgttagtctgatgggcttcccattgtgggtaacccgactttctctctggctgcccttaacattttttccttcatttcaactttggtgaatctgacaattatatgttttggagttgctcttctcgtggagtatgttagtggcgttctctgtatttcctgaatgtgaatgttggcctgccttgctaggctggggaagttctcctggataatatgctgcagagtgttttccaacttagttccattctccctatcactttcaggtacaccaatcagacgtagatttggtcttttcacatagtcccatatttcttggaggctttgttcatttctttttattcttttttctctaaacttctcttctcgcttcatttcattcatttgatctttcatcactgatagcctttcttccagttgattgaatcggctactgaggcttgtgcattcatcacgtagttctcgtgccgtggttttcagctccatcaggtcctttagggacttctctgcattggttattctagttagccattcgtctaattttttttcaaggtttttaacttctttgccatgggttcgaacttcctcctttagcttggagtagtttgatcttctgaagccttcttctctcaactcgtcaaagtcattctccatccagctttgttccattgatggtgaggagctgctttcctttggaggaacagaggtgctctgatttttagagtttccagtttttctgctctgttttttccccatctttgttgttttatctacctttggtctttgatgatggtgacgtacaggtggggttttggtgtggatgtcctttctgtttgttagttttccttctaacagttaggaccctcagctgcaggtctgttggagtttactggaagtccactccagaccctttttgtctgggtatcagcagcagaggctgcagaacagcggatattggtgaacagcaaatgttgctgcctgatcgttcctctggaagttttgtctcagaggagtacccggccgtgtgaggtgtcagtctgcccctacaggggggtgcctcccagttaggctcctcgggggtcagggacccacttgaggaggcattctgtcccttctcagatctccagctgcgtgctgggagaaccactactctcatcaaagctgtcagacagagacatttaagtctggacaggtttctctgccttttgtttggctatgccctgcccctagaggtggagtctacagaggcacgcagggctccttgagctgtggtgggctccacccagttcgagcttccagtccactttctttacctattgaagcctcggcaatggcagcgcccatcccccagcctcgctgcagccttgcagtttgatctcagactgctgtgctagcaatgagcgaggctccgtgggcataggaccctccgagccaggtgcgggatataatctcctggtgtaccatttgctaagaccattggaaaagcgcagtattagggtgggagtgacccgattttccaggtgccggctgtcatccctttctttgactaggaaagggaattccctgaccccttgcacttcccaggtgaggtgatgcctcaccctgcttcggctcatgctcggttcactgcacccactgtcctgcacccactgtccaacactccccagtgagatgaacccggtacctcagttggaaatgcagaaatcacccatcttctgtgtccggaaataacttttaatatgtacagcttgagagaaagaatctttcagaaatgagatagagaaacataataaaagaatccttggtgattttcttaaaaagtaaaaaccgtcactactgagaaaaagacatgttttacaaagacatctgaaaatcataggtattgtggcttatgttttgggatggaaatgaaagatttgatgaaaattaccagagatttttacataaaacagctgattaaagccaaccatcctttttagtgttgcctttatttgaggatgttagggagaattttctcattttgtgtttagtcctgattggcctggatcataagaattatactgtatttagtttgtagtaggacctgctcttctctttaggacctgacacataaatagttttgtgtaaaagtgaacattgtaatttctcttaacagctgtaacatcttatgaagatcttggactctttgcatttggattacctggaaaggtaattttttttcctcctcattgtgtccaaaacccaaagtggcatttttccttttgtttcaagttaaaagagacaagtatatacaagaggaagacattagaggaataaaaggaaactaaagtgagaaaagagagaatgataggagcaggcaaagaaagagaagtctttgtgtccttcctaaaaatgcatcaatacatttaattcaatgcttgaatcttttaatatttttcatcctaataaagtagcacaatgacttgaatgactttaaaagagtaacgatgacctgttttaagttgtattaattttgattatgtactcatatgagtaaaccctcataaagacaagaaaagaaaagcaacatcgaattcaaattgtagcatggctatttacaaaaccagtaatcagaagatcatatcacttaagaattgaacattgctacaagattatctagctatcctctcatttataggtgaggaaattaaggaccagagaaattaagggacctatttgtcaactattatataaagccagtaccacatcctagaactctagatctactgcttttcttactcagaataagagaaataacagcagtatttatggggcacccacttgcaatagggatactacactagtttaataggtagagaaaaataattgtcttccaccagtaatcaggagttgaacgttactgttagtgctatagtatatatattttttaatttctgaagaactactatacttctaaaattcatattcattttggctccaaacaggaattcttttgtttgtaaatctgttgtttgtgtttttatgttttcgattgacaaatacaaattgtatatatttattatggacaacatgtcattttgaaatatgtaaacattgtagaatggctaaattgacctaattaatatttgcattacttcacatacttaccattttttgttttatttttattctaaaaggatactctatctgtaactggctaaactaacttctgaaagtgagtctggaggaaatatatatagctatacaatggaaagaaaacctgtatttacattccagttaactttggtggagttttttgtttttgttttttcagacagagtttcgctcttgttgcccaggctggagtgaaatggcatgatctcagctcaccacaacctccgcctccctggttcaagcgattctcctgcctcagcctcctaagtagctaggattacaggcatgtgtcaccaggcctggctaattttgtatttttagtagagacagatttctctatgttggtcaggctggtctgggcctcccgacctcaggtgatccacctgcctcggcctcccaacgtgctgggattacagcgttagccaccgcgcccggccctaactttgtttttaaagtacaaaaaggaatgcttaaatcatatactatatagcatcatggcttggaccttagtcacctgaaacttaaacaaaacagaatatgttacttgagggtaaaaggttttgttaatcttccttagtagcaatgtttctgttctagaggattaggatgtttggtgtagccagggatcagtttcctccatctagtttaaacaaagaagaaaatattttttgtatgagaaaattccacaattaatataacataacctataaacataactctaagtatcaacactgacatcactgtcatttcatgttcatatttcctgcgttgcttgtatagcagcaaagtttaaagagtagggactgctgagagtcttcttttcctaaacctcttagagtagttgtgttgtcattttaatacatgcaccaaaaaagttcatagtaggcaggaacactagacaaagcatactctgaatgaggagttgttgtttggttgcttgtttaaattttctccacacttccacagttgggttgaaacttaaccatttccttctatccagatgttatatagttataatatgggataatattatgataaagaaattttttgaaatgttttgaacttgttaaagatttatttcaatgtctataaattggtatttattcaccagacaaatatttattgatcaaatactttgtaccatgtactgtgctaggcattaaaaatataagtaggtaggcaggtgggtagatagatagatattctagctttcaagatattaaatgcttaaattcagccaaagaatgaaagaataatcatcaataagttaatattactgttttttgcaatatattaattgaaaataaaaccaaatttcatgtatacctactactgacagtaggtatcatttgtactgaagatagtatacacaagttcaaaatagtcttttcacaaataacttcgacattttggaactaagttttacataggctgaaatgcagaattttttctggagagcgttcaagtggcaatcaccacatctccaaagacactttgccagattttcatatcattagccctcctctgcaaacctcaaggctcctaggtcctaataacttagattgttttcagtgtaggcaaatgctgtgccactgatagaattcctaacaaagatgggcatgaaagattatctgttcccaattcatgtagaactgaatgattctagacagctagtcagctccaggcatacgttggggttccgatccattaagacttgagtgattgaaaggcccacatggaagcacagtgttttactgtttcctctaagcatatctgattaccttgagttccccaggaatctcatcaaagatgataagctaacaagcctacagactgaatttagtcctcaggcacattttatatggctcaaatattttttatttttaactgattaccaactaagcatcattaaagtatgaaaaaatttcatttctgactttctttgaaaaatcagatctggctacattggatccacattctcacatattatcaactggccagagctgagtagcacctgccccattgaagggggaggaattctccaatatcctacagttcttgccaactcccattgtcttatattcagcttaattcacattattgagtttggaacattttgcctatattttcagggtttgagagtaattgggctctagactttattaatctctgggactgggatgctcaaagtctgggatgctgatatagtcagaaaacttatatcatttccttttaggcaatatagcattggcatagcacacccagccggtctttttctacttatttaagcagtgtgataaaaccagcaagaagggaatgagacaccactcccacacttttaatttttatacttgataatcatcgattactagcttttaacacttttaacaatttaaaagtgactgccaagaaaaatttcaaaaacttctttatagtaactttggaactattaaagaaatactttttaatgtgatgattattaattttatgtatttcaaatgactggcagatttctttttagtttctcctcacaacttctgcatctgcttttttagtaatagttactggattttaataaaatactgatccttttatattgtttccccttctatcttctgaatatttctgttcttttacagttggtggtggcaggcaccataataattcagaatattggaggtaagcaattgcaagtgcactgtttatacataaatgtgatggcaataatgtcctttgaattgttatcttactacagatctagctgggaacttctgtagacatagctatcttcagaagcctgtgtgttggcctctttactctttttttttttggatcctttttagcagcacttgtgacagtagcttctaaattcagtttgagctaaaccctgattgcagtcgtgttattaggtctgcaacacacctctaaaacattggctttctgtgattctgaaggtaggatacagtctggaaaagctctcctggtgattttaaaatattttccctctacttttgttctaatcaccctattggcagatactactttagagggattagtgttccgtgggctgtgaacaagcaagtatggacaacagtgtcctcttgtaaccaagaatttaaaatgaccaagtggtttaaaacataaataaatctgagataaataagcattctcacatttatcctgtatcttgttcctattaataaccaattctagaaatgatctcaatattgagaactatgtagaaataaaactactgttaattatagacagttactgagtaaatgtattaaacatttaaatccaaaatatgggtatcatgtgtgtatatgttgtaaagaagttgcgtagtgctgaacaatatcttcgttttcttttatcattgactggagtgctaaataaatgctcttaaaggaaaatacacagaaaagtttgacatgtactttggatcttatacaggattgtatagtcagaggacattttaatcttattttttacatgtaacagtttaattcaaagatgacagttttaataaacttcagctctcataatcaagaggtctgagctatatcactttaagtattgttcaatcaaattccatcgttaataggtttttttggttaaggaaaaattgacattccaccagtgaattgtgctgccattgttttagaatcctgttttaattctttgaattttcatgaaaaaatatgaataaaaagaatgctttcttgcatgccataccaaataattttctcctaacacacactacttcacacttcacagtagaaagtcaagaaaaccagtctcttcatttatgaatttattatagtcattgattttaagatctattttggaataatttatttagcaactaagtattgcttaactgtgcactgataatgtttctgaatatgatgtatatttttatatttttaatccctctttatcctctctgtatagattctaagaactatcacatattgtttaggttagattgaaccattgtttaacagtttatgtagactgttcagttcagcaatttagatccaaatttgtgaccctggcacaaggcccactgttgtattctttgtccctttcaccttgattccttccttgttctctaatcttgtttataactgttattggagatggctatactgtagcacttggctgctactagatttaacttctctgtatgtatgctcctgtaccccactatattgttaagttcctttagctcaaaagtatgcctcatttctctttgtactcccagcacctattacacctgggaattgataaacttgttgagcagaatagagctgaaatgatttgtataatctctttctaagtaccttaaatattctagatatatttatcaagaagagaaaagggaaatgctagaccggcatctagcttcaggtatttgaaagactgaacatgaaatataaaaaagacactagactaattcaagtattgttccagagggcagaactggtgctaatgtatagaaatctacagagaagctgttttgggttttcttattcggagtacccttgtaactaagctgtgtgataatgaggatggcctacatccctttgaaaatgctccttagccctgaaaacattcaaacagagctggttggtcagttgccagaattctagaaaggattcttgcatttggaggtggataaatcatgagttttcccaactcttaattttgttggtttgcttgcttgcttattttagaacttttttttaaaaaggtgatttagagtggtcacagcagtttttaatgtcccttaaatttagaaaagctagtaatgcttatttagtttttagaatgatatcctcatgattttcttcacattggttaaaagtgtattaagtgcccagtcagtaataaccaaatacatattttcagagttttttctgtcttttttcgtagccagatgtacataaaccatttctttattataatagaattggaagcttgctcttgtgagcagaacactagattggaagtcagataccttgaattctgtctactccagtctctgccattgggtagccatgtgtcttgtggaaatccctcactctcactgtcttggcttcagttccctctttgttaaattgttggacggtagagtgggaagcagggagtttaaggtcccttcttaccccaaaatttgaattcaaatttggcacattgggaggcatattaattattttaacgtattaacgtattttattacaggaaagttcaatgcgagggttatacttggttcaaaagatgatttggccctttcttaggtatctttaacaaatcaataactattgccctaaaagcattcatggatgctattttttgtcactaagcaaaagggaacttcagttcttaggactaccctttagaacctcctcttaggttaaagtctaggaaccctagccttaaaaagtagtttcttgattgatatatacagaatctgtggaacttctagtccatgtatgcttgcaaacaacatacttatttgggaggatatttaatatactgtgtcattatattaaataagtatatatatatatatacagttttattataataaataagttaatcgtacaatgaccaatgttacttcattaaaatggattttgattattttctttattaattggaaatatattggatatttaaaagattatattaagtgtaaatcagattgaatttttacacatcttaagtgcctgtctgcaaataatgtagttcagataacttttttttaaaagaatgtttgttagtataaattatctgacttttgcagtggttgtttacattaaaactgaaaaataatgtaatagattctatttaggtcaagcactctactagatactttaattataacaactcttcaatatagatattatcttcattttatagagaagagatcagtgtgcagtggagataagtagcttgctcacatttatcccataatgaagcttggattcaaaccttgctcagttggcctttattctttctgctatgatatagcaaatgtttgaaaaatgtgaaaagattaaatgttgaagattttctaacttcttggggacaggaactatgtgtttttatttgttttcctaactttacctagtttctgagaagagctcaataagtagtatttgttgaatgaattggacagtttttaaagttctgcttaaaagcctaagattttgcctcaaagagacaattgaatatactatgtaagtgataaaaaaagaaacttgaaagaccatagaatgacttctagtttagaattatataaaaatttaaaagttcaaaatactggggagagttagatctcatttatgtaaaatgggttaacaatatattgaaataggctgggtgtggaggcccacgcctgtaagcctagcactttgggaggccaaagtgggaggattgcctgagctcaggagtttgagaccagcctgggcaacatggtgaaacccagtctctactaaaaatacaaaaaattagccaggcttggggttgtgtgcctgtaagtcccagctactcaggtggctgaggcaggaaaatcgtttaaacccggtagacggaggttgcagtaagccaagatctcgccactgaactccaacctgggcaactgtctcaaaaataataataataataataataataatatatatatatacacacacacacacacacatatatgtaaaatatctattattttcaggttaagaaaatcatatcttaatgtttcttaactctcttattctttgtaacatttaaatacttctcagttttcatgagatacaattcctgtggtgaatccatgaaaaaaattgaaatggaaggcctttaaaagcaaaatgaccatggattgcccttgatcaatatttgtttcatgtgtctttcgccaaagacccagtttatttcccacatttccatattccataaatcaaattaatgtgctcatttatttacatccctagtacttagcacatagtatacatttagtaaataacatttattataggaagaaagaaaggactaagaggggagagggggaaaagctagtgacctggcttagtactccttcaagagcaaaaagagagttgattgaccaggaagagaaagcccagtatatgtaagtgagcatatagtttttaggaaagcgtctactgttagaacttcacagaaaatcgtttttctcccccaagattaatcaggcaccaagtattagtcacaaggctctagtgtggtctgacaaattgattgaaaaaatctactgtctgtaaatctctaaattttataatggaaaaaaatgcaacacactagatttaacactcttattctaaggttatagaaatccttggctttggaaatttgggaaccatatagtaaattactacttaaaagcaattcctgatatcttcccaatactaatgaataacaggctcaacattggctagagccagaggtaaccctctgcagcccatttcctcaggtgctggagtagcatttgttgagagccactgctactgggacccaaagtcagaaaagatgtgtctggaagttttaacatttaatgctgttataggggacaattctggcttagagagtttgaatttggcagcctaactaaagataaaagattaataactgtagtagaaagtaagtataaggtagttttcacatagttcctgtaacagtgttgtattatgtgattcttttcttaaaaactaaggtaagtagttggtttcacattcatttgaactcctgaagtaaaccattcagtaggctagaattatcactagaaatcaaacactacatcccaatcatcttcttagtcaagccagaaaaagtcttattaactcttacaagcacatgataacagtgaagtcaattgatgttatttctggtttcacaacttgcccaattcaaaatgtggaaagatgagtagctcctagggggatgttatattcttattttgctcttataaatatgaaggattactatgaatagcatatgctttccttaattcttcaaagccccagttctttaaaggagattaaaaatttaatcattactacgttttgtgaaaggaaaaccataaacattagtagtcttactgaaacctcctgaaattgctagaatgacccagatgtttcagtctggcacagaatccacacaccttactcttgcagcctttattaacacctcagtttggtaatctatggactcgggtaaccccatttctaaatctcagaaaggtataaataagatcattttcaattgagaattataaaaatctcaaattctcagtatttgaaaaattcacaatattagatgctagaaactacttggatttgctttcttcctgtatattcattcatgcattttatttatttactttttggtaggctagtaaagtactaagagtgtttcagatatactagtttgtattgtctcttgggaaactaggattgggcgcgcagatacatcgccatctgctggtcagtttatctgtggtgaaactgcagctttcttgagacttgtctagaaattctagaaagcactgccttagaataggagaggtacaggaaatttggagagtctttttcacaagcacttcatttgacaacatttactggtagtgtatcttttttaaggttttgaaaatatttttcatagtaatttctattgaaaattataaaattttcagaacagtagatattttggtcattttttaatcaaatttaagatcctgaaaatgataagacaaagatatacatttttttctagggtcatgggggagcattttcccccatatattttgattttcatttatgcatgtgttctgtactatttgagtgcatatagaacttcagtggcatttagatattttgtgggaccaccagattaatgagacacattgaatagaataaaccagttagtatccatgactaaaaacatgtttgaaataaaattgaatctctctgagacagaaaggcaaacttattttttccccgtagcacatccgtttgtttagggctgagtaatcctttaagaattgctgaacttcccccaagtgctgaaaacctaattctgttttaaaaatagctgtaagtaattctgtcctcatacatatattttacatgtttaacaaaaaagattcttatcttcataaactgtaatgatgtcttaggcccaaactccaattagggttggtttgttttttttaagtttgtatgcttaataacgacaacttgggaagcattttcagagtgctgcgaaaaataactcataagaatacagtatttggaagcacagagactgatttttattttttggatttcagtggagtgttaatatttcaaatacgtgagaataggaaacttcctcttcagaactacaatcacagccgtaaatacagtagagtcatagcagtagatgcaatagaatctcatcatgaaactccatgaattttgaactaatcacatcaccaaaggagctccaatactgaaaaatgaaatacattgaaaatatatctcaagatgaaatgaaaattctaagtgttactaaagcttctgactaatgttctctgtgatattcatttcctttgaagtcaactgttaatctcagcattcaaaagtagtttgtttaaatactgatttaaaaaagaaaaataattctgaagagtggtacttctggtagactttccttatttgtctttgttttgttggtttactttttcactttgctcctgcactttctcatggcatactagttaatagaacgagtttctcaacccaggcgggctgtttgcaccatcactagcttgggcaagttacttctttgtgcttccttatattctgtgaaataagtaatatgtacctcacaggtttgtgtaaagattaagtgaggaaataacttgtgtagaatactaccaagcatacagtaggcatctaaaaaacaaagatgttagctgttttcatggatctctgcccagagtcccttccctgtttctgtgtttctaacatctctcctctcaacctcccgggcccaattcatttatttcactttataattagatcagcagatattaacaccttgcaacttgctattacctaatcagattttaccccattttagtcactttttaatattactgttgcttctccatgttgtttttaaagagtgctttcaacttctgtgttttcagttgacagatgttttattttttcccagagaagtttctattaaatgagttatattagtttaaaattaagtagaaaagaatacctatttagttaatgtgctaaaactaagtgatttataatggctgaatacctgacatcaaggtatatcttctggcactgattttggctttggtggtttggggccacttaactatatgcatggctcttgtggatgacccagttgcagctattaatttagagtagaacatggtgtgtcttgttttaggaatctatactaggtgtccatgtcacccaaaatcatttgcaaatttttgcttatgattggtctgtaagataagtgcttaaacactttcttatgccatttataaaagacataagacaaaaactgtggcagacagctatttgatctagtaaaccttttagttaaaaacaaaggcaatatgagcattcctatcaatagtatatctttaaaacttttccagttcattttattgagctgattgttcttttgtatgaatttaattaagatatatttcctaacttaatgtgtatttggtaatctttttgtttcttttctgtattatatataatataatgtgttaaagtgctagctagttcttacatgaaagtttacttgtgattaagaaaaaaataattttcatagtgaatagaatggtggtggcctttgttttactggcttaatccgtgtgggttttcccctatagtaagttctgtggttgtatactcttaaaatatatactaacattctctagaaaagaagcaatgttttgcatgttttattatatttgtatcttgtatgtgaggtcttctttgagagagaaacacgtttggtgagttcatatttcttaaaatatacatgattcttcagactggaatctaatgaaatagtactcccatttgaaaaccaaagagttgagggtacaacaaaggataaaagtgatcagatgattagccaggggctaatagaaattctggaaagaatgacagatattatattagaaagaaataggatctcatattcactgaagctttctacagctaaaggtccaaaagaaataatagaaaattactgaaagagatgaatgtctgaaactttagaaatgcatgtggtgttggattaatccaagcaagaaagaaagatgggcagataataaattacattttataggaagtctgctttccttgttttcaaagtattttgtcttttttcttttctgtctctctcacaagatatatttaagtaagtctaggccggtttcagaaaattcagttcacaatttttatctttgcaccatatgtgtagagttctttggaatcggtaaaatattataaaaactccaaatccttgaatggagaaggttagtctaaaccttccttctgttctgtgccaaattgatagcatttttccttacgagaatatgaacaatacagaacacattttcacatacaatcagttgtaataccccataactaaaagattttgcagaaatgtctcagtggattttagtcaacccactgagacatagctgtacttctgctagggaaaaagaaatcgttgtaaactgaaaaaatatgtatatgtatattttcatcacagagaagtgattatttaactgttctaaattttactttgacataaatacatgttattttactaaaaaaaattgagagtgtatgtttttgtgtctatagtattatctatctccatacaaatttacacgcaaagtagcatgtatcctttttttcctcaagttaaatggtcacatagcattgtaatcatgaagttcagctcctttcaaatgatgttgattgagaaatatacattcttcttaaactatttgagccttttaatcaatttttccccagatttttgccattgaaacttgactttcatttttgttcttagcttttgtaagttttgtaaggagaaagtgaaatgtttcctgatatataaataagtaataaaattaatgtgcacacaaagtatactctttattcttttttttttttttttttgaggtggaattttgctctttcacccaggctgaagtgcagtggtgcagtctcggctcactgcaacctccgccttccagtttcaagcgattctcctgcctcagcctcccaggttagctggtattgcaggcaactgccaccacgcctggctaatttttgtattttcagtagagacaggatttcaccatgttggccaggctggtctcgaactcctgacctcgtcaaccgcccgccttggcctcccaaacactctttgttcttcatgggcgtttcctttttggccccaacacatacacacaaacataatctctgggaggaaagagaatcttactctgttaaattgaagttctgactacaaatcttctgagtttctatatatttaagcttaaactcaagtatttacatatgaatgagttctgtattctgtaaccatattaaaacttttcctagtatttttatagaatttgtttttatagctacatcagaattaggatcgttattaaagtgctataaaaggtagttatttatcggactctgttagattaaatgtgagaaataatgctagcttcaggttatgattacataatatagatgaaccctgttaataaaatggaataaaagttggaagttttgtctttttaatatatttaatggtttatattgaactttctctaatctttttagagactaattttaaatgtaattcattatgtattcttttttatcctataattatatgtgttcataatgcaggggtgggtagtagagagaggaaaagaaagggacagagggaatgagacttctctgttgtggggaggcatctttctctagtaagaaggaacagataatccagttactagccatacctattaaacttctgtgtctatgtctgttgttgctaaactaacctctaatgccttagacggagtgataacatataagagagtttttgtaaaactttgtacaaaatttcatttaaaagtagcctgtaatcaagactgtttctcttacctagtttgctttggacttgaaatgtaaacaaaagatacttaatgaacttaacaattgttattcttctctacagttacttttctgtgtgtgtgtgtgtgtgtgtgtgtgtgtgtgtgtgtatgtatctttggtatagtgtgttatatgttaatcttccatatgttgtcatagctctaatggacatctcttttcctagatggattattgtttaaatggttaagaatcatagaattctaataggaacactatttattcttttgcagctatgtcatcttatcttttaattattaaaacagagcttcctgctgctattgcagaatttttgactggagactatagtaggtaagaaaaagtattttacattgtgtccgttcatgtattaatttgataaatatgtattaagctgtaaatggcaatacttgtagtggcaggtaaaataaatgtagtccttgccctcaagacagttacaaattaggcagaagtgaagcagtaatagaatagaaactactcagccaatgtttgattacccatatgaaagcgctgttctgtgaaccatatgaagcaccagatataatccttgcattccttgggggtgtgagataggctaagacaggtctgagattgagatgctcttaaggaggaataaagggtaaatttctggggatatgcaagacacaggttggggatgggagaaggttgaatatactgacagtacgggtcttaaacaaaggaggggagtgaatgatattgctgtcatttctcagcaaatcatagtgataaaaaatgtggcagttacaactatacctgtttgaaattcctattatataccatggcaaaaaaataaattatttgcaaggacttaattgtttcatttcctgtttttgaacaatattataaacaatactaaactacattgtatctcttttatctttctttaaaaaatgcatcttacatttttgactcacctctttatagggaaaaaacaaaattaattgtacttttcactgtgtagaacaagaacattctagaaaaaggaacttgaaaagacagaataaatcattttaattgccatcaagttatttcacatagttaagtttcaaaccacagtacaaaacctgtcagacttttagatttgaatactgggttgttctgcttcaataattgaacttgttctggaatgcaaggaaaggtttcaaaaattagtttttagcttttacatttcagcttccattaaagaattctacttagacaactgcaaatacatatttgtaagaaaagtgtggtgtactttagatctgaatagaaaccatcaagaaaatgtagttaaaaaaagacaagtagaagtcctaaatgatttctcttcatcagaagatattgttcctttgtatgatactttacagttaatgaggtttccacatgcattatcacatctgatactcaaaactaccttattttatctacagctttatctagttacattttgattttatgcttaggttgataaacaattcctataagaaatagctatgtgaaattcatttttgtatctgctgtaaaaaacattgagggcaccttctattactcaaattctatgtgagaaatttatattttagggttaagaactcaaggcaatatgaggtagaataaagagggctagactaagagtaaggagatatgtgttctatccatttaatattcaataatctcaggaacttaatttaacttcttttgactatataaagtacttggagccttaggtttttttatgtgatataatgggggtaccaatattgccttctcaataaagttgctgggatgatcaagtaagatatatatacacatgctaatagcatgtgtataaacaagcatgtgtgtacacaaacttacagcacagtgtggagaattaaggaattctaataattactatattaaacgtggtgtttccctttttgccctgactgccaggaagctcagagtcaaatgtgacacatttgaattaatataactgtgttaattccaacagttgtcacaagtgttttcttttttcttgatcctgaatttggtggctcctatttatattcttttattgtcatatgtcggtggaaagaggagggattagaaatatatgtaatattttagaaataattaaagtagtatgtggcagaactggtattgaaatttaggtcttctttctctaaaagtgatatttttaccgtagcttcattttaaataattggcaaatgatttacattgttgcattgatttttttgttttttaaataaaaattaaaatgaacttccatctcattcatattaatagaaaattgattaaaatgttatttttacatgttagaaatacatttttaaaatcatatacttcaaaatactgtggtcagtttgcatcatctctgttatgttttaaaattgtacatctttttaacaaccttatcttgttttaaatgtaatatatattcatttatttttggctaattatattaacttacttgaatgcagataaatcattagtcttgaaagcttgatgctagaaaataagtaagaaacaaaatatgataattgactttactatccataaaggacagtttttttctagatagacttacagtaggcagtatttcttctatgagagaaacatgatattgataagcttttattttagggtttgatatacaataaattttaattaagatctttcaggtatgctaattttctgggttatctgcgagcttggtgtacctttgaaatataaatctttataaagatatcagaatgaaactgtgttcataatattctaatagaagtcagaagctataatacttatactgaactttcatgatatatctatatatttcatagaataacttacatttttaaaatctgtggctgttaaagttggaagctctctgttaacatttaatgatcttgtcggggaatatgattgacacaattaagttgtcttgcattttagttacataattgatatgggatgtgagtaagatcctaattcagaacatatgatactcttgttccattcctttcgagaatgaaattaaagcgacttataaataaatctggttttcattaaaatatggaaaaaaacatctgcatgccaaagcatttgcaatacagctaaggatttatactctatatttcatacttggaacatttttatcatacaggattaaatccacagatcaaacaagttctctaggaagtataaaggtttttactctaattcttttggcttaaagagaatgtatatttagatcacagtaggaaaacaggagttctgttagatcgttctttattccccccttaggaaaaaattaaagttagtacattcttctgaaatgcttatttacaaaataaatgtatttaatatgtactttttgagatttctttttactagtttgtttttctcaggcagcagttttattttgtaagtttaataatttctgttctttagaaaatatccattgagaaacacaattcatttgtctgtgacacacatgtgaaatctaaactaattttactgtgctttactgtgttgcctttattgttaatgaatggtaaagaaaagcactgtatttaaaattggctttattaagatgaattattaaggataagaaatgattaacgataaccagtagccaagacaaggatagagaaattacattttacagtataattatttttatattaagaatttaaagttcaatcctatgaaaaggagaatgcaaagcatgatcttgaaataaatgaggtagtatctgaaagtatttccattgctactgtcaccttccttttgctgattttacagacatataaaatgaagttgttgagccagatgatctctaaggtctcttccagctctaacattccataactgtgattctgagttactgctgggaggaggtaaagttatcttcagtcccacagttcagtgctttggtcagttatatgacttttatggacataaatgaattgtgatctgaaatagtataaagtaactggtgtacagaatttcaaaaagtgttcctttattcctgtgcaagagaaaagagtcctggtcctggggattaaatgctcccttttgtacaactttagcttcgtgacatttttttttcttttaaagagtgaaattggcttataataattttttgttttattttattacggtaagaacacttgacatgaaatctgcactctcaacagattttcaagtgtataatgcggtattgttatctacgagagacagcaaaactaacagatggaatctcctttggtactcctttgggcatttttcctcctggcactgcaactgtctgggtctaacattgggtcccagaaggaaacacatttcagacatagagccctgggccttttgccagcttcagaaatttggttgccaggtgttcctcaatgaaagatcttttgaagtttctgttttgattcttactcaagagtgactagaagataaacacgttgagtatcatttttgtattattgatatgtgtactcttttagtacttcctgcataccaggaattgaggggcatgtgcaaatggagagagcaaagcttcaggtccactaaagctgtaaatacttatgcataggttatagtttctggcatatgtatttcctaatgatacaaattagggtggagaagggaaaagtgtcatcatggtgctgtttctgcagctgctccttctcttgttctgttaaagaggaagttgtcagcacccaacagtaacaattaagttcatgttagaagccactggttgaaatccatgtagaagacctttgcctaatttaacatggcagtgggagactggtatctggcagagaatgaaagaggatgcgttattgcaaagtgggaattttgagattatctaccaaacaatttgaaaaagtccctattggtctttgatgccccaagctcccatttttgcataagttttactttgttactattgtgcgtgtgtatgtatgtgtatacacttaagtgtaaatatctgacagctacgataaagaaaattgagaaaaaaaagcaaagaaaaatcatgcataacatctctaacctagtcactgtccttttaattcttttgaatttttcgcaaaagctttcaaaactatagttaataattatatttatatcatcatcattttccattttattcattgtgttttttcttaaagccacgtaacattccattgagtatgctgttctaaatattttcaaatgttgggtatatagagttttcctccagcttctcaatattataataatatattcaacagcttcacatacatagaattttctctattttattttcttagattgccactacatttttattgctcttgctacatataatcattgtttttccaagagatagtactaattggcacgatcactagcaatgtatgaagtccagttgtgccacatccttgaatatttttgtttactaattttgctagattaattgaaacagtctcattatttctttaattagcaccagtgattggattttcttcatgtgtatttactagttgtatttctttcatgaattgtttctcctttgcatacaaatctattgaggtcttgggaattaactttaacttttaaaaatgtctacatatgtatctcacatattgctcatattgctatcacataaaaatatctactttttggtattttaagtatatccttctggctttatatgtgcatccagttttgtttttttcaatgaacaaatacaaaatcacgttaacctacctttttctcattctgtattctaatgcctttatatgaaaattttaatattttacaattggtgattaatgccctttcctgaaatttggaaaaatgtatatagaaaactataaagaagaaaaatgacctattattttaccacccagagataatggctatcaatatattttagttcctttccatttttaatgcatccatgtttttcctcaaaattatcatgctatatacacacaaatatatgatgtttactgaatattcagtatattgttatttcaaaattatcatggtcttggaggtttgttttcaatttttattattttaaatgttttcagtaaacatctttttataaaagtctttgttcttcaggaacagaaaaccaaacaccgcatgttctcactcgtaagtgagagttgagcaatgagagcacatgaacacagggaggggaacatcacagactggggcctgttggtgggtgggggcaaggggagggggagcattaggacaaatacctaatgcatgcagggcttaaaacctagatgacgggttgataggtgcagcataccaccatggcacatgtatacctacgtaacaagcctgcacattctgcacatgttctacggaacttaaataaaataaaaatttacaaaaagtgtatgttcttattatttttaatagtcttttataagtgttttcaagtatataattatttgaaaattctttatatctattgccaaattgctttccagaaaggtaatttatataatttgcattttcaccagctttttacacacctcatcactcctcactaatgttgactattatcttatttttaaatatttattaattcagtagttggaaatggcatctctttgtttttattcatttctaaatgtcaattcattaataagaaaaataggatcccacaagaacattttaatgaaaggaagtaggcttttcctaatagctggttgtaatggttataactctgtgtgtgtgtgtgtgtgtgtgtgtgtgtgtgtgtgtgtgtgtgtgtcagaacaaacactggagtcccatgcctaaagtagaactttttttataatagatattggtatcttgatggacaaacactactaataatcatatgtgttggcattgtgttccctcttgcacttcttcccaaaataggtaagtctttatagagcacattatttgtttagaaaaaggaaagaagggagggagggaaagagagacaaatattaaggggctttaaaatttcacagtaccacatttttggcagaaggatggtggttgtgtataattttaaacttggccttattttaggttgttcagccttcagccctgcctagttaacctattacttggtttgcagtagtattttgtctgccccactaaaataaaatctttacagcggaacattaaagagcagcctttccttacagtgtaccattagtggtaagccagttccaattctgctgtacagagctacataaatgatctgtgacagatagttggaatgttgttattctgagccctaagccccagataccaaccactataatagaaaacatgcctaagatgtatagctttagttgtacgttaaaatcgctttccttataaattgctttttattttactgttattttacaggctttcttggctacacaagtagtttatcatttttctttatgatgttctttgctcttgtggtaagtttaaaatataatacattgcttatctcctcactaaaattggactcattgtgttagtcttttttacttttaactgttttgtgttgggaagggtatctcattttatttcactgtgttattaaaagcacttttgttccattaaattatttccttcattgtatctattttgaagaggcttagctagaacagcatttcaaattcagcatttcttgtggttaactagagaggagagcgtgccaattctgttaaaatcctagatggagtgtaattctttgtgtaggtgtgtaaatttattcctgtaccatactgtatgaagaatcagtctggttctaatctgtaaaatctgtttgagactagtcatcttaattttgaaactttattccattaataaaaaaacagagcttctggtactacattgaggagatctagtaagaactgggttgactgaattctattttgtctggtttattcagcatagataaattctcataaaaacactactacaaatatttttcttcacatgtgggatatattccttattttttaattagctcatttttattatataaaaatatcagatggtaaatttaacttattttgatattataaaataatataaagataagaatttaaatttatttccttctaattcttctaaaacatcttaacattctaaagatagtacctttgtgtgaaattttttaagtcttttttctttgtatagcagtttattccataatcagtatctaaatgtcaaaccttaagtagaaataaacatttttaactttccaagaatatacatgtccaaatgagcttttcataagcttggttcaactctttcttgtttttgaaaatgcatgaaagaaacagccatatgtaagagcagaacagcacatcagtagttaagccatattaaagatccagatttcaaagctgtcaaaacaacctagggtgcatttaacttaggctaagctatcttctgagacacagggataaaataactttaaattatttaaacaaagtggaagtgactctgattttagtatatataagcatttattctctattgaatgctcttaaaactaaaaacatttaacagtgtttacatttaatcatttgttgaatttaacaacattaaaatcattcctcttcttctctccccagttgtctgacttatatcttacagataagtgaattgaacatacactttgtaggctccatattgaaaaagaaaaaaactaaatatttccatcatcatttgattgttgagaagtgtggttagaagtggcctacatatgcaaatgaatgtatggatattaaagagaatcagtatagataacatattgaatttttctctcacagataattggcaatgcaatcattgcatagataggagtaatttagttttcatagccaatagcttaaagcaggttaaatgtattgatatgatatgtctactgtagttttgtttctgtcatgacagatactctttaattcaatgcagatttctaatgtagcagccatatggaaataatacccatattctacatttattgtaatgccttataaaccatctgctcagatttttacctgtgagcacagtttaatctacagtggggcaatgaagaatactctgtatgcttttttaaatactctttttaattggcatgtttattttattatttatttatttatttattttgagacagagttttgctctgtcacccagggtggagtgcagtggcacgatctcagttcactgtgacttacatctcctgggttcaagcaattctcctgactcagcctcccaagtagctgggatttcaggtgcatgctaattttttttttttttttttgtatttttagtagagatggtgtttcaccatgttagccaggcaagtcttgaactcctgacctcaagtgatccacccacctcggcctcccaaagtgctgggattacaggcgtgagccaccgtgcccagccaccatatttattttagattctctgaatgttatcttttaaaatacatagtggttaggaaaaggaaacgtatatatattaacccagaattttggaaggataccagtttttcatttattattcttgtcaatatgtgtttgtaaatatgtatagcatttatatcatattttttaaaaatcagttcaggaactattattttcttatattctttgaataatataaactaaaacctatattttatctgttctcccagatctgtattttcattaaaaaaatttaacctaaatttttgccccctctaaaatattttgcaattttaaaaataaattatatctgtctcagaatgataccatcaagatggatttacctttttttggtaaatttactttttttttggtgtattttagagcacaagcggattaccattcgttctaaaagttctatcttaagtacagattagtattctaagcaacgttttaatacgtcggtaatccagttagacaacttttttttttaagagacagaatctcactctctccagtcacccagactggagtgcagtggcatgatcatagctcactgcagactcaaactgccgggcttaggtgattcttctgcctcagcttcctgaatcactagaactacagctgcataccaccacgcctggataatttttttttttttttttttgagatggagtctcactctgtcacccaggctggagtgcagtggcgccatctcggctcactgcaagctccgcctcccaggttcacagcattctcttgcctcagcctcacgagtagctggaaccataggcacccgccaccacgcctggctaattttttgtatttttagtagagacagggtttgaccgtgttagccaggatggtctcgatctccagacctcatgatccgcccgcctgggcctcccaaagtgctgggattacaggtgtgagccaccgcgcctggccagataaatttttttttaaatgttggtagagacagagtcccattatgttgcccaggctagccttgaactcctatgttcaagtgatcctcccaccttggcctcccaaagtgctgagattataggcgtgagccactgcactggcctgaaatagagaattatttaaatggtttttagtcagaagctttgcttctactgaacactatgttaggcattttaggatgtggaaatttaacctggacactagtcttaaggatctgtcaatctagtaggggagataaatttcttttcaaacatggagaacagtgtgtgcaatatataaataagtattgatatatttgcttcagaataagagtctcaagagttgagaggagagaaggctcactgagagctagagtaaagaaggattttagaggaaatacaacttgagttgagccacaaaagaagcaaagggcttagagcagagagaaggaagggaggccttttgtgcaagtgaacaaatatttttaatacttagtctcctttttccctttgtcattccaaccccaagacttaccttcttaccaacctaagcaaggacttcctgttaatctttcctctctgttgttgggtctcgtttcactcccgttctgtacttctgctttgtgggacatcatctctatccaccccataccaccatacaggcttggagttgggatggatctttgcagagaaattagctgtagtaactgaactgtctattaatataaaatcaggctacttcttatttttttcaaattaataaaaattaatgataatattgcactttggagcattgctttgaaatattttgatttgaaagcttaagaaataacaactgataaatgaggcagctcacatacagagtttatctaggtacctggtgcacagcaagtcctcagtaaatgattttttctgccaacactaccactgttagttaggggaaaatataagaaactgaatttgggcctgtgcagtggctcacgcctgtaatcccacactttgggagcctgggacaggcggattacttgagcctaggagtttgagaccagcctgggcaacatggcaaaatctattctctacaaaaaacacaaaaattagctgggtgtgatggccacacacctgtagtcccaggcactcgggaggctgaggtggaaggatggtttgagcctgggaggtggaggttgcagtgagctgagattgtgttactgcactccaggctgggtgacagagtgagaccctgtcttaaaaaaaacaagaaaagaaactgaatttggagcagtttcaccctcacctcatcctcatcgtttttttttgttgttgttgtttttctttgaaaacctataaagataatgatggtgagattattgcttttgattttgttatttccttttggtaagttgaccgtttcattttatgtcatattgaaaacttacctagaaatgtcaaagcagcttgtctagtttatccttctacagtaatttttttcttggtgaggtttttaattaagagtgattctttagttcactcattaacttaatcctaaaagtatatgttttccttatatttgttttatcactgtgtaaaattttgattaaattagtcaaaatccaaaactaggtaaataccaagtaggaatagaaattgtgtttacatattggtctcctacaaagaacaaatacttcctttattctttcttgtccttttgtgcactgggattcaccctggagcaaacatttacagagtaattatgtgccctgaaacaacagcaacaatggtaatattgacagagccacagctataggtctgataacaggatggccacaattaagagtaaaaacatgaaacattttcattgattaattctgggaaacagcatccctctggatttcttttaatgttttttttgtttgtttgtttgtttttaccagctggagttccctagctatatgctcctattccagccagctttctccacattaaccaaaaataattcagatctgtaaaagtaaggaggggcagcacttaatgtgtacatcagaaatccctgagctccttctgagtataaagtctgtacttatttcttcctgtggcctttccataaactgctgttaaatgtttctctattcactaatacctactctacaaataaccatattcctgtgtgacagtcactgaaaacatcatgttcctgttttgagttgcacttaaaaaaaaatgccttgatgctgttggaattttgaaagttgacacaggagtacccttagtctttaatgggggagatctctacttaacaccctgcagtctccaaccgcctccctaccacaggtgaccatgttaaatgttgaccccattctaaccgggaaaagtcacagaagcagagactcttctattagcatcttatttaattgaaatgatactgacctatttcaattcagtttcttattaattttataagaaatgatctgagtgctgattctgtttacttttttaggtaataattaaaaaatggtccatcccttgtcctctgacattaaattatgtagagaaaggtttccaggtaatagcttatattttcttttcagtttcttcctttttattttaactaaaaagaaaagaaagactaatgattcttttctgattgatgaaaaagtaatggctatattgcattttagaactttgttttgaaatactttcatttgaaagcctagtaataataaattcatcatttttattgatatattctgaaatttaatggctgttggtttctctttttcccctcaatgctcttaaacagatttcaaatgttacagatgattgtaagccaaagctctttcatttctccaaagaggtgtgtaagttattaacagatacttttagttgatttttcacatttcaagttttaagaggtttgtgtaacagggtctcttaggtctttgtacctgtgactaattaattttcatgaaagtgctaagtataggattgcctaccagaagactactattatttaacacagggtggcctattatgaaacagccacctttttttttttttttttttttttcctggtatgcctttgaatggagcctgttttaaatgggcctctgcctgaaagaacagatttaccgaatgtctggtctggccaataaggtcctctgtgtataccaacttcctgttgccctctgcacttgtaaagctaaatagccaattatatcaaaaactcttcccctgtgagtagaaccttggtctgtagctaaacagcctcatcattggactagggattgagcactgccaatatatcttctggccgacattccaaagttgaaattcatgatgccaggagtagagactaggagaccaagtccctttgccttccctaaaagccataggatactggaaatgcctgtaagagcccctgagcatcagcagaggagacaagaactgtgacatggatggtctctgctttaccactctagaagagctcaaagtcttccctgttgctgcaggcttatttgtctatactttctgactctgctgaaatgctattttgtatagttcccagatgctagaatcccccctgctcatgtaaaactctattagtgtagaatgttagcttggttactccaccatgcagaattttcctttttatctctagtttttaaatgagaaatatctctctggtcccaaaagggagattaccacatcttttacatggtaaagacctccaggtgccgtaaagatctaggtaggataattgacaagccaggaaactgagcaatatatgaaatggagaatttgtgaattaaactctcattttcctagtccagcctcaggaaacactacagcttcctctctcctaacccccttcagatattttaagactctaggcattatgtcccaagataggtcttcatttctggaatttcttttgtttaagagcctgaagttagttaagtggaaatttttttagagcagaaaggagaaaatagatcaccatcgtctatttggtaaagatggtattttcacttaaatggtaactttttttgctttactctgactcttaagtattctaataataaaaacaaaacaaaaccttatatttgtatattacattggatctcttaagagtttgtaggtctagaataaatgatattcattcccattgaaagagatcctaatcaaagatgctggcaatattaaaatgtgattaatattttcagtattcccttggattgagttcatgaaagcaggttcaagagcattaactattagtgctgcttagagtaataagatacatttaaattgtgcgtacatttagaagacagagaattaaaaaagagcatttctaaaatgttatttttatctcatttaaatattatttatcttatgtaatttttaaaatcttatccagataatgtagaagtagtgattgtagtaaaagcagcatggtatgggcagccaaataaaaaatattctggctagtacaggcaagcccactatcaaataaaatatttgctggatcacaagtgtttttctcttttaaaaaattcttattttataaagagaagactcattaaagatgaaataaatgtaatcaaattgattttttaaagaactgagtttgttgtcaaatgaaataatggtttcagtagagtggcatttaataattttgtctctttaaaatttttttcagagtgcttatgccttaccaaccatggctttttcatttctctgccatacctcaatattgcccatatactgtgaacttcaaaggtactgtagaatcctggaatattttaaatatattgtgtatctttttacctctaaggctttcggattgaatgacatcctcttttattaatcctttcctctcatcagtggatcctaagtgttagtttaaaacaaaacaaacaagagttagttctgtccaagttaagaatgtttcctagaagtgtaatctttgaggctggcctgtaatcccagcactttgggaggccgaggcaggcgggtcacctgaggtcaggagttcaagaccagcctggccaacatggtgaaaccccgtctctactaaaaatacaaaaaaaatagccggacgtggtggcgggcacctgtaatcccagctacttgtgaggctgaggcaggagaatcgcttgaacccaggaggtggaggttacagtgagccgagatcacactactgtattccagcctgggcgacagagcaagactctgtctcaaaaaaaaaaaaaggaagaagtgtaatctttgtgtactaatttcgaatgaggacttctagtgtatagttattgatggagttgttcttgaatgaggaattctctcgaccagcttaggacatacttgtttctttacatataattcagatcacttattctacctttgtcatttttgtcttttagtccttcaaagaaaagaatgcagaatgttaccaatacagcaattgctttaagttttctcatttattttatatctgcactctttgggtacctcactttttatggtaagtacattttaaaattatagatgacaaaataatagttacatagatggcctcacgccaatctatagactttacctatgccttttattactaagttaatttgctcagatcaccaaattacaatgcagtactgtggtggctcttgaggcctaaacaattggattatctttcttttagaaaggtagttcaggtttaagattaatgacttcttatgaaaattttcttaaacacttaagtaaaacttcaggcttagggacatgattctttctataagaaaaaatgtgcaattttaatgattctgtttttcttaaattttgaattcaatatattagtctaattcagaagtgtgggggttgggtgagtcagtcatcttaattgcaaaagaacaagttgagaaaggaaagggttttacacagaactatatctgtatacttagatgtcagacatctctgccttcagatctaattatcacaggattcagcagatgtgcattctatgatgcaccatgaccttcctccttaattatttttacaggttcttttaaatttatgcaacaaaaataaaattgtgttttatttcttttgcaaaaactgtctgctttgtatgttgactttttttcctcttctgataagaacctcaagaaaaagtaaagttctgtgtacaccatcaggaaaagcattatttccaatgtgagcatggtgccctgctagagacgctacaaagaaagttaaaacagattgtcaagcttttctgatcatcattaataaaacaaaattacttaaatatataaactttatttttggatgttgggtttgttagtttttatacagacttgaactcaataagacttttctgtgtcaataagatactgtaacagggtctcttgggatccaaaaatattttgtatagtggaatagctatatatttcttttattaaaattgctacctggcacaaacactattatatttagggatcttcagcaataagaaaaagtccaaaaaaactgacctccttcttctccctatggataaatagaactatctggaagaaacctcagatggcttgccaatatccaggctggctgagaaattgttagatgaatcaccattaggtgcttagaaactgtattaaattgtagctgtattagattgaaagggatgtggaggaaggatggaagctaatacatttattgagctaacatttaagacagtgtcaggtattttatatatactccctaacttaatccttataacaattctgcaagctcagtgtaggttcatttaggttgagtaattagaccagatacttgaagccagttaatagtggaattgggatttgaatctagttttgtctctctccaaagccaatgcctttattactgtgttgtctactcagaaattgtgctatagaagccagatttcctttattccaagtttttgttaaggtgatcttttagaaaaatatgactcacttaagctctaggcatctatctatgtatgtatctatgtataatctatctatctaacattgctgcttgaacacaaaggctaaaggttttcatcatgtagatggcatgtttcctagacagggatttgtctaatatcaagtaaaaccattatgttgtctctgatttaatctcttctccactaatgcaaattcttcagagtatgcaaattttatataatagagaaatacacatctaagaaaatcacatggtaggtaggtatatgattgattaataggtaggtgggtaggcagatagatgggtggatgaatagatgatagattagatagatagatagatagatacatacatacatacatacatacatacatacatacatacatacatacatacataaatagaataaatgatacaaaagtagtaagttcttctccaaagacagaagaggcagatattgatttgctcttggattgtgaatcataaccaagaaaaacctttgatcatatctttctaccaggataacaggagctttgtgtcataggaagaaattgctggttgaacctgagatcttataagggctagcctcaacttaaggcttccaattcattttacagatgaacaactaaagcccagagaggtgaagtgacctgtcacagaattaaaggcaggtttcctgaatactaatccagtgttatttctgctactttgtgataatctttgtaaacttaataccctgtttgacaatgtgtattaaacaggacagcctcctgacttcaatggcatatataacttgcagagatcaccattaggccctttctgagatttgtagagatttgtctgaatccagggaagcatgcaccactctatccctcacatatgttatggctcagttaagaacacagagtgactggctcagaagaagtgttttcatcctgggaaagtagaaagtggacatgtgacatctattttgaatttgtaataaatctagttcttcaagattcaggagctgctttggatccttttatccagagctcctaaagtttaatttctaaatttgtcagattaaagggacttataggtatgtacctagattaatgatacttgctctgattacagctgtgaaaggaagagaaaagggttcctctggtgagccaggccagtgcccaaatgttgcataataaccaggccatttaaaaagtctatgaggttgttaagcaagaagtgttaatagctcattttatgattcagaaaatggaaataaaatagtttgccatatttctccaaagactcacaagtatctcacagatttggaaatagaatccagatttcctggctcttcttagtctcctacttagtccaaatcccacattgtgtaaagtatgtttttgatactttggacaattcatttctctcctgtttccattatcactagtctagttcagattctctttacctctcagtgattgtaacagtagctgttatgcctgtttggggtctctttttcttccaatccgtactcctgctttagttcagatcataatacactgttctttgtaagtcattattgcatttctgtggcctaccaggttgaggccacatctcatgcagaactgtattactaggtctgaaatgcatttccagccctatcacccacacactgtttcatccactgtagtacttactagaccacttattttctcagatgcacattccctttgctttgtttgtgctgctccttgcttctagagaatctcttcccccacatctttgaacatcagcacacattcattgactcatgtaatgttctcagtaaccctatagtttagtatatggccatccccattttaaagatgtaggaactgagagactcagtgtaagttgctagttactggtggggtttgaacatgttctatgtcatcacagtttagaatctccatagctcttgtttagaactctctggccacttacatgtgtatatcacactttctatcatagctatgtgtattcatctcatctcttcttaaagttccctgagaacagaggtatgtttccttttgtttttggtttccctcaaagtatcctttctgaaacactctcaaattaaaaggcaccattctattttaagtacaaactgatattttcccacaaaacactgatatccagtgtttctgagcaccctcagtcttctttccccttgtctgggttgaggttagggagacattgtgagaatgcaagaacactggagcaaagcttggtcggcatgtataaatcctattgctgaccaccacacactggcctactaagtaagacatttccctaacacttctctttttttcataaaacatgaatccacagatgaaacgtaacatgcaccaagctctgagattctagaaaacgttgtggtattgaggaaaagatgctgtctctagcaccaaaaagaagtaggtgtatggcactgcccctttgtgttatgtgatcttaggcaaatcatttaacacttttggacctacctgcgtattaatattgttatcatggggactaaattcaacaacacgtgtgaaagcactttataaacaaacagcacaaatgttcaaacccttagattatggaaaagttccaaagagataatttagtatacatattcattgtcataatttgagaggttctgcttattctggtttttattaaaggaaaaagggtgttaggtttcaagaagatatttaattaatgtctctgtgtttcataggctaggggaaaggccaggatttggtaatgggaatctaaaatctgttatcatccattagtgcaaaggaaaacaattttgttactattgataccttagtactttataatgtgatccttattattttatttacagacaaagtggagtcagaattactaaaaggttatagtaaatacttatcacatgatgttgttgtcatgactgtgaagttatgcatactatttgctgtgcttttgacagtccctctaatccacttccctgtaagtactcttaaagggttttgttgcctagtatagacgcttcctaatagggaaacactaattctttgcagaatagaatgtttgaatcacatctagtcttgtatatcttattcacttgtcaagtaattgatcaaagacttcatacttgcatatggccccgtaaaagcataaaaataacagtgagccactaagctaatttgtgctttttgagatttagtttagatttacgttctcccacagcattgtttccaatttagaaactatagttcttctaaagttttgggtttttcccccctttaattctgtattctgttttcaaaaaaatgtgcatgaagaggaaaaagtcaagtcaggaaaaataagctccttctgggtttattgtaaatttattttcacataagcattctagttcaatcttggtgaaaatattttatttgctctagaattgtaatttaaggggcaaaacagattttcattgcatctggttgctatacttgagaatcttaagaatttctgagaaaaagggaacaaaggctttgggtataaatgcatctgcatggatgtcttgaatctctaatgctgagttttgtaagagctggggcttcaagcctcctccctgtgtgggctgcagtgccaagattacagcagggactggataaattttttggcatgtgaccgcctgctgtgctcttagcaatgggaagtgtagtgaactattttttcatatttacaggctgtgaaacatataaaataaaatagtaagtggtatttctttcccatggcatgatttctttttctattataaattgtctgtttttttaatctgttgcatttaatgaaaatcattctttgagacttttttcatatttttattgttggtaattttaaaaattatgcaacctaaaaaaattgcatgtgaaaactttttctagcattaaagctaagtatttttatgaagcttacacagaaagggttagtatataaacagtttatgtgtataaatactttataataatagtttatgctgtatttttgaaatctaaatgatgtaggaggcaaaaatatcatggttgttgtatatgtttctctcagcaaatatctggactttgacatttcctcttcgctatatgtttatttttctgtaatacaggccagaaaagctgtaacaatgatgtttttctccaattttccattctcatggattcgccattttttgatcactctagcactcaatattatcatcgttttacttgcaatatatgttcctgacattagaaatgtatttggtgtagttggtaagttttctgtttcaaaaagttcacataataaaattgataaaattgctacccagcctcacatctgaatccagcaatatcctctcttttttttccctccactttaaaggtgccagtacatcaacatgtttgatttttatattcccaggactattttatcttaaacttagcagagaggattttctgtcatggaaaaagcttggggtaggttgtttttgtttctttctttcaagacttctattttaagaaatagtttgtcagtttatattattttacctgcatcaagaaagtcaatatattttaaaatatagaatacattattgcagagagtagagatttaacaaataatccaattgtatttttttatcttttttcttttatctttcttatcttttatcttttttcttatttccacaggcattcgttttgctcatctttggaattttggttgggaattttagtttagcactcatcatttttgattggattaataaataaaagaaatattttcctacttcttacaagaataatatacccctagttgcaagaatgaattattccggaagacaccctggatgaaaaataacattttaataaaaattattaacagaaaagcagaacaaaatggcagtgggtatggggaagtaagagtgtggcagttttaatcaaaaaaagaaacaaactcgaaatgctcttaaatatattgggttgatcttttgttttttaaattaatatttttatggtagttttatgtttgcagaaatactgaacagaaagtacagagttcacatataccgttttaccccaacatacagtttcccctattattaactcttgcgttcatgtggtacatttgttacatttgatgagccaatattaactattattattaactaaagttcatagtttaccttaggtttcattcttggcagccactagcaaccactgatttttttttaacttttattttaggttcaagggtacatgtgaaagcttgttacataggtaaactcgtgtcacgggaatttgttatacagattatttcatctcccaggtattaaacccagtactcattagttacgttttctgctcctctccctcctcccaccctctacccaccagccccagttgtttttttctttgtgttcataagttcttactatttagctctcacgtagaaatgaagacatgcaatatatggttttcttttcctgtgtgtgtttgctaaggataaaagcctccacctccatccatgttcctgcaaaagacatgatcttattttttatggctgcatagtattccatgatatatatataccatattttctttatccagtctgtcattgatgggtatatagggtgattccatgtcttggctatagtgaatagtgctacagtgaacagtgctacagtgaacatttacgtgcatgtgtctttatggtggaataatttatgttccttggggtatatattcagtaatgggattgctgggatgaatggtagttttgcttttagctctttgaggaatcaccatagtgcttccacgattgttgaactaatttacactcccaccaaaagtgtataaatgttcccttttgtccacaacctcaccagtatgttattttttgactttttattaatagccattctgactgatgggagatgataatctccttgtggttttgatttgcatttctctaatgatcagtgctactgagctttcttatgtgcttgttggcagcatgtatgtatgtcttcttttgagaagtgtctgttcatgtcctttgcccactttttaatggggtggtttttctcttgtaaatttgttcaagttcctcatagatgccggatattagacctttgttggatgtatagtttgcacatattttctcctgttctgtaggctgtttggttttttttgctgtgcagaagctcttaagtttaattagatctcatttgtcagttaatttttgcttttgttgcaattgcttggtgcctttgtcatgaaatctttgcccattcctatgtctgggatggtattgcctaggttgtcttccagggtttttaaagttttgggttttacatttaagtctttaatccatcttgagttgatttttatatatggtataaggaaagggtacagcttcaatcttctgcatatggctagccagtcattccagcatcatttattgaatagtgagtcttttccccattgcttgtttctttcagctttgttgaagatcagatggtcataggtgtgtggccttatttctgggttctctatactgttccattggtctatgtgcctgtttttataccactgtcatgcagttttagttcctgtagtcctgtagtatagtttgaagtgggttcatgtgatgcctccagctttgttctttttgcttaggattgccctggctattcaggcccttttttggttccatatgaattttaaaatagttttatctagttctgtgaagaatgtcattggtagttttataggaatagcattgaatctgtaaattgctttagccaatatggccattttaatgataacgattcttcctatccatgagcatggaatgttttttcatttgtttgtgtcttctctgatttatttaagcagtgttttataattctcattgtagaaatctttcacctccctggttagctgtattcctaggtattttattctttttgtggcaattgtgaatgggattgtctgatttggctctcagtttggttattggtggtgtataggaatgctagtaatttttgtacattgattttatatcctgaaactttgctgaagttatcagctcaaggagcttttgggtggagaccattctagatatagaatcatgtcatctgcaaacagagatagtttgacttcctctcttcctatttggatgtcctttctttctttctcttgcctgactgctctggctaggatttccaatactatgttgaataggagtggtgagagagggtatcctcgtcttaacgccagttttcaagggaaatgcttccaggttttatctattcagtataatgttggccatgagtttgtcatggatgcctcttattattttgaggtatgttcctacaatacctagtttgttgagagtttttaacatgaagcagtgttgaattttttttttttttaagtctttttctttttttttttctttttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtatctgttcatgtccttcgcccactttttgatggggttgtttgtttttttcttgtaaatttgtttgagttcattgtagattctggatattagccctttgtcagatgagtaggttgcaaaaattttctcccattttataggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaatgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccaagagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggaggttttgggctgagacgatggggttttctagataaacaatcatgtcgtctgcaaacagggacaatttgacttcctcttttcctaattgaataccctttatttccttctcctgcctgactgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattctgaaatacgtcccatcaatacctaatttattgagagtttttagcatgaagggttgttgaattttgtcaaaggctttttctgcatctattgagataatcatgtggtttttgtctttggctctgtttatatgctggattacatttatttatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtaggattcagctgtgaatccatctggtcctggactctttttggttggtaaactattgattattgccacaatttcagagcttgttattggtctattcagagattcaacttcttcctggtttagtcttgggagagtgtatgtgtcgaggaatgtatccatttcttctagattttctagtttatttgcgtagaggtgtttgtagtattctctcatggtagtttgtatttctgtgggatcggtggtgatatcccctttatcattttttattgtgtctatttgattcttctctctttttttctttattagtcttgctagcggtctatcaattttgttgatactttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcgtttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcacttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgttgggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcagctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttccgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctgtttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctcgttgccgccttgcagtttgatctcagactgctgtgctagcaatcagcgagattccgtgggcgtaggaccctctgagccaggtgtgggatatagtctcgtggtgcgccgtttcttaagccggtctgaaaagcgcaatattcgggtgggagtgacccgattttccaggtgcgtccgtcacccctttctttgactcggaaagggaactccctgaccccttgcgcttcccaggtgaggcaatgcctcgacctgcttcggctcgcgcacggtgcgcgcacacactggcctgcgcccactgtctggcactccctagtgagaagaacccggtacctcagatggaaatgcagaaatcacccgtcttctgcgtcgctcacgctgggagctgtagaccggagctgttcctattcggccatcttggctcctcccccaagtgttgaattttatcagaagccttttctgcacctattgagatgatcatgtggtttttgtctttagttctgtttatgtgatgaatcacatttattgatttgcatatgttgaaccaaccttgcatcccgtataagtgtacttgatcatggtggattaacttttaatgtgttgctggattcagtttgcaagtattttgttgaggatttttgcatcaatgttcatcaaagatattgacctgaagttttctttttttattgtgtctctgtcatgttttagtatcaaggtgatgctggcctcatagaatgagttaagaggagtccctcctcctcaatttttttggagtagtttctgtaggaatagtacctgctcgtctttgtacatttccactgatcattttactgtctccatagttttgtcttttccaaaatgtcatatagttgcaatcctatagtatgtagccttttcagactgccttatttcgtttagaaatatgcaattaagtttcttctatgtctttttgtggcttaatagctcctttctttgtagcactgaatagtattccattgtatggatgtaccacagtttgtttatccattcacctgttgaaagatctcttggttgcttccaagtctttgcaattacaaataaagctgctctaagcattcgtgtgcaggtttttttgttttgttttgttttgttttgttttgagacagagtcttactctgtcacctaggctggagtgcaatggtgtgatctcggctcactgtagcctccatctcccaggttctagcaattctcatgcctcagcctccccagtagctgggattacaggcacccaccactacgcctggctaattttttctatttttagtagagatggggttttaccatgttggccaggctggtcttgtactcctgacctcaggtgatccatccgcctcgacctcccaaagtgctgggcatgagccacgatgcccagcccctgtgtaggtttttatgtagacataatttgcagcttatttgagtaaataccatggagcacagttcctacactgtatggtaagaatgtatttagttttatgagaaattgccaaactaccttccaaaatggctgtaacattttatattccagagagcagtaaattagagtttctgttgtcttacatcctcaccagcatttggtggtgtcagtgttttagattttcaccattctaattggcatgtagtggtatctcgttgttttagtttgcagttccctaatatgatattgagcatcttttcatatgcatatttgccatctgtttattttctttggtaaagtatctgtttagctcaactctcttttgccttttttttttttaaatactgggtcttgctatgttgccccgactggatttaaattcctgggctcaagtgatcccagtgcctcagcatactgagtagctgggactgcaggcacataccaccatttgttaattgttttctcattgttgacttttaagcattctttttagattttatatttctggggttttgttttgtttttttgagacagagtctcacttccgtcacccaggctggagtgcagtggtataatctcggctcactgcaacctctacctcctgggttcaagcaattctagtgcctcagcctcctgcatagctggaattacaggcgcacgccaccacacccagctaatttttgtatttttagtagatagggtttcgccatgttggccaggctggtcgcaaactcctgacctcaagtgatctgcccgcctcagcctcccaaagtgctgagattacaggcatgagctaccatgcccagccaatttctgttctttatatgtgttttgcaaagatttttttttccccattttgtggcttgctgttttattctcttaacagtgtctttcaaagagcagaagtgtttaaatgttcttaaatatattgggtcaatcttttgtttgtttgttttaagaaatcagtgtattaaatttatatacaaaattgattcttagctatgttttaattttgttagcatcagtcactaataacaaaactgagattgttctacttggtagaatttagagggattttgccctccctctaaatcctatctaaaaacttttataactttcctcttctgttcattatgagatagacctgtgatgactgcctgtgtacttcaaagtcctttctctgagttttcttagttggtcactaaaacaggcaacattctacttggcagagacaaaatgttgatcatttctataatattttgtttggaggttataaatcattgcagcttctcattgacatggcttatttcaggttaggaaccagaacctagggctctcctcccatgaaattctactaaagccagggtgtatcagtaaaaatgtaatcctaccccagtacacatgtaaagtagagaattgcatgcaaagtgccggttttcatatatggaaatacactcttttgcaggtgcacctttgcttctcacttaggaaataagccgaaaaattgacaactgagcttctcttttgagaagatcaagatatttagcaactggagaacagtgtagtgtaatggtaaaagaccaagctcttgggttagaaagacttggattcaagtctcagtgtaaggcacactacgtaacctctataagcctccatgttcacatctgtaaaatggagttaatgcctattatacagggtcatattgatagaattaaatgctctgtataaattaggtgcagaccaaaacagactcttttgatagattaaatgtttatcccctttgtccattcccttatctggaccaatgaaatgagtttgctttccactaaggacatggaaacataccttgaatttcttcatcttgcatgagaattattttcagaatctttctctagccttcactcacaggggaactggccccaggtgcacgttttgagtgctttcccacagtttacctcagctgtactctcctactaataatgccttcctgaaactaggcacttagaatggtcccaggccacagccagacatggcctcccatgtggcttcaggtcagccagagccagtcaatccgatatcctactactcgtaccctcttcttctgtttatgacattatggatccaaatacagataggtgtgcagctacttaaataagtctaactccagtaataccaaaataaccctaaatctgcaacagatgcaaggatgccccctgggggcaattgttaagtgtgatgacagctgggcatcaattaatacatttgtcacctgctcatgagataggatcatgggaggtttggcaaagggacagtctgttgaacactgcacaaaacttagtagcaagaaaaattatttgtgcaggtattcatttttattttactttaatgttctgccttatctagttgcctgttttgagtcacaactttctctgtgcatttagatgaggttaataagatggctggtgagagcagtgcccccttcagccaagattaccaaaaaaaaccttgttcaaatgcccctcagaatttttcctgggaaatatgggccttctcattatgggcttaatgttcataatttattaggtaataactatttaaaataaaactaagtaaagcagaaaatatatacttttctaacatttggagacttgtttgctaaattaaaagacgaagtgccaagactataaattactttcgtatgttgagggtgaatgtttaaattgtacttttttatttttaacagaatgtttactcatgagcttagcatttaaatggttaaaacaaggctttgaagttaacactccattaagatgaatgggggtaattcacacctctgcttgtgctatattatttcagtctggttgcagagaaaacaagacagcagtaggttgatttactgtgtgaaggccctttaaacacccaaggtctggaaatctttggggtgtgtgtgtgtgtgtgtatgcttttccatctagaagcaggatctgaaattcaatacaatctaggtatagaatcgaggtcttgaaaatactaaagattctctgctatccagcaattccatatctggcatttgacgggtagcacgttactggatcaacccaacctctctggctttgtttgctactgtactgtagtgtttcttcctaccacagcattttttaaacttcagcttagtatactggtaaatccatcagtggaaaagcagaaacgaattatccattttccggtgaactttgtatgtgccttcagatgggttatgagctaagcattggtcttcatgtgctcctttttaaaacattttcatctttgcaaaatctcctgttctatatttacctacatataaagcatctacctttaagaactttacaattttttctcatatccctggggtagtgaagtaagcagagatcagttgaaaaagagacatttctttctcaatgtgtcctttaaaccagttctatattgtatttgaaatgtgtattccacccattggtggaagtgctacagccatttgaccctgaaatgattcattttagggcctgggaataaggttatcttaacacaaatgaaatggcaaacactgtataagatgttaatgagtttggaagatctatctttaaggtaaacagatttttctcttctctcttctctgtcctgcatgtttgcaggctcaggttactgggtaatctgtgggtagctaggtgtggagagtacttccactctggctggctgtagtgctgacactgccaatacagtatatacagagagaaaatagatgctagaaacagagggactcaaactgaattaattttaacctgtttttctttttggcatgttaacagctctctgtggctgtgttagaattagccctatgttaaacatactttacttcctgcaaatttttctgcctagattttaggtgtcataatttttgaccttagaacatttcagaatctttttattgtactgagaaatttgttttttaaaaaactcaaatacacaatttattcttctgataatcttcctgtattttttccataaggaggtaggaaaagtaggaaacaaaattttgatggaggatgaataaagatattgtggacatggtttctttattgcaatcagaatcctttctgtttgtcacccttcctaaacaatctgataaatgtgtttattatcacagtaatctgttgtcctgctttgccaagctgtcagtcaggacaagcaattataaggaacaggaagactcatcttggctgatggccaggtgggcaggtgggaataagaggtttattcacctgtggtacaaagtaaatgggtagaaaggaaaattgagttgccagggagaaaaaaaaaacacaaaaacagatggatgaaaagacattgtaatatgggatgctataaagaaaaagacttgcagagaaatgtttctcacttgtttgagtgtacagtcatcccttgggggattggttccaggatctccctcatatatcaaaatccatgcacattcaagtcctgctgcagaaccacatatacaaaatatcaaccctgtgtaaacatgcgcagattttgcatcctgaaaatactatattttttatccgtatttgattgaaaaaagtcaactgttagtgaacccgtgcagttgaaacccatgttgttcaagagtcaactgtgtatatattttatctagtgttcatcagtggacagatacacaacacaagcaaaagggctggctaattcattcagcaaattcttagcacatattatgtcctagaagttgagctagtcccaaggtcatgaaactatgtaagacatacatacatcttgcttgaaaaaagttcagatacaacttttatttttctgactgaacattttcagaccaacttgataagtgaaattgcttaaatgaaaaattatacatgtatttttaatatatacatatgtttttaaaaaaagattttggagtcaaaattacctgtgttcgaatcccagcttctgtctctttctatatctttctaattttggacaagttactattctctgaacttgctgaagactcaatatttgactgggttttctctcaaccagaggaaactctccttcaagtgagattacatatttgggaaaaactcgagtaagccgttaagcattgaatatacgtacacttttattactttactgtccctcaaatcacataacttccaaccatgttgtctcttctgccgtctctgcttcagacatttagtcagcagcctgactagaaaacggtattctagaaatatcctgaccaatgcatttattttcactactgatgtatttttccccggaaaaagtaattcttgtagtttcatagtaaatattatccacatattttgactttacatcagcatttttagcaatgacattacacttttggcttataaagtatgtggtcagaaaagctgcaggccttttttaggtaaattaccctggtttctagaaccctgtacttgtgctgttgatttacattttttaaatatgagggaatatacatgcacacacacacacatatatatatatacacatatgtataggtacacatatacatacatacatatgtatctgttatctatgtgttaaatttcatcctgttagcttcagtgcaccacttaagcagttgagatcttttttttgaatcttgattctagtgcatcagtcaccattcccgcttttgtgacattcttcatcatacttacattttttcatcccattcacagataaaaatgttaaatgagacaagactaaccagagggccctgcagcccaccgctatcagtatttctcttgagttgttattaatctatactttggatgaagttgttaatattcctgtagtgtcatctaacctgcatttcctcacttcccttggaagtgacccccaaatcagtgggtacagcctaaactcctatctgttttctgtatttctagttgcttcagaacatttctgcttgggggctccacaatcacttcaaacttaacatgtccaaatccattcctcactacagttttctcatatctgtcagcagcccctgttttcatccaacatcccaactggctttcttgcttccattcctgctacctacagtccactttcatactgcaaagtagttgtttaaaaattcaaatcagattatattgctaccctgattaatttcctccaagggctttccatctcacttagaatgaaatccatgccatggcctacaaggctcaattttgtctgtacctacttatttctctgatgtcaatgtatctttcattctccagccacactggcctttctgcccctggaacacaccaagcttgttccctcacacttactgttttccctacttagagcataattttcaaagacctttgcaagccgggcttcttatttaagcctcgggtcaactgtcaccccctcagagaggtctgccctgcctgtcttatggtcatgaccgtcttatggcccccaacacatggtagtgcttttaactttaccctgttatacaggtcactgctggaaatcttgtttatgtgttgtctgtgtccactagactgaaagtttcataagaactgggacataactgtcttatttataaccaaatcctcagagcttaggacagtgcctggtactttggagtggcttaatatttgttgaatgaatgcataaaggaatctaacagactgtgtccttctactctttacctctaatctgtcacaatgtcagttcttctttgaaatgcctcctagatttgcttttatgctgacccagcctcctgccagactcctatctaaatctcagccttcatctctttgtgcctgaagtattgcagtgattatcacttcaggctgttctttggcatcacttgggcaactttgcaaaaattaccacatgcaggttccaccccaaccagttaaatccaaatctctgagggttacgacccaggcatcgataaacttcttagagcttcccagatgactccaatgcacaactactggattgccatatctacctgctagcagatgtatgtcttccagcccattttgcctgttactgttctctggtctccttggaatcctgctttcatagtattactctcttgctcaagaacctataatggctcactactacccccattaatcccagataatggctcactgctacccccattaatcccagataatggctcgctactacccccattaatcccagattcccttgcctcatccactaagctatatttgagccctttcttacgtatgttctacaatacccttaaactgttttttctgtctagcacttgatttgccttttattaccctcttctatattgttactcctctccctactcccacttccaggtacatacccagaatgtgacttattttccacctatccaaatgcttctcattcttcaacacccagctcaaatcccacttctgtaaacactttattctccactctagtctaccccttattatctgtatgattattttggtataccattagtaccttgtaagatttttcgtatttttttcataaactacttttgtaattttgtattcagtttttgagtgggtaatgtgcacatggtacagattttaaatttacaaaaataccctcccatccaattctatccccagcatccagttttcctccttggaagcaaccacttttacaactttctgtgttcttcccagtatattctatgcctctcttagagagagagagagagaatacacaaacacaaggagaatacacggatatacacccgcaaatgttggcatacaacatgaaatcctttgcccctttgacttctctttacttaacattatgactttttttagttgtgctaaaacaaaaaataaacaacacctaacatgaaatctgccctcttaacaaacttgtaagtgtacgatatagtgttgttaattatatgcacattgtatagtagatacctaaaactttttcatccggcatgactaaaactctgtgcctaattgaacagcaactccctatttccctgttcctgcagtccctggcaactgccattttactttttgcttctatgagtttgactgctctcgccatcttgtaccaaggaatcatgtagtattttgtccttttgtgactggcttgtttcacttagcatattgtcctcaagtattatgcatattgcagcacatggaagaattttcttcattctttaaggctgaataatattccattgtatgtgtataccacaatttctttatccatgaatctgccaatagacatttaggttgttttcacctcttggctattgtggataatgcagcaacaaacatgggagtgcaaatatctcttccaagattctgttttcaatcattttgtttaaatatccagaagtgagattgctgtatcatatggtagttctattttaaattttttgaagaatctctatactggtttccttaatggttgcactattttatgtttctatcagcagtgcacgagggttccaatttctccatatccttgccagcatttgttttttgttattttgataatgatcatcctaacaggtgtgaggcaatatctcattgtggttttgttttgcatttccctgataagtagtgatgttgagcatcttcatataatgtctggtcgtttgtatgtctttggggaaatttctttcatgtcctttgcccattttaaaatttaatttttttgttactgagttgttgtagttccttctatattttgtatattaaccccttatcagatatgcggtttgcaaatattttctctctccttaagatttttattctgttgattatttcttttgctgtgcagaatctcttctgttggatgttgtcccacttgtctatttttgatttagcattatgttttggagattattttgtatcagtatacacaaaactccctaaatattttaacagctgcatagtattctgttaatgcatagaccataatttaattagctagtttcctatcaatgcatattgagggattttttattttcaaatgttgcaattttatataatgcttcaaatgttatctttgtatacatatgtcatttagcacatatattaatatatctgtagtatatatttctatccatttaactggaattctgggtcaaagggcatgtgcatttttaattttggtaggtattactacattgaccttcattaaagattttattggctgggcacagtggctcatgcctgtaatcacagtactttgggaggctgaggtgagtggatcactcgagcccagaaattcaagaccagcctgggcaacatggcaaatccctctctctacaaaaaatacaaaaattagccaggtgtggtggcgtgtggccatagtccgagctacttgcgaggctgaggtgggaggattacatgatcccagggaggttgaggctgcagtgagttgtgattgctctactgcactgtagcctgggtgacagagtaaaatcctgtctcaaaaaaaaaaaaaggaaaaaagaagatatactgatttatattcacaacaactatgtaggaattaccctttcaattttgtgttgttatttagcttttcacatttaaatactttacctctctgactccgttgtaattaacccaaagacaggaactatgacattacatattagcatctctcacagtagttggtgctcagtaaatatttgttaaatcttgtgtatttagggagttttcccatgagtggcgtttctgatgagtcccatgtgagaattgtcccctttgcatgtttgctgtttccaggaaagggtgtgattgtgtgtgatattcttaggcgagatgcttagtctattttgtgttgctggagcctgggaaatccaatatcaaggtaccaacacgtttggtgtctggtgagggccttgtctccactcccaagatggcctttgaatgttccaccctctggaggggaggaatactgttcctcaaatgacacataagtgaaaagagaaagcccgcttccaaaggcacttttattttattttatttttattatttttatttttaatctttgtgagtacatagtaggtgtatatatttatggagtacatgacatgtttcgatacagacatgcaatgtgaaacagtcacaccatggagaatggggtatccatcccctcaagcatttatcctttgtgttacaaacaatccaattatacttagttatttttaaatgtgcgattaagtaattattgactatagtcatcctgttatgctatcaaatagtaggtcttactcatattttctatttttttgtgctcatttaccattttcaccctgcccctactaccccacaacccttgtcagcctctggtaaccatccttctgctctgtatgtccatgaattcaactgttttgatttttagatcccacagataagtgagaacatttgatgtttgtctttctgtgtctggtttatttcacttaacataatggtctccagttccatccatgttgttgcaaatgaaaagatctcattgtttttatggctgaatagcactccattgtgtatatgttccacattttctttattcattcatctgttgatggacacttaggttacttccaaatcttggctattatgaacagtactgcaacaaacatgggagtgcagatagctcttcagtatacctattttctttcttttgggtatacactcagcagtgggattgctggaccatatggtagctctatttttagttttttgaggaacctccaaactgttctctacagtggttgtactaatttacatcccccccaacagtgcataaaggtcccctttccccttttctccacatcctctccggcatttattattatctgtattttttataaaagccatttttattggggtgagatgatatggcaattttgatttgcatttctctgatgatcagtgatgttgagcaccttttcatatgtctgttagccatttgtttgtcctcttttgagaaatgtctattcaaatattttgcccattttttgattggattattatattttttccaatggagttgtttgagttcctcatatattctgattcttaatcccacttcagatgggtagtttgcagatattttcttctgaaagcacttttattatgatattaaacctactgaggaaggtggagccctcatggcctaatcacctcttaaaggctccatctcccaataccattacattggcaattaaatttcaacgtgagttttggggggaacaaacatttaacccatagcagacaccattcatttatatttttcttccaggatcctgtattatcattaactcagaaaggccaactaatccttggatctattatcaaatttggtttgtttgaataattaagtataaattagctaaatggaaaggctctcctctgtaagttctttaccatctttttatgatgaaaaattttaaacatgaatgcaagttgaaataatatgcccatatacctaccactgaaacttagcatttggtcgtatttattttgtgactcacatataaattatatttatatgtaaatatacagttaactttagaacaacatgggttttctaactgtgtgggtccacttatatggggatttttttctgcctctgccaccccgagaaggcaagaccaacccctcccctgccttcttctcagcctcctcaacatgaagacaatgagaatgaagacctttatgatgatccagtttcacttaatagtaaatatgttttctctttcttatgattttcttaatgacatttttgtttctctagcttactttattgtaagaaaatagtatataatacaaataacatacaaaatgtgtgttaatcaactgttattggtagggcttacagtcaacagtaggctattagcagttaagttttggtgggagagtcaaaaattgtacacagattttcaactgtgtggtgggtgggcacctctgacccccacattgttcaaaggtcaactgtaaatacatttatatttgctgaataatttgcaaagtaagttactgacattccatgaagcagtaagtaaagttgaaaattattttttgtaaaagtcaccatctaccttagctcaggctactataacaaaataccatagattggatggcttaacagaaatttatttctcatagctctggaagctgggaagtccaagaacatggtgctggctagaattattttggtcctggtgagggcctcttcctggcttgcaaatggctgccttcttgtgtcctcacatggtggagaaagagtgatctctgttcctcttcctataaagccactaatcccattatgagggtctcaccctcatcacttaatctaaccctgattatctcccaaagaccccatcttgaaatacttgtgggttagggcctcaatatgaattgaggggttggaggagacacaattctgtccacagaactttctgtgaacaagcctattattccctccctccctccctccctccctccctcccttccttccttccttctctttcttttctttctttcttctttcacaaatgttgtccctttctccaaaaggataagaagctgcttgatgcagctgtcaccagaacttctcttagtaagggaaatatccttaatgtctttttttttttggtggtggtggggaatatcttgataagtcatttaggtatgaacggtgaattcttatacagtggcacagcaatgtgagtttactaaatgcctgtgaattgtatactttaaagagggtcattttatgttatgtgaatttcacctcaatcaaaaaaaatgtgaccctatgaaaatggttggcaagaggagaggaagtgagagagatagctaaaccactctgcataaaagagaaaatgtgaatttgggaactggagaaaagcaaagggaaagaggcagagagtgctaacccagtggtgggagtctagaggaaaagtggctgacgggcattttaagaacagaagcgtttaatattcagttttaatttgcctgtctctgtctcctgaaactaataaagtcagtagacacaaaaataccttgtgtgaacagaattgtgcatgtaaacccttctttagactcacatgggacagaacacatacagccttatgctatccaggtgatccagaaacctcaaaaagtgaaattcaaaggcagagatggccaagaaaaaatgtaagccacttgcttcctcccagagtccgtgggcacatcaggagggttgtgggacgatcctcatatgagggatgtgattgaaccaacttttcctaattctcaaagtgtattgaactttccttgacatctcattggcaatatattgtcatttcattgctttaagggctcattatttactagtcatcaattgtacctgtaggggaatgcctctttttagagacaagagaccagacctccacagaggtagatcttggagattggagcagttctagaatttctaacatttccccttacggtcatcttgctaggttctctgtaacaaagcctggtagttcagaaatcaggctccaagaacgtgccatagatcaacctgtttgtgtgtgtgtgtgtgtgtgtgtgtgtgtgtgtgtgtgtgtgtgtgtgtgtgtgtatgtatttgggatcagagccactcaacttcctttttttttgaaacggagtttcactttttttgcccagactggagtgcaatgctgtgatctcggctcactgtaacctccacctcccaggttcaagcaattctcctgcctcagcctcccaagtagctgggattacaggcatgagccaccacacccagctaattttgtatttttagtagagacgaggtttctccatgttcatcaggctggtcttgaactcccgacctcaggtgatctgcccgtcttggcctcccaaagtgctgggattgcaggcatgagccaccacacccggccttcaactcaacttctacttagatggtggcagtaggaatcagagggagtggggcccctagggaagagcactcccatggaaaaagagtagaaacaaattttataattccctggttttcttacccagttctccaacctgctaaaatctgaaaaagtttcatactttaaatgaatggaagatcattagtctcataaaataatatgacactactgagctggcacttcggtgtatagaccaggttctatgccaagcacattctcatgtaatctgaggtaagcacagttatattccccatttaatagattagaaattaaagtttagagagactgtaaggttaaatgacttgttcaaggttatacatccttaagatgccatcctaagaatagaaactgaagtttgactataaaggctgtgtgcttaattaccatgtaaataaagtgtatccaactgttggagtttttttctacaaaaaggttctgctcatagcagatacatagtcaatattgactgtgttgaaggctgctttattcatttaaaatgtggcacctaaatctgttctgttacatcagccagacagtattttggccggccttgtgtcctcttgagtcatggttcattgccacagcactgttgtttctcctttgttaagtatttcagaggaaattctggacaaaggaaaggtatatgggtcttcaagtagagcagggatgtgttccagtagttgtcaactagactgagaaaacttggatgtcttacgaaacaatgtcagaaatccatttctgtgttctgtgactttctacaaacacaatttttaaaaatccaaatatagcttagaccatcagtagtctaattcagtgtttcccagatttgagatttcttttggaactttagaacgtcaaaatgaatcttgggacattgataagattgcagactttttattttataaattgattaaggatattaaacttgccactttcaatataaaaaattaaggaaggttataacctttgtgaaaaacttgctacatagttatttatctcatcaaagaccagtgaaaactttctcatagaccaacacttggaaactatcagtctaaataaccagtctatattcaaaaattcagtaaagatttcttcacttctaatgctcattgacttcagttatcttataggtggaaagaagtagatacaaaaacagatcttgattacaaaattcgttgatgacctagttgactctttccccagtcattactaatcctaacctttgggagcgaaaaatatctaaataagttctggtttacaaatttgcaaaatttttgtcaacacttcagaattcagaaaaaaacacaggacatttttactatataacttcctaagtttatatgatatatcaaaagtcagtaaggattataccataataatatttacatttcacagggaagcaaaatacttggagcctctccttgtctttgtctaaagatttgtcattcatttgcattcaaataaattctttgctttcattcatccagaatggttctcaatttattagctcatgagactacataaatagacttgtattcatacattttaatttcagtgtaaaatggctttcctcaatttttttttctactcaactctcccaaaagatgtctaatcactcccacactcagttacttaaacatttcataatgttgttacttctatagtaaaacaaaaagtaatttgcttttaataaatcagagagccctactgtagcaatctagaactttattctggcgagagcaaattctcaaattatatttccagcctcatttgtgaatagctgattttccctgtcacaaagcattgttaggtaggtacagtatttttctttagttggtaaactactggaacttacaatccaatggaggtgacctctatacaatacctgggacggtaataccctgaagcgcagggtgtggctattgcatgtgccacatgcacatgaggccatctgtgcgtgcttgttgaaagaatgacatatcttggtgagtaatatgaacattaaaagctctgctggataagctcatagaggtggggttcactgccttctgggtgagtggggaagactttgtgaagaaagcaacaactgaagtaaaattgaaggataaccaaagtagaaatgagaatgaaaggaagatactcctgtttggaaagaaaatactaacaatatgtacaggaaaatacaaggtatactttggagatgacaagtaaaaattttgccaggagcacagatgtaatagcaatttgagaagtaaagctgaagggtaggatcctgatgtagagaatgctggacccaggctgagcttggactttacatcaagtagaagtggtagagaaagattaattgcctctctgcattggactagtgccatcgtcttccaaaagctaaaaagaagcactttaggccttcaagggctagttatctaaaaaccacacttgatttgttcttaagtctcagctcctgggcatatgaggaactttttctggagttttggaaaattcctcatgccctcagatcctattaagacctctggcatctttttttttttaattatttaatttatttatttttattttttattttatttatttatttatttatttattttgagacagggtctcattctgtcgcacaggttggcgtgcagtggtgtgatctcagctcattgcaacctctgcctcccggactcaagcaatcctcccacctcagcctccagagtagctgagactacaggtatgcgccaccatgcccagctaatttttgtactttttgtagagacagggtttcaccatgttgcccaggctagtctcgaactcctgagctcaagcaatccgcccactttggcctcccaaaattctgggattacaggcgtgagccaccgagccaggtcaagacctctggcatcttaagagacttcctatgagttcctgcctccaaacttttttttttttttttttttttgagacagagtctcgctctgtcgcccaggctggagtgcagtggcgggtattggcttactgcaacctctgcctcccgggttcaagcgattctcctgcctccacctcctgagtagctgggattacaggcacacactactacacctagctaatttttctatttttattagaggcggggtttcaccatgttggtcaggctggtctcgaacttctgacctctggtgatctacccacctcagcctcccagagtgctgggattacaggtgtgagccactgtgcccggcctcctgcctccaaacttttgcacaaaccattcatgttgtttttctctttcccctccaaagcgtttcttctccctcaaaacctgtttccacactcaacctcctctagaaggacttacctgactatgacttaatgtaactgctccattactcaggaaacctatgctcaacatcttgatgctacatttaatttctctaaatgataaaatatacaaattcttgtatatttgtatgtctaaccaccctgcgacagcctttaggaaaggttccacatctgccaactcctttgtatcctccatccagaacctgcctcccatccctactttacccatccacctcagagacttcatggtacagtgcagtatacttggtgagtgttgatggtttaagagtgtgccctgaacaacgaaggatttctttgaggctgaaatcctgtgggatccatggaatgggagtttcacctgtctttggcttctgctcctttccccagcatgtgtagagcttctagaacagtccccagcaagagaggatcacttggtacacctctttcttatcctcactgtctccagtctctgctgtaggcctgctagtgatgatcaggatacaggttttaacatggccaagctgttaataacctgagattgggcaccatgaacaataagcattaaaaggcaataacaacaacaacaacataacctgttaattttatgcaggcttaattttttaaagaactatttcttcctaacttgcttttactcttcttcatctactttctcatacctatgactgacaatgataaggacacccacccactatacacacctaattccatccctccaaatttgatttcgtgttctctagagctggcgtgttatgtgacctattgtggggagaggctcagctgagggactctgtgatgccaaatggacaaaggcacacttttttctccaggtcccagcctggtgaaagtcatagcacctgagaatttggagctgactctctcctttggaaattgtgccttccaaaaatatatcttacactgcctgtacctgcatgcaataggttttggttcttaccaactgcagcttcagtctgaacttgagttctaccctcatggatgcaaatcaaaacagctcagaatcaagtctgggaagcaagtcgaagtggtttgatttgcatggggagcttttgtctctgcatgaaggcagccaaattccctaggctccccagccctccggaaatatgctttacaggacccgggggcccaggcccagtcgggtgggtgtgatttgaatgttctctgctacagctgctgcaccgggccctggtcactgctgttggtttcgctccattttactgcctcagaatccccctgtgcatgttagtggttaatacagcagccaggagacgccagacagctctcggcacctggttcaaatttaaggctcatttacacatgatgtcacacacgcattgtcagcgcgagggaggtcaggatggttcattttgggaaggttcacattgttgagtctttacaacactcactgctattaatgctttaaccatctgacttggatttcggttttctggcatgaggtaatcccaggcactagatttatatgctgaatgggaagccagcaatggtggctaatcatgctggtttgcagatctgcacctctggagccttgggatggaattagagggccacatggcaagtagcaaatcataggcgttttgagcaggagaggaattagccagacctggaagcaggggccatagatggggtgttgtctgagccaggaagtttgattgaagaatggaaaccaaggtaaattggacaaggatctgggcccagagaccacaggaattattctactttgaccagtgctttgggtcattgcttgaactgtccttttgctcatcactcatagaaatcccagacccatcttcccaggtccagcgtaagtctttcatgttccatgaagcctttcctgaccacccatcccacagcaggggctgaggtggttagatcaccagaggtcagaagttcgagaccagcctgaccaacatggtgaaaccccatctctaataaaaatacaaaaattagctaggcgtagtagtgtgtgcctgtaatcccagctactcaggaggtggaggcaggagaatcgcttgaacccgggaggcagaggttgcagtaagccaatacccgccactgcactccagcctgggcgacagagcgagactctgtctcaaaaaaaaatttctctcctgaatccctaagtacttttgttactgagtacttaatttgtgcgactagctcattttaccctcacaattccaaagggaaggctttattatttctcttttacagatgacaagacaggttcagagaggttaaataatgtatccagtgtcaaacttttaaaagtcaggatggaatcctgattccaagcttaggttctgaaccactggggtaggctgtgtagtactacattttctgtggaacgtggtatcggtaacatgggagagacaggctgtgcctcaggaagatgccacatgggagtgcacagcagtgctgtagtgcctcgtgtttatgtgtagtcccaggtgcctggctgtaaacaactgcagggcagtgaccatcacctctgcttttctgcatccccacacttcctaacacagtgtcccccaaagtgtgcatcaatggatggatgaatattagcacccccgcaccaccctcacctaaaacatactgaaaagtttgagatctttggataaccaccccatcccctgctgttgtcttctgtcatacggctgaaatcgtaaaactggtctgcctgtcacagctccagtgagcctacttactcactggaaattcagagaatgtctttagtcctgttgactgctttgattttgttttttaacttgtaccaagacctgttgccatgatgggtctctgcaaatgggctttcttgttccatgagtctctgttttagtcaagtgaagggcacactccttttcattggccacctcttacttttcctccaagaggagtactcactcccagaaccctttgctgggctctcatgccgagcttaggtgccccttcagtgtgcttctgcagcactcattaccccgtagtagcattgtagtttaattcctgtttgcttgactgaagcagagactcacctgcagacgcctgtaggtgccttccacgttgctcagatgaacagtagagaagggtcaggcctgccctaggtttctacccctctcctcaaggccctttctagtcaccacgccacatcctgctcatgactgcagggatcatgcctctgggcctctgtccatgcagctgcctctgcctgcactccaggacaggggccttctctgctgtccactggagccctgtggaagggactcctgaccctagccttagggaagtcatctctaaaggctgttttattacagtgtttcctcagaatgaccctatagacacagtgttttctcagtgtcctctcacctttgaacatatccgggaataattgaaaaaaccaggcaatcaaatgtgcctctcataaatcaccatcacttcagagcagaacttaagagtttggtttgcaagccacaccaaatagtttgagcttggccctctaccatttcctcctgctctgagcccagaggttcacctagtggactgtagcaatggattcccttgcccctggcttcctgttgggttcagccagagagcagcaccagtgggagcctacagagggaggaaagtgaggtcaaggtgtctgctgcctcctccctgcctgccaggccactgtgggtagactacacctcaggtggccctccccatgtgtagccatgcttgccaggttctgggttctggaaacctccacctcctcttgccccttcagtcatagggtggtagcccccttcattgctattagctgttatgcactcaattgtgttccaaccccaaattcgtaggttgaggccccaatccccaggacctcagaatgcaactgtatttggagatagggtctttaaagaagtaattaaattaaaatgaggccattaagccctaattcaatgtgactggtgttcttgtaagaaaaggaagagataccatggagatgtgcacccagaggaaaggccacgcaaggacacagcaagaaggcaactgtttacaagccaagggaagaggcctcaggagaaccaaacgtgtccacaccttgatcttgcacttcccaacctccagaactgtgagcaaataaatgatgttgtttaatcaccca

SEQ ID NO: 526 - DNA, 71431 bp, Homo sapiens
cgtcatcagatcaagtcgactcgctcctctccttccaggccctggtgaagtacggaatgccggaagggccgggctcaaagctccgcctctggcgcgaccgacgactggagcgcagggcaggggtagaggctcgtagatggaactggtagtcagctggagagcagcatggaggcgtcctgggggagcttcaacgctgagcggggctggtatgtctctgtccagcagcctgaagaagcggaggccgaagagttgagtccgttgctaagcaacgtaagtgggctgtgttcgcttccccgcgctgacgccctccggcttccctcaagtgcctgccaaataagacccagaaaaggaggaccgcaccgggacaggggagatgctggagcctgaaccctgggggatggggtctgaaggcagccgccgagattcagatgagattggcgcagttatgaacgtgatagcagcctagcatactctagaaagaaaagatgaaaagcgtcgggtggaagagatgcagcgttgagtggaagctgcgaacatgatgggatgagcggccctaggattatgtactcactgctgttagttagtatttttgtcaccttattttctccaccagtctcgtgaggtctttgcaagagtcacaggattttcctcttccgacttagtcatggggggagggaaaataataaacattttaatacagaaattcttagcggtagaatggaagtggcttggtagtaagtgcatagcacgttcctgaccctaaagcctgtgcagtgggcactccgctttttaactcgagtcctagacactgttcccaggactttgttcccggtgctgtttgtggggagggggatgttttcagggatactgccagaacaacgtgaattgcttctgtttataatattgtcattgcaagatattcctgaccatccttccagtttggtagaactaattcattagatatataagtagagattagttgtgcagtcctagtaattgaggagaaacaactgcccacagcagtcccaggttgactcagcaattctttagtaatcacatgagctgaggccttatccctcctctctctccccactccattcccatcctatcttcatctcttgcagtcacaaggttagtcatggcccttcctgaactctgcctgtcttgtgtactggtggaaatcattttcctaagaaaccctagattcctggagctgcagtagtgggaggtgggaaggaaaggaaaggaaattagtgttggttaagcaacgagtgtgtcatacaaaccctggtggtttgcagcttttttccataatctttcatttatggaatttctttacgaaattttaacttcaccgtccaaacatttaacactactaaatttgtgtgcttacaggaacttcacagacagcgatccccaggtgtttcatttggtttatcagtgtttaatttgatgaatgccatcatgggaagtggcatccttggcttagcttatgttttggctaataccggtgtctttggatttaggtgagtcttcatattttagcatcaaatttttttttccattttgataatatacggagaagtagagagatagattccagaagctgctattatacaatttctagttagttatttctggggttttagcatttttcttgttattcttgttgctagtgtgtaccttggagggctactacatagcttcttaaatacacagaagtgtgactagtttttaaaaatgggaacttgatccacatttcatttataatgaaatatgacacttaagagtggcatattcattgtatctccttggccaaagtgaatcaaagccatgcagattaacttccaaatagcaattttgtgagtgcaaatacaacacataatcttttcattcctcgctgtctctttgtattgttaagtagtcttatttcactttcagaggccagacatgtgttttgtgcctgttcttttttatgtttcaggacttagcttgtaggccagtttgcccaaaatagaagacaatcctggatattctgtgctttcatagtactttgtatattcattctgttattataattgttacaatgatatgtttggaaattaatgttcccactaaactgaaatcctttacaactggaggtcaaggcaggcggatcactggaacccacgagtttgagaccaacctgggcaagatggtgaaaccccatctctgcccaaaatacaaaaattagcctggtatggtggagtgcgcctgtagtcctagctacttgggaggactgcttgagcctgagaggttgaggctgcagtgagccatgattgggctactgcactctagcctgggtgacagagtgagatcctgtctaaaaaatttaaaaaatagaaaaatcctttataactggaccttattcttagcatctagcaccacatggctaatagaatgaattaacaaattggctttgtcagtagaagcagatctatttactaggaaatttaaaatgcctagggagtctcttttatgtttatttcctgcttttattccaaattttttgataagcaaagcaacttttaagtaacccaacttgcttttattatggaatgtactcacaaactttcattatttttaaaattaaaaactatatgtgacaccttaagcaagacatagtcagaggactttttttttgattctctttgaaaaatcataatttatgcaccagggtcttacatgcagatatatactgctgaatgtgtgctcacccagtcatagcaaccatcatttttggtgatgctaaagtgttattttgtgaagttcctgatgtcagtttaatgacatttgtacttttacctctcaattttatttattaacaagtattaactggaccacagagagaaaatttcttcaatgactggggcagttcactggggatagctgtatagaagcttgtcctgctggtgtcttcctaaaaatgaataggaaattatctaagttttttctttcacactgttggtgagaggacctcaatcattacattgtttgcacatttttcaaattgcatcattagaggtgtgttaactacattattttaatttagtttggtttggagagtgtgtgcgtttaatagatgctagaaaatacagcctaaataaatcttaagtacaccttaataagatgaaggtatgataaggaggtcaatatcactggaagtagagggaggaagggaaaaagagaagacaatgagattgcataagtaaaacttctgtttagacttaaaataagaagaaaaccagtcataaaaaggaaatattacaagattatttaatggctgattcagcagtcagcagacaagactgcaaaatgaggaagtttgcttgtatttttaaaaaagtttggtttttatttttttttattttaaaatcagtatattttcatttaaataaaattggtaaatacaaaaaagtagaaaagtatcttcttaatttccttaatgaacataattctgctactcagagatagttcctgtgaatatttgactgttaagcaatttgtttttgtaatgagacaccatacaaaagacaaacttttgggaggttttgaccaggtgttcttttatgttttagcttcttgctgctgacagttgctctcctggcttcttactcagtccatcttctgcttagtatgtgtattcagacaggtgagtaaaaatgttatgctgcttcatttaataaaggagtctcttgagtttgtatctacatatagaactggatgtctcaaatctaatatccagtgagcatacatttttattagatagggtgatcggaatggagaatttgaaaaaccaggatatacagacccaatactgtgggggaatatccaagcacaggatgggaggaggtaattagcatttttacctgctttcctccacaacacaacctaattttctggagtagagtagatcatgggagggtctaaaaggtgttcaaaggatccaaaccttatgcttatggagaaatcattttctcaaggagagaacaccttctcagagctactgttgccttccctgcccccatctgcctgctagtcagaggtagggatggcagaattaggattgtaggaagtaaggtcacaaagctttaatttatttagacacattttgtatttttaattgcaagtctagaatagggtagttttttcctaagagaaataagtatgtgcagttaattcaatatatttgtgtatatactttttcccatttggaattttattatgcaattcagtcatgtattgaataagttcttttaggatccagtaaataaaagtatatgaattatagaagtgcttttctaagattttccttttgtcattaacaaatattctatgttcatcagtcctggtctttttatctgtctagtctcttttgtctttggattaggtcagctttgatgccaaaatcatgggtttaattcttatatggatgagttcgttttgctttatctggccttgtgatgttcagattttaagaagaaaagtagatacacaaaatagataaaaatggatttcttaattcatttagtgtttctataaaagaatacctgaggctgcataatttataaataaaagaggtttattttgctcatagttctacaggctctgcaagaagcatggcccttcttatgaggggcttttctgctccatctgcatctagtaaggggctcaggctgctttcattcattgtggaaggtgaaggggagctaggatatgcagagatcacatggcaagagaggaagcgagagaggaggggcatgccaggttctttttaacaaccagctctcatgaaactaataaaagtgaaaactcactcattaccccaaggaaggcaccaagccattcatgagggatctggccccagggcccaaacacctcccctttggccctacctccaacactggggatctgatttcaacatgagatttggaggggtctgacaaaccaaactatatcagtgagactattctgtgctgaaacaggtgagtgaagcccagtgatgtttcttaagaattttaagactcttcagaataattctgaagccactgctctagtttgttttcctaaaacctgtccatcatcagaaatactcatagatctttttatacacagagagctctaagcctcagggattctaatttcaaaaatctgaggtgagactcaagaatatgtttttaacaaggcaaaaccagtttaggatccatagtttatagctctaacttgtaccagtgctttggccagccagtgccagatatgtttttaacaagtcctccaagtgattcttatgcaaatctagtttaggattcatagtttatagccacaacttctaacagtgctttggccatccagtgcacgcctttgctctcaaggggcttgggtgaatgtgcagacagatgaaaatactaggaagcagtacaaatattaatcctaaagtaacaggttgttcataaaagcatcctgaatttaggaataatagctttagataaatatatttgtaaatcctgctgaaacttgaattttaattgcatgtattgaaattttgctgaatgtgaaaaaaattttacttaattgtgatactttaacatcttggtagattctttcaattcattctgttaaaagattaatactttagtcaactatgtggcaattatgtctttcaagcttcattttaaaacttcattttagttttaatttaagtaaaatgttttatttcggttatgtgggagtagtattcagtgtgtggagatttctaagtaattttaattttttactccttcggttcacatgtatttaactttaagattctgacactgtgtttgttcttttctgtaactctggggcgtatgaagtgaatatatctgtttctcttcttttttctttttctttgatttctgtagcctacttgggcccatgaactaactacttcatggttctgcctgcacattgactcacctgtcttccgttgattgaattccttcaatctttgtaaaattctctgtggaggtaggcttttccttttttttttttttttcaatacatacattcatatataaagactagagtataatacgtaactaactctctcccaacagtttgttggactgtcataaaggattattatgctcagattgaattcattggtaagagaaagagctatcatgagtttttatgaaataacttcttcatttatttgctggtggtaaagggtaaagagaaattttcatctttataaaagtaaaggatttcttcacatgaaattctactttagattttatggagcgtttggggtctatcaggacttttcatgggagctgaggtggaatgtaaagaaccttattctctctagccttcgtttgtcatctgtaaaatggcaatgataacacttccttcttggaattgttctgagagtgaaataaaataatgtatatgaaatgtcaagtccttggcaaatgagtgctccctggggcaaaaatgcccactggggcaaaaatccctaaagattgcagggtgttgtacacactactatctcagaaatagttggttcgttgccattcttttggaatacttctcatgctctgatactaaacccacagctcccctccactggcttccatgtcactgtcaactggagagagtgagagtcctagaactctgcatacctctggccgaaccacaactccctagtcgttgatccctactactcactggattgtcaccattatttgccttgagaccatttggattatgacattataccatctatctcaatttgtgttagtcatttcaagtatattaggttatctttcatttctcagactcatcccatatggctgtcatctgtttctgacctcgtcttccactgctctctaactcctgaaacccttccactgtgctctctggaactcacagtcaatcatcagcaaaactcacatgtctctaattctcttctgaacatttctgtctgtttcttacactacgagaacctcctctgaggcttccctgtagttctctcaagtggtcagtcttttctctttatgtctctcatactaatttgaagatggtataggtgtcctgtttgtcccacatttctgcttctcaaccatcttcctctccttgaaccccccagcttttaatctcatgaatgtataccatctacggctctccttactattgtcatctatagactcctagaccatttcctgtcatttcatgaaagttttagctaaattttagcttctactcaccttttagttctcttcagtattacccctgttataattctggatgatttcaatatgcatgtagctaatccttctaatgctttcagttcctgaacctcttcttctctaatgatcatattctctacctacactggccacttattttctcctatggtcataccactgatcttgtcattaccaaaatagcatttgttagtatctgcccatctgccaccaccatctcctttgtttctaactcaccctctcaagtacttcaactctgacagttttcacccctaccaagacttctatcaattcattgattctaccacctttgcactgaccccccacactcattcttacttccctctttatccagttgaggttttgtagtatgttatttaatcccttgcctatcccttgaaccatcatatttccctggtaaaattccaaccatagttaaatataactctgcctgcttcacatttgcacccatgcatttgaatcttcctgaggaaaagcacaaccatgcagactgatatcactataattcaacgtctagtgtacctatgatgctatcacacaattctggttcacttctttggttcatcacttcatttagctcattcatctgctatctaggagattgcttttttatatcttctcctgtcaaaccttcgacacttttttctttgatttcacccataactgatattcttcgctttctgtttcactgaaaaaatagaagcaatcataaaagaattttataagctcttgccaccacttatttatctgtgcctatatactctgttccttgggatgaattctttgtgtttatttctaaggcctaccccccaacttgtgctatgatcccacctgctcttgcctacatcactccagccactttctcccttctttcttatttcttggcccttttctaccatttccttcctatcattttacaaatagtctaatttctgtcatcataaaaatctcttttactttgcatcttttgaatatgcctcatgtcttcatgacagcactccttaaaataattgtctaaaccaggccaggtgtggtgtctcatgcccgtaatcctagcacttcgggaggcagacccaggaggatcacttgaagtcaggagtttgagaccagcctgggcaacatggtgaaaccccatctctacaaaaaaaaatacaaaaatttgtgtgaggtgacatgagcctgtagtcctagctactggggcagctgaggcaggagaatcacttgagccagggaggcagaggttgcagtgagctgagatcatgctgttgcacttcagcctgggggacgggagtgaaaccctgtctccaaaaagaaaaagaattatctaaaccagatgtctccagttcctctcctcccactcctatcaggcttttccactgaaactgttgtagcagtgacttccacattgctaaatccaatgatcagttctcagtcagcagcatgtgacagagctgataactccttgctctctgaaagacaagtcacgctttcctagttcttcctgtttcatcaaacactccttttctcttctgttgaattctcttaatctccccatcctctaaacattggtgtacccctgggactattcctctgatctcttttcttttcccttcttttcttttttttttgagacagagtctcactctgtcacccaggctggaatgcaatggtgtgattttggctcactgtaacctccgtcctgcagggttcaagcgattctcctgcctcagccgtctgagtaggtgggattatagatgtgtgccaccacacccagataagttttgtatttttagtagaaacagggttttgccatgttggccaggctggtctcaaacttctggcttcaagtgatccacccaccttgtcctcccaaagtgctgggattacaggtgtgagtgatctcttttcttttacactcattatcgggctcatggtgattctgaaatttatatccctggcctggaactctcccctgaatttcagtctcatctccagctgcctccgtgacatctccacttggatgtctaacagctcagatttgtaaaactccccatctttatactaccaatctacactttctactgttcccatctaagtaaatggtaatgtctttcttctaattgcttaggccaaagatctttaagttattctgtatctcccctttttcccctcatcctgcatgttcagtccatgccatactgttcccttcacttcaaaaaaaattttttttcgagatagtgtcttgctgtgtggcccaggctggaatgtagtggcgtgaacatagctcactgcagcctcgacctcctgcctcagcctcccgggtagctggtaatcacaggcacacatcaccatgcacgtcaccacacctaactaacctcagcctcctgagcagctggtactacaggctatgtgcgtcaccacacctggctcattttttaattttttgcagagatgggctcttaccacgatgcctaggctgttttccaacaccagctcaagcaatcctcctgccttgacctcccagagtgcttgggattacaggcatgagccatcgtgcctggccaaaaaattaataatctgataattttctcatttaattgctaccacccatcttcagttactattaccaccatcaaaagtaatagtttatctttttgtttttacttccactcttacttcctgcagtctattcttaacaaaacaaccataatgatctgttaatgtaagttaggtcatagcattcctttgctcaaaatcctccagttgcttcccagttcaatcaaagtaaaagcaaaaatcattacaaagtccaacacaagtcttctgccctttttatctccttgatttatcttccagtactccctcactggtttcagtcacacttttaatttttatcttatgtaacatatacttatatagcacttagcatcattctaaggactttatgaatatgaatattcatttaatcttcataataatattatgaggtacgtatcaatattatttccattttttgaaatgaggtaactgtggcacagagaggttaaagtaacttgtccaagagaggtgaaagtaacttcccagttaggaagtataggagccaggattcaaacccacacagtctggctctaaaattgtgctcactcttccccagtcgtgctgggtagtctcctgcttccatacctttgtgctttctgtgctcttcttggacgtttcttcccccagtttcccacatgactttgctcactcatcaccttcaaggctttgacaaatcttacctcttctgtgaggtctttttatacaatctcatttaaaattacaaacagcaacggttgatctacagtgtcatcaaggaaggaggatctacctttctgttccattattcttgtgtgtgccttccccatccttgaggtctaggacgacttgtggagtgcagacatcgcatccgtgttctagagagcagaaagagagaaagggatgcctaccagctgaatctcacttaagactccattttcttgttgccagaacttaatatgcccgatggccatactaaattgcatagggacctagaaaatgtagcgtttattaaaggtggcaatgagcccaactaaaagtcagggttctgttactcaggtagaagaagggaagagacaaccagcagtctctaccccaccagggttccatctttatccgtacttgtactttactatctttgaataacattataaacttttatagcttagctaccaaaaataggttgacgactctcatccatgctgccgaaacatatcagctacctctgatattggagatctccatttagatgttccagaggctttgtgagctcaacgtgtttaaaattaaacttatctttcatctttaatggctcaaatgtgctcctcttcctgtaccgtacctccgtgaatggtaccaccagtttatatctccttcacctcgtacattcacccagttataaattaattttgtaaatatttctcggatctgcctaattctccttccttattgctactgtgtagatcacgccataacccctccccaggattacagtagagttaaatcataacaggtatttaagttcatgtcattttaattcatacagttcaaaagtggggaagaaaataactttaaatagtgctgggtaatcctgcctgtattctactcagtgaacatatattcatctggggactgagtgtgaggtgggaaatataataatgttgctccctctgttatattttttttctttaaagataacttttttttttttaagacaaagtctcgctctgttgtccaggatggagtgcagtggcgcgatctagccaaaccgcaacctccgcctcctgggttcaagcaattctcatgtctcagccctctggcatcttaagagacttcctatgagttcctgcctccaaacttttttttttttttttgaggcagtcttgctctgtcgcccaggctggaatgcagtggtggatctttgctcgctgcaacctctgcctcccgggttcaagtgattctcctgcctcagcctcccaagtagctgggattacaggcacccaccaccacatccggctgatttttgtattttttagtagagacggggttttacagcgttggccaggctggtatagaactcctgacttcaggtgatctgcccacctcggcctcccaaacggttgggattacaggcgtgagccaccgcacctggccagataacattttttagcatactgtcttcatggtgctgttttaagagatttgcatgtattattctcacaatagcaatgtgaggtagaaattgttacatccactttagagataggaaactgaggcactgagtgattaactagcttgcttaaggttgcacagctagctagttagaagagctaatattcgatttaggcaagctaactccagagtccactttcataacactgtgctgccatttccccactattataggaacctggaagcttattttctggagaaggtaaactaaaaggactcagcaatcatagatattaggtgtagttaaggccaagatcaccttactgaaaacagggagattaagtgaaagtctactaactgaaggagagtcccagttagtaggagttctgagactgctggcagcaagtcttctactttcacttaagggattggaggaatattttcaacagaatttctcctgcccaagagaaaagacctacaggtaaaaatagttgagggcccttcaagaaagagctgagtacctcctgtttaatcatcatatagttaagcataccactcaataagcctcttctgtgtacacagagcttgtatttagtcttttaatgcatcacacttacgtcaagaaatagccaagtatcaccagatatttcaggaaaacctttaatgtgaaagatatatactaaaacagccacatacacacacacaagccaataatgagatacctctacacatgtattagaatgacaaaaatctgaaacactgacaataccaaatactggcgaggatgtgggacaacaggaactctcattcattgctggtgggaataagaaatggtacagctactttggaatacagtttggcagttttttaaccaaactaaatataatctcatcataggatccatcagtagtgctccttggtatttacccaaatgagttcaagacatatttctacacaaaaacctccataaagatgttaataacagccttatatttaccaaaatctggaagcaactaaaatgttcctcagaagtgaaagaattttaaaaactgatatatttgtacaatgggatattattcagcactaagtagaaatgaggtgccggagccttggctcacgcctgtaatcccagcactttgggaggccaaggcgggcggatcacctgaggttgggagatcgagaccaacctgaccaacatggggaaaccctgtctctactaaaaatacaaaattacctgggcgtggtgctgcatgcctgtaatcccagctactcaggaggctgaggcaggagaatcgcttgaacccgggagttggaggttgcggtgagctgagatcaagccattgcactccagcctgagcaacaagagcaaaactccgtctcagaaaaaaattagctgggcatgatggcgggcacctgtaatcccagctagttgggaggctgaagcaggagaatcgcttgaaccccggaggcggagactgcagtgagctgagatcatgccattgcactccagcctgggcgacaagagcaaaacctcgtctcaaaaaaaaaaaaaaaaatacccagcatggtggctcacgcctgtactcccagcactttgggaggccgaggtgggcggatcacctgaggtcaggagatcaagaccagcctggccaacatggtgaaaccccgtctctactaaaaatacaaaaattagccaagtgtggtgacacacacctgtaatcccagctacttgggaggctgaggcaggagaatcacttcaacccaggtgatggaggttgcagtgagctgaaatcgtgccactgcactccagcctgggcgacagagcaagactccatctcaaaaaaaaaaaaaaaaaaaaaagaagaagaaatgaggcatcaagccatgaaaagtcatggaggaatcttaaatgtatactgtcaagtgaaagaaaccatgtgatccagcaattcctcttctgggtttatacccaaaggaaatgaaattggtaccttgtagagatatctatgctcccatgttcattgcagcattattaacgatagccaagttagagaaacaacctaagtgtcagtaagtgagtatataaaaaattgtgatatgtacgtacagtgcaatattgttcagacttaaggagatcctgccattttcaacaacatgcatagacatggagaacattatgctaaatgaaatgagccagacacagaaggaaaaatactgcatgatctcacattcatgtggaatctaaaaaagtcaaatacatatgaacagagtagaacagtggttatgtgggggatgggaagatgttcatcaaagggtataaagttgcagttatgtagaatgaataagtctacagagctaatgtacagcatgatgactatatgtaatattgtttactgaaaatttgccaagagagtagatttcaggtgcttttaccacaaggaaggaagaaagggaggaggaagggcaagagggaaggaagggagggaggaaagaaaagataactgtgagagggtagatacgttaatttgcttgactctagtaatcatttctctgtgtatatcaaaacatcatgttgtacaccttaaatgtatataataaaacaaaaaaatctgaaaaggctacatactgtatgattccaagtatgtgacattctggaaaaggcaaaactatgcagaaaataaaaaagatcagtggttgccagagtttagcagagggagcgtgaataggcagagcaccctcacctttaggacagtgaaatgaatctgtatgatactataaagtggacacgtgtcattatatatttgtcaaaacccatagaatgtacagcactaaaagtgaaccctataatgtaaattatggactttgtgtgataatgacatgttaatatagatacattgattgtaacaaatgtaccactctggtgcaggatgttgattgtaggggaagctgtgcatgtgttgggggcaggaggtatatgggaactctgtactttctgttcaactttgttgtgaacctaaaactgctcctaaaattattaaagaaaacacaaggaaagaaacagactcagaggaaaagaggaaacagacaatacaagaccagatgaaaacttaaaaagctacatttaataactttagagaactaaaagaagatcctgcattcttgaaacaaaaataaggaattataaaaagggtatattcagaaaaccaaaagtcctagaagtcaaaattagttcaattgttgggttgggagagttacagaagtttcctgggggtggaaaaaaagagaaagcttgaaaatgggagagaaaagataagaaaattagaagatcagtccaggaagtccaacatgcaaataatagaaattctgcaacaagaaaaaagtaaaagggatggtagaaaattattaacaaaataatacaaaaattgatgtaactgaaggaaattagtttcaagattaaaagttttcctcccggtatccagtataatacttgtaagataattgttacccaagacatactgtgaatgatcagaaatccagttatatagataatattctaaaagcttacagagagaaggaacaaacaacacaaaaaaaattcctgcaaagaatcaagaaccacagtagtgaaagtcttcctaggagcaatactgtaaactagatgactataaaacaatgccttcaaaattcctggggggaaatgattttaatatagaattctataactagccaaactgttgcttaagtgtgaagtttgaacaatgacattttcatatatacaaggtctcaaaaatttttattcacccttacttagtgaacaatagagtataccctttaccaaagttagagagtaacaaagaaacaaggaatcaggcacaggaaagaagtggagggaattcccaggacataactaagcagcagatctaagcaccatctacagattggagttgtgaggttttttgtggttttgggagggggtgtttagatgggatctcactctgctgcccaggctggagtgcagtggtgtaatcttggctcactgcaacctccacctcccaggctcaagtgatcctcccacctcagcctcctgagtagcttcccacctcagcctcctgagtagctgggactacaggtgtgcaccaccacacctggctaatttttgtactttttgtagagatggggtttcaccatgttggtcaggctgatctgaaactcctaagctccagcgatttgcccacctcagcttcccaaagtactgggattatagatgtgagccactgcctggctggagttgttcttttcacaaaggcacagtcctcgctccaggtcatgcctgccctctggattgtgttcaggatggaaactcttttcttattcctctgagtaaagggattgtctttctcatttgtcggtctaactcttaatttgtgttaacagtgcttgagtagattagcagtcaggccgggctgttaaaaaagtcagaataaaatagggattgaaccaaggtagtaataaggtgaataaaagaaagaaacaggttaacaaatggtggggtgcagcagagttccagttgagaggagctgatatctgagtaaatgtggacaataaaggagaagtagatgtctggtgtatctcccaggtttccggcttgagccactggattaatgatagtgtcatcaatgaagataggaacacagtaggaggaggttgttcaaaataaaaatgagttcagttttagacttatatgtaggtggacaaggcttagaactgaagcacaggctagaaattcattcattcaatactcttgtctactaataagaaagagataaataagagccagttacttccctgaaaaagctcatagtctaataggggaaacaaatacataagcaaataatttatatctagtatgataaatttaacagtttaaatatgtataaggcatagtgatatcttagaagagagagtgactttgatatgggcaggaggcagggaaatactgggtagaagagggtggttccccagcaaaggcccccaccccccaagcctggaaacccatggccctaattgggaacaggcatttctgttttcatgtccaaatgttgccttctgcctgccatccccgcatcctgtacccatataaaccccaaattccaggtccacaggcaggagagcagacaaacagaggagcagaagaggagcacagtaaaggagagaagagaaggagtgtttgaacgtcaaggagaggtcggttggggacagctggagaggagattggccatgggacagcagaactccaggggaagatcatcttcccactccatcccctttccagctccccatccatctcactgagagccacctccatcacctaatacaattcccacattcaccatccttcaaatccgtctgtgacctgattcttcctggacacaggaaaagaatctgggtacgaagagggcactgggctggttaatacttaagcaatctgtggaaggcagagctaaaagagcactgtagcatgcccactggggcttcaggagttgcaggcatgtattcctagatgctgctgtggggctggagcccaaaagcgctctccccgccccctacacctgccggtctgcgagctccgcctcctgtaaggggtttgagagtgcagcagccgaacagaacagacaagccacagccctgtcgcaggccctgcccttcgtgggggatcaggggactctcccgtttcaactttcccttagttggagggtgagggtcagtaaatgttcatggacaactaagctgaaaaggaatttgactagcagacaaggcaagagagaatattccagcatgtgcaaggatacaaagccatatactacctattgtattcaaagtaccaaaaatagtttactgttattagtagtacataaagtacaaaggagaaaattaaactggagagttagacaagtctcagatcccaaggaatttgtagtttttgctgaagcagtgagaagccactgaggttgttgaaaaagagtcaaagtagatactggaatccactgttggttgcttccaaaaagaattttggtcctttctagtgcccagaacataatctctttctctggcaaagaaaacgtagtcttctgtcttccttttcctaaagaaggttacaattattttatgaagattgtaattttgagtaatgataatggaataaagaaggagtgaaatggcctttgtgtgctcctcattttttttcttttttaaggcaaaaaggttttaaaaccctctggagcactgattctgaataccttctttttataacattttctaaatgctccctttactatatgaaatgaaattcccataggtattataccctactgcagtgagctgagtaatgcttcccgaaaaggtagccacatcctagtccctgaaacctgtaattgttaccttatatggcaaaaaagaactttgcagatgtgactgagttaagatgttgagatggagagattatcctggtggactctaaattcagtcacatgtatcatggagggaatatcatagaggagatgcaggcaacatgacctctgaggcagagattggaatgacatgaccacaaatcaaggcatgccagcagctaccagagactgcaagaggcaaggaatggattctttctagagctttcagaagagtggccctgtggacaccttgatttagacatcgtgaaactggttttggatttctggactttagaactgagaaagaataaatttctgttgttttaagccatgaagtttgtgataatttcttacagcagccttaggaaactaatacactacttacataatataatgccataacaatgaaataaagaagacacaaaaagtaaatgttagtgatgtgactttccatttaggaaacaattttttgcaaagttccaaacaaaacaaattatagtcttttctgcatttacatggtaattgtatttctggaaaatttaatatatattcaaaccattaaccaatgtttgtagcatctgccatgtgcttgacacacagagagtatttaataaaagctggatacatgggtgatgaatagatggatgtattaaagctacaaagagagtacataagttccaaaataaacatgcaaggcaaaaattatgtgtagtcaaacgtatctttaaaaattcttgggcaggcccagtggctcacgcctataatcccagcactttgggaggacaaggcaggtggatcacgaggtcaggagttcgtgaccagtagcctgcccaacatggcgaaacccatctctactaaaactacaaaaaattagccgggcgtgatggcgggcgcctgtaatcccagctactcgggagcccgagtcaggagaatcgcttgaacccgagatgcagaggttgcaataagctgagattgccaccactgcattccagcctgggcgacaagagtgaaactccacttccaagggaaaaaaaaaattctttacatagcttatcaaatacagtgttcaatatctacatgacgtactggacactgacacataccatttctcaataaagagctgacagccctctctccccattccctcagcatcgtttgggtatcttatgaaggacatgagttgttttagggatgtaatgaattccattcagcactatgaggtactctcaccgacaatcacagaagaattaaaactgactgaaaggcaatagatatgtttcccatttcaaagctcactgtggacattttcttatggtttggaatggttgtgagctgtccaaactatattttgatgtgtttttcttcttttgatcagggatcatagttcagtaaacccacagttaaactaagtgggctgatcgtatgggtctatctaaagtgaatttgtgtacttgtctcatccttcttattaatgagtggttctaaactggacttggtttttctcccatggggcatttggcaatgtctggaggcatttctgattgtcacagccggggattggggagggcagggtgaggcaaggggctattggcaggtagtgggtaaaggccaggaatgatgctaaacattctgcaatacacaggacagcccccaacaacaaataatgatctgggcccaaaagtagtggcaaggttgagaaaccctggcaacattatgtgtgtgctccccttgtgtagtgattcctttgtagtgtttgccttgacattagattaagtgttcccttaagcagaagctgaattttttgttattgagttgcagtgaaggatgggtgtgaatctctgcagggttaaacatttttacattaacctttcctttttatttttatcaaaagtaatatatggttacatgtatgtgtgcatgtgtgcacacacttatgcagaacttagaacagttccccacccattcttccctagttttatcgcatttcccagagttagcaacatgtaaagagttttgtttttaatttttttggtgattgcctctctaagtctaaataatagcttttggttatctattgatttaagagattatctattgactcttcactgcagaaggttagcaaaagctcagctacactaatccctccccttcttccttctaatattcattagtttatattcgattgtcctttcattgattattttgtaattctaaattaaatacatataaacatttaattttgttccatcaactttagtcagtatctttttatcttctgcctttattatactagcgcttctgttctttcaccttccttattcctatttcctatagtctgtctgctgtacctttacattgtcagattgacaatatttactttctgttttataattatatttgtttgtttttatccataggttgaagccaaaagttgaaaactattaccatttataggatataactgtaaatattgttcactgaagagctaagtagtatactgagatcccagaatcatctctatatatgcaatatcacatcctctgtgccatgagaaagaatgttcctagtattctagcattctgttttctgtgttgagtgttttaaaatcatgccacattcagttggcacactggcatctaaacacatactaagaaagatcagaagtgtcaatgaaattgcatagtgaatattcaaaaaatgaatgacctgcatgggcaaataatacaaaaaaaaaagatcagaggaaaatgatagaaaacacaagaaagacaagaatttcaaaataataagggtacattcccaatggccagctttctgagagttgaactgtatttgaataactcatgtccctcaacccagatccaaagataatattgctgctgctgaaacctgggctctttactatgaccagagtttattaattgtcctatttcattgaggaaaaaatgcaaaacagaacactggaatgactagctggaaatattccactatttcatgggaagcaggtttctaaacgattcctgtggaggccaaactcttgctctcgccaaaatattatagcattaaagtgtgccttgatggtacattaaggaagaaattttccccgaatttacttaagatttatagcctttctgctctcacaaaacgtagcattgatttctttaatatcaaaaaaagtttcctaaaataaactgctaatgattgctttcagtcatttgtttacttgaggtcagtcatgccaagtactgtttgtatcaattcttgtaaaagactcaattaattttgtaattgtcataattactgttattcctgttctgtaggaatatgctattaatgtaactggacatcaccacatcttatttttgtatctctcaaaacatctttcataaaactttgatggtaggaaagagctgaaaaaaaatctcctgttagtagaccaagtagtacttcaattactaaacaccagagaaaattaaaattacaccttaaataaaaccaaccagatatttggtagagaaaatggaactgtacaaaaatatggtttttaaaaataaaattctaccacttgtattatattcattatagactattggaaaccgttccctgccaaaaaaagaaagaaaaagaaaaaagtttgtgaccatttgtaattcattttagtctttttatgtatttttttcacctaaaataatatgggcatttaaatattttaaatatagttttaaatggctacatattattctatcaaaaatacctaccataatttatgtaaccactttctcattgttgagcatttaggttagttttgtttttccagttgaaacaataccccctgagtatctttgcatataatgatttctcttgattttagttttaagacaagctcttaggggtcaaatgttttaaatattttaaaggttcattgttcaaattgcatttcaacagtcaataccagtttacactgttttcagcattttaagaaattgcccaaatgacagagcagaattttaaaagtatttccctagtgttgatttggtttatatgctgagatgctgcagattttttgttgttaaaaagtgagtatgtggagatcaaacatttggctgactgtgtacacattttatttagtaaagcctcaatgttaagcaagaagccattactcatattcatgttgtctcaggaatggaaaagtgcttctaatttttgcaacaaaagaagtctgatggcagtgacagaaaggaatgactagctagatatgctgaccggaaagctagaattaggatttgaccattgtagtcagtctccatttaagagcctaatggttttttcttctcaatttggaagtttgctgcatttagagatattcttataaaactaaaaaaaatagacccagggagcaagtttgaggttactaaaatgtatcccattattgtcagagttgcatttcaaactgtcttcattaaactgttagtttgattacattttctcaaacagtaactgttgtgttttaattttttaaattaaaaataagttttaaatttcaggtaattgaaagaccaattctttttggaatctttcagtattatggttttggttcacagcgaaggtatttgcttgctacatttgctaaatatactatctatacttcattttgttgcataaaaataagacatactccggttagcctttttgatgggtattaccttgatgacttgctcactgacagagaaactgatgtaaaataggtcatttgaaaagcaggtgtttgatatatccccatatgtaacactgaaaagccttcttgctctagatttttggaaggaaagctttcttaagaaagaacggaaaagagagaagaaccaaatagacgcaataaaaaatgataaaggggttatcaccactgatcccacagaaatacaaactaccatcagagaatactacaaacacctctacgcaaataaactagaaaatctagaagaaatggataaattccttgacacatacaccctcccaacactaaaccaggaagaagttgaatctctgaatagaccaataacaggctctgaaattgtggcaataatcaatagcttaccaaccaaaaagaatccaggaccagatggattcgcagccgaattctaccagaggtacaaggaggaactggtaccgttccttctgaaactattccaatcaatagaaaaagagggaatcctccctaactcattgtatgaggccagcatcatcctgataccaaagccaggcagagacacaaccaaaaaagagaattttagaccaatatccttgatgaacatggatgcaaaaatcctcaataaaatactggcaaactgaatccagcagcacatcaaaaagcttatccaccatgatcaagtgggcttcatccctaggatgcaaggctggttcaatatacgcaaatcaataaatgtaatccagcatataaacagaaccaaagacaaaaaccacatgtttatctcaatagatgcagaaaaggcctttgacaaagttcagcccattcatgctaaaaacaataaattaggtattgatgggacgtatctccaaattagaagagctatctatgacaaacccacagccaatatcatactgaatgggcaaaaactggaagcattccctttgaaaactggcacaagacagggatgccctctctcaccactcctattcaacatagtgttggaagttctggccagggcaatcatgcaggagaaggaaataaaggatattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaagtacctaggaatccaacttagaagggatgtgaaggacctcttcaaggagaactacaaaccactgcttaatgaaataaaagaagatacaaagaaatggaagaacattccatgctcatgggtaggaagaatcaatatcatgaaaatcgccatactgcccaaggtaatttatagattcaatgccatccccatcaagctaccaatgactttcttcacagagttggaaaaaactaaagttcatatggaaccaaaaaagagcccgcattgccaagtcaatcctaagccaaaagaacaaagctggaggcatcacgctacctgacttcaaactatactacaaggctacagtaaccaaaacagcatggtactggtaccaaaacagagatatagatcaatggaacagaacagagccctcagaaataatgccgcatatctacacctatctgatctttgacaaacctgagaaaaacaagcaatggggaagggattccctatttaataaatggtgctgggaaaactggctagccatatgtagaaagctgaaactggatcccttccttacaccttatacaaaaattaattcaagatggattaaagacttaaacattagatctaaaaccataaaaaccctagaagaaaacttaggcattaccattgaggacataggcatgggcaaggacttcgtgtctaaaacatcaaaagcaatggcaacaaaagccaaaattgacaaatgagatctaattaaactaaagagcttcttcacagcaaaagaaactaccatcagagtgaacaggcaacctacaaaatgggagaaaattttcacaacctactcatctgacaaagggctaatatctagaatctacaatgaactcaaacaaatttacaggaaaaaaacaaccccatcaaaaagtgggcgaaggacatgaacagatacttctcaaaagaagacatttatgcagccaaaaaacacatgaaaaaatgctcaccatcactggccatcagagaaatgcaaatcaaaaccacaatgagataccatctcacaccagttagaatggcagtcattaaaaagtcaggaaacaacaggtgctggagaggatgtggagaaatagaaacacttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacatatgtttattgcggcactattcacaatagcaaagacttggaaccaagccaaatgtccaacaatgatagagtggattaagaaaatgtggcacatatacaccatggaatactatgcagccataaaaaatgatgagttcatgtcctttgtagggacatggatgaaattggaaatcatcattctcagcaaactatcccaaggacaaaaaaccaaacaccacatgttcttactcataggtgggaattgaacaatgagaacacatggacgcaggaaggggaacatcacactctgaggactgttgtggggtgggaggaagggagagggatagcattaggagatatacctaatgctaaatgacgagttaatgggtgcagcacaccagcgtggcacatgtatacatatgtatctaaccttcacattgtgcacatgtaccctaaaactttaataataataaaataaaataaaataaaagaacagaccagatgcagtggctcacaccagtaatcccagcactttgtgaggccaaggtaggaggatggcttgagtccaagagtttgagattaacctgggcaacatagtgaaaccctgcctatacaaaaagtaaaaaatgaaaagttagcctgggcctggtgtatttgcatgtgcctgtggtcccagcaactccaggggctgaggcaggaggattgcttgagcccagtagttcaaggctgcagtgagctgtgattgtgccagtgcactctagcttgggttacagagtaagaccctgtctcaaaaaaataagaatgtacatatttaattgtaatatgaaacggatgctgaaaatgaacaccgatataagtgacatatcagagatgctctggagacttggttcatataatatggaacaaaattaccttctcaatgccaaattagaaaatgatatgtacataattttcaggtttaaaatatatataccaaggctttgggatgttaaatataaggaatgttgcccatgtataacattatcaattaagcttaagaatattaaagatttgttgattaaaataattactaatttttgtgatagcttttactttagaatatgtgatttgaaaaaaaagaatgttgacatttcacatagttggaaaaaattctagttcttagttttgtaacttaattttatgttctaaaatatgtctcaaatccacccttgtaaaattattagtcttttattattaaagcataaagtttgctactcataaatcaaattatatatctcaaattcaaagctaaattgcccttgtgcattgtttagcagtatgtaaatacattttagaaaagggctgtatcattcatgaagtttccaaattcgttgatcaattctgataataaagttaaaatttttgttcttaattagtagatctcattattttttcagcattccactgacttctttctaactttgtagtaatgataggtaaagactgtatctggcttaaaaaatgcttatttttacatacatgtaggtctttgattatgaaagtaccgaggagttcttttgtttatacagtggcagttgaaagaaaacccatgtatatcttgagaagatttattggaactagctttgagaaatgatgagccatatctttaactcaataaaagatatgtattgctgtaccaagccttggtatctgctattctctttagtgtaagcacttttcaaactataggattatacaaatagtagcatcactagttaaaacataaagctatatgatctaaagacatagttttggttattttttgagccatttaattttcatcttttctgtgaccacatttattaaacatgtgacatgaaaatggaatactcttttatgatgacaaaagaaagtatatgcccagccaattatgggataagagtattattttttgtgaacacattatcatcattctagacacctggagaagtgaatatctctgaaagtatcatacatttatactttaactttatttacatatccagttttcagaaaccattgccaatgaaacatttggacaatgtggtatgcaagtactgtatagtaagaagtagggatgttcttgagtaattgttccatttgaattaatccagcatgggtagttgttagacaaccatgaaatgtgctaagctttacctattctaagaggactctattcttacagaccataagcgttcaaaagttttccaagaaaaaaaggttacttctttaaatttagtctgcccattcaaaagctacaataaggcaggtggattaaactgctaggagttgcaatgttagtattgagagcatttaagcaatttaaaatctttcagaatgcctaagatcacaaatttacccctgatcagcctacacagattaacttaaaatacatacagagagatgtcagatagctagagggtcataaattagtgaccaaaattacatcaatctgcatgttgacattgtttaccttatattgattagaaacttttgcttaggaaaaaggggaaataacttttattttaaattatactttaagttctagggtacatgtacacaacgtgcaggtttgttacatatggatacatgtgccatgttggcgtgccgcacccattaactcatcatttagcattaggtatatctcctaatgctatccctccccctcccccaccccacagcagggatgtgtgatattccccttcctgtgcccatgtgttctcattgttcaactcccacctatgagtgagaacatgtggtgtttggttttttgtccttgggatagtttgctgagaatgatggtttccaatttcatccatgtccctacaaaggacatgcactcatcattttttatggctgcatagtattccatggtgtatatgtgccacattttcttaatccagtctatcattgttggacatttaggttggttccaagtctttgctattgtgaatagtgccacagtaaacatacgtgtgcctttgtctttatagaagcatgatttatgttcctttgggtatatacccagtaatgggatggctgggtcaaatggtatttctagttctagatccctgaggaatcaccacactgacttccacaatggttgaactagtttacagtcccaccaacagtgtaaaagtgttcctatttttccacatcctctccagcacctgttgtttcctaactttttaatgattgccattctaactggtgtgagatggtatctcactgtggttttgatttgcatttctctgatggccagtgatgatgagcattttttcatgtgttttttggctgcataaatgtcttcttttgagaagtgtctgttcatatccttcgcccacttgttgatgcggttgtttttttcttgtaaatttgtttgagttcattgtagattctggatattagccctttgtcagaagagtaggttgcaaaaattttctcccattttgtaggttgcctgttcactctgatggtagtttcttttgctgtgcagaagctctttagtttaattagatcccatttgtcaattttggcttttgctgccattgcttttggtgttttagacacgaagtccttaacagcccatgcctatgtcctgaatggtattgcctaggttttcttctatggtttttatggttttaggtctaacatttaagtctttaatccatcttgaattaatttttgtataaagcgtaaggaagggatccaagttcacctttctacatatggctagccagttttcccagcaccatttattaaatagggaatcctttccccatttcctgtttttctcaggtttgtcaaagttcagatagttgtagatatgcgacattatttctgagggctctgttgtgttccattggtatatatatctgttttggtaccagtaccgtgctgttttggttactgtagcctcgtagtatagtttgaagtcaggtagcgtgatgcctccagctttgttcttttggcttaggattgatttggcaatgcgggctctttttcagttccatatgaactttaaagtagttttttccaattctgtgaagaaagtcattggtagctcgttggggatggcattgaatctataaattaccttgggcagtatggccattttcacgacattgattcttcctacccatgcgcatggaatgttcttccatttgtttgtatcttcttttatttcattgagcagtggtttgtagttcttgaagaggtccttcacatcccttctaagttggattcctaggtattttattctctttgaagcaatggtcaatgggaattcactcatgatttggctctctgtttgtctgttattggtatataggaatgcatgtgatttttacacattgattttgtatcctgagactttgctgaagttgcctatcagcttaaggagattttgggccgagatggtggggttttcgagatatacaatcatgtcatctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaatgggctgttgaattttgccaaaggccttttctgcatctattgagataatcatgtggtttttgtctttggctctgtttatatgctggattacatttattgatttgcgtatgttgaaccagccttccatcccagggatgaagccgacttgattatggtggataagctttttgatgtgctgctggattcagtttgccagtattttattgaggatttttgcatcgatgttcatcagggatattggtctaaaattctctttttttggttgtgtctctgccagactttggtatcaggataatgctggcctcatacaatgagttagggaggattccctctttttctattgattggaatagtttcagaaggaatggtaccagctcctccttgtacctctggtaaaattcggctgtgattgcatctggtcctggactttttttggttggtaggctattaattattgcctcaatttcagagcctgttattggtctattcagagattcaacttcttcctggtttagtgttgggagggtgtatgtgtcaaggaatttatccatttcttctagattttctagtttatttgcatagaggtgtttatagtattctctgattgtagtttgtatttctgtgggatcggtggtgatatcccctttatcattttttattgcatctatttgattcttctctcttttcttctgtattagtcttgctagcggtctatcaattttgttgatctgttcaaaaaagcagcttctggattcattgatttttttgcagggttttttgtgtctctatttccttcagttctgctctgatcttagttatttcttgccttctgctagcttttgaatgtgtttgctcttgcttctctagttcttttattgtgatgttagggtgtcaattttagatctttcctgctttctcttgtgggcattttgtcctataaagttccctctacacactgctttgaatgtgtcccagagattctggtatgttgtgtctttgttcttgttgatttgaaagaatgtctttatttctgccttcatttcattatttacccagtagtcattcaggagcaggttgttcagttgccatgtagttgagcggtgttgagttagtttcttaatcctgagttctagtttgattgcactgtggtctgagagacagtttgttatcatttctgctcttttacatttgctgaagagtgctttacttccaactatgtggtcagttttggaataggtgtggtgtggtgctgaaaagaatgtgtattctgttgatttgggttggagagttctgtagatgtctattaggtccacttggtgcagagctgagttcaattcctggagatccttgttaactttctgtctcgtggatctgtctaatgttaacagtggggtgttaaagtctcccattattattgtgtgggagtctaagtctctttgtaggtctctaaggacttgctttatgaatctgggtgctcctgtattgggtgcatatatatttaggatagttagctcttcttgttgaattgatccctttaccattatgtaatggccttctttgtctctttttatctttgttggtttaaagtctattttatcagagactaggattgcaacccctgcctttttttgttttccgtttgcttggtagatcttcctccatccctttattttgagcctatgtgtgtctctgcacatgagatgggtctgctgaatacagcacactgatgggtcttgactctttatccaatttgccagtctgtgtcttttaattggagtatttagcccatatacatttaaggttagtattgttatgtgtgaatttgatcctgtcgttatgatgttagctggttattttgctcgttagttgatgcagtttcttcctagccttgatggtcttcacaatttggcatgtttttgcagtgactggtactggttgttcctttccatgtttagtgcttccttcaggagctcttgtagggcgggtctggtgatgacaaaatctctcagcatttgcttgtctgtaaaggattttatttctccttcacttatgaagcttagtttggctggatattaaattctgggttgaaaattcttttctttaagaatgttgaatattggcccccaatgtcttctggcttgtgaagtttctgccaagagatcagctgttagtctgatgggcttcccattgtgggtaacccgactttctctctggctgcccttaacattttttccttcatttcaactttggtgaatctgacaattatatgttttggagttgctcttctcgtggagtatgttagtggcgttctctgtatttcctgaatgtgaatgttggcctgccttgctaggctggggaagttctcctggataatatgctgcagagtgttttccaacttagttccattctccctatcactttcaggtacaccaatcagacgtagatttggtcttttcacatagtcccatatttcttggaggctttgttcatttctttttattcttttttctctaaacttctcttctcgcttcatttcattcatttgatctttcatcactgatagcctttcttccagttgattgaatcggctactgaggcttgtgcattcatcacgtagttctcgtgccgtggttttcagctccatcaggtcctttagggacttctctgcattggttattctagttagccattcgtctaattttttttcaaggtttttaacttctttgccatgggttcgaacttcctcctttagcttggagtagtttgatcttctgaagccttcttctctcaactcgtcaaagtcattctccatccagctttgttccattgatggtgaggagctgctttcctttggaggaacagaggtgctctgatttttagagtttccagtttttctgctctgttttttccccatctttgttgttttatctacctttggtctttgatgatggtgacgtacaggtggggttttggtgtggatgtcctttctgtttgttagttttccttctaacagttaggaccctcagctgcaggtctgttggagtttactggaagtccactccagaccctttttgtctgggtatcagcagcagaggctgcagaacagcggatattggtgaacagcaaatgttgctgcctgatcgttcctctggaagttttgtctcagaggagtacccggccgtgtgaggtgtcagtctgcccctacaggggggtgcctcccagttaggctcctcgggggtcagggacccacttgaggaggcattctgtcccttctcagatctccagctgcgtgctgggagaaccactactctcatcaaagctgtcagacagagacatttaagtctggacaggtttctctgccttttgtttggctatgccctgcccctagaggtggagtctacagaggcacgcagggctccttgagctgtggtgggctccacccagttcgagcttccagtccactttctttacctattgaagcctcggcaatggcagcgcccatcccccagcctcgctgcagccttgcagtttgatctcagactgctgtgctagcaatgagcgaggctccgtgggcataggaccctccgagccaggtgcgggatataatctcctggtgtaccatttgctaagaccattggaaaagcgcagtattagggtgggagtgacccgattttccaggtgccggctgtcatccctttctttgactaggaaagggaattccctgaccccttgcacttcccaggtgaggtgatgcctcaccctgcttcggctcatgctcggttcactgcacccactgtcctgcacccactgtccaacactccccagtgagatgaacccggtacctcagttggaaatgcagaaatcacccatcttctgtgtccggaaataacttttaatatgtacagcttgagagaaagaatctttcagaaatgagatagagaaacataataaaagaatccttggtgattttcttaaaaagtaaaaaccgtcactactgagaaaaagacatgttttacaaagacatctgaaaatcataggtattgtggcttatgttttgggatggaaatgaaagatttgatgaaaattaccagagatttttacataaaacagctgattaaagccaaccatcctttttagtgttgcctttatttgaggatgttagggagaattttctcattttgtgtttagtcctgattggcctggatcataagaattatactgtatttagtttgtagtaggacctgctcttctctttaggacctgacacataaatagttttgtgtaaaagtgaacattgtaatttctcttaacagctgtaacatcttatgaagatcttggactctttgcatttggattacctggaaaggtaattttttttcctcctcattgtgtccaaaacccaaagtggcatttttccttttgtttcaagttaaaagagacaagtatatacaagaggaagacattagaggaataaaaggaaactaaagtgagaaaagagagaatgataggagcaggcaaagaaagagaagtctttgtgtccttcctaaaaatgcatcaatacatttaattcaatgcttgaatcttttaatatttttcatcctaataaagtagcacaatgacttgaatgactttaaaagagtaacgatgacctgttttaagttgtattaattttgattatgtactcatatgagtaaaccctcataaagacaagaaaagaaaagcaacatcgaattcaaattgtagcatggctatttacaaaaccagtaatcagaagatcatatcacttaagaattgaacattgctacaagattatctagctatcctctcatttataggtgaggaaattaaggaccagagaaattaagggacctatttgtcaactattatataaagccagtaccacatcctagaactctagatctactgcttttcttactcagaataagagaaataacagcagtatttatggggcacccacttgcaatagggatactacactagtttaataggtagagaaaaataattgtcttccaccagtaatcaggagttgaacgttactgttagtgctatagtatatatattttttaatttctgaagaactactatacttctaaaattcatattcattttggctccaaacaggaattcttttgtttgtaaatctgttgtttgtgtttttatgttttcgattgacaaatacaaattgtatatatttattatggacaacatgtcattttgaaatatgtaaacattgtagaatggctaaattgacctaattaatatttgcattacttcacatacttaccattttttgttttatttttattctaaaaggatactctatctgtaactggctaaactaacttctgaaagtgagtctggaggaaatatatatagctatacaatggaaagaaaacctgtatttacattccagttaactttggtggagttttttgtttttgttttttcagacagagtttcgctcttgttgcccaggctggagtgaaatggcatgatctcagctcaccacaacctccgcctccctggttcaagcgattctcctgcctcagcctcctaagtagctaggattacaggcatgtgtcaccaggcctggctaattttgtatttttagtagagacagatttctctatgttggtcaggctggtctgggcctcccgacctcaggtgatccacctgcctcggcctcccaacgtgctgggattacagcgttagccaccgcgcccggccctaactttgtttttaaagtacaaaaaggaatgcttaaatcatatactatatagcatcatggcttggaccttagtcacctgaaacttaaacaaaacagaatatgttacttgagggtaaaaggttttgttaatcttccttagtagcaatgtttctgttctagaggattaggatgtttggtgtagccagggatcagtttcctccatctagtttaaacaaagaagaaaatattttttgtatgagaaaattccacaattaatataacataacctataaacataactctaagtatcaacactgacatcactgtcatttcatgttcatatttcctgcgttgcttgtatagcagcaaagtttaaagagtagggactgctgagagtcttcttttcctaaacctcttagagtagttgtgttgtcattttaatacatgcaccaaaaaagttcatagtaggcaggaacactagacaaagcatactctgaatgaggagttgttgtttggttgcttgtttaaattttctccacacttccacagttgggttgaaacttaaccatttccttctatccagatgttatatagttataatatgggataatattatgataaagaaattttttgaaatgttttgaacttgttaaagatttatttcaatgtctataaattggtatttattcaccagacaaatatttattgatcaaatactttgtaccatgtactgtgctaggcattaaaaatataagtaggtaggcaggtgggtagatagatagatattctagctttcaagatattaaatgcttaaattcagccaaagaatgaaagaataatcatcaataagttaatattactgttttttgcaatatattaattgaaaataaaaccaaatttcatgtatacctactactgacagtaggtatcatttgtactgaagatagtatacacaagttcaaaatagtcttttcacaaataacttcgacattttggaactaagttttacataggctgaaatgcagaattttttctggagagcgttcaagtggcaatcaccacatctccaaagacactttgccagattttcatatcattagccctcctctgcaaacctcaaggctcctaggtcctaataacttagattgttttcagtgtaggcaaatgctgtgccactgatagaattcctaacaaagatgggcatgaaagattatctgttcccaattcatgtagaactgaatgattctagacagctagtcagctccaggcatacgttggggttccgatccattaagacttgagtgattgaaaggcccacatggaagcacagtgttttactgtttcctctaagcatatctgattaccttgagttccccaggaatctcatcaaagatgataagctaacaagcctacagactgaatttagtcctcaggcacattttatatggctcaaatattttttatttttaactgattaccaactaagcatcattaaagtatgaaaaaatttcatttctgactttctttgaaaaatcagatctggctacattggatccacattctcacatattatcaactggccagagctgagtagcacctgccccattgaagggggaggaattctccaatatcctacagttcttgccaactcccattgtcttatattcagcttaattcacattattgagtttggaacattttgcctatattttcagggtttgagagtaattgggctctagactttattaatctctgggactgggatgctcaaagtctgggatgctgatatagtcagaaaacttatatcatttccttttaggcaatatagcattggcatagcacacccagccggtctttttctacttatttaagcagtgtgataaaaccagcaagaagggaatgagacaccactcccacacttttaatttttatacttgataatcatcgattactagcttttaacacttttaacaatttaaaagtgactgccaagaaaaatttcaaaaacttctttatagtaactttggaactattaaagaaatactttttaatgtgatgattattaattttatgtatttcaaatgactggcagatttctttttagtttctcctcacaacttctgcatctgcttttttagtaatagttactggattttaataaaatactgatccttttatattgtttccccttctatcttctgaatatttctgttcttttacagttggtggtggcaggcaccataataattcagaatattggaggtaagcaattgcaagtgcactgtttatacataaatgtgatggcaataatgtcctttgaattgttatcttactacagatctagctgggaacttctgtagacatagctatcttcagaagcctgtgtgttggcctctttactctttttttttttggatcctttttagcagcacttgtgacagtagcttctaaattcagtttgagctaaaccctgattgcagtcgtgttattaggtctgcaacacacctctaaaacattggctttctgtgattctgaaggtaggatacagtctggaaaagctctcctggtgattttaaaatattttccctctacttttgttctaatcaccctattggcagatactactttagagggattagtgttccgtgggctgtgaacaagcaagtatggacaacagtgtcctcttgtaaccaagaatttaaaatgaccaagtggtttaaaacataaataaatctgagataaataagcattctcacatttatcctgtatcttgttcctattaataaccaattctagaaatgatctcaatattgagaactatgtagaaataaaactactgttaattatagacagttactgagtaaatgtattaaacatttaaatccaaaatatgggtatcatgtgtgtatatgttgtaaagaagttgcgtagtgctgaacaatatcttcgttttcttttatcattgactggagtgctaaataaatgctcttaaaggaaaatacacagaaaagtttgacatgtactttggatcttatacaggattgtatagtcagaggacattttaatcttattttttacatgtaacagtttaattcaaagatgacagttttaataaacttcagctctcataatcaagaggtctgagctatatcactttaagtattgttcaatcaaattccatcgttaataggtttttttggttaaggaaaaattgacattccaccagtgaattgtgctgccattgttttagaatcctgttttaattctttgaattttcatgaaaaaatatgaataaaaagaatgctttcttgcatgccataccaaataattttctcctaacacacactacttcacacttcacagtagaaagtcaagaaaaccagtctcttcatttatgaatttattatagtcattgattttaagatctattttggaataatttatttagcaactaagtattgcttaactgtgcactgataatgtttctgaatatgatgtatatttttatatttttaatccctctttatcctctctgtatagattctaagaactatcacatattgtttaggttagattgaaccattgtttaacagtttatgtagactgttcagttcagcaatttagatccaaatttgtgaccctggcacaaggcccactgttgtattctttgtccctttcaccttgattccttccttgttctctaatcttgtttataactgttattggagatggctatactgtagcacttggctgctactagatttaacttctctgtatgtatgctcctgtaccccactatattgttaagttcctttagctcaaaagtatgcctcatttctctttgtactcccagcacctattacacctgggaattgataaacttgttgagcagaatagagctgaaatgatttgtataatctctttctaagtaccttaaatattctagatatatttatcaagaagagaaaagggaaatgctagaccggcatctagcttcaggtatttgaaagactgaacatgaaatataaaaaagacactagactaattcaagtattgttccagagggcagaactggtgctaatgtatagaaatctacagagaagctgttttgggttttcttattcggagtacccttgtaactaagctgtgtgataatgaggatggcctacatccctttgaaaatgctccttagccctgaaaacattcaaacagagctggttggtcagttgccagaattctagaaaggattcttgcatttggaggtggataaatcatgagttttcccaactcttaattttgttggtttgcttgcttgcttattttagaacttttttttaaaaaggtgatttagagtggtcacagcagtttttaatgtcccttaaatttagaaaagctagtaatgcttatttagtttttagaatgatatcctcatgattttcttcacattggttaaaagtgtattaagtgcccagtcagtaataaccaaatacatattttcagagttttttctgtcttttttcgtagccagatgtacataaaccatttctttattataatagaattggaagcttgctcttgtgagcagaacactagattggaagtcagataccttgaattctgtctactccagtctctgccattgggtagccatgtgtcttgtggaaatccctcactctcactgtcttggcttcagttccctctttgttaaattgttggacggtagagtgggaagcagggagtttaaggtcccttcttaccccaaaatttgaattcaaatttggcacattgggaggcatattaattattttaacgtattaacgtattttattacaggaaagttcaatgcgagggttatacttggttcaaaagatgatttggccctttcttaggtatctttaacaaatcaataactattgccctaaaagcattcatggatgctattttttgtcactaagcaaaagggaacttcagttcttaggactaccctttagaacctcctcttaggttaaagtctaggaaccctagccttaaaaagtagtttcttgattgatatatacagaatctgtggaacttctagtccatgtatgcttgcaaacaacatacttatttgggaggatatttaatatactgtgtcattatattaaataagtatatatatatatatacagttttattataataaataagttaatcgtacaatgaccaatgttacttcattaaaatggattttgattattttctttattaattggaaatatattggatatttaaaagattatattaagtgtaaatcagattgaatttttacacatcttaagtgcctgtctgcaaataatgtagttcagataacttttttttaaaagaatgtttgttagtataaattatctgacttttgcagtggttgtttacattaaaactgaaaaataatgtaatagattctatttaggtcaagcactctactagatactttaattataacaactcttcaatatagatattatcttcattttatagagaagagatcagtgtgcagtggagataagtagcttgctcacatttatcccataatgaagcttggattcaaaccttgctcagttggcctttattctttctgctatgatatagcaaatgtttgaaaaatgtgaaaagattaaatgttgaagattttctaacttcttggggacaggaactatgtgtttttatttgttttcctaactttacctagtttctgagaagagctcaataagtagtatttgttgaatgaattggacagtttttaaagttctgcttaaaagcctaagattttgcctcaaagagacaattgaatatactatgtaagtgataaaaaaagaaacttgaaagaccatagaatgacttctagtttagaattatataaaaatttaaaagttcaaaatactggggagagttagatctcatttatgtaaaatgggttaacaatatattgaaataggctgggtgtggaggcccacgcctgtaagcctagcactttgggaggccaaagtgggaggattgcctgagctcaggagtttgagaccagcctgggcaacatggtgaaacccagtctctactaaaaatacaaaaaattagccaggcttggggttgtgtgcctgtaagtcccagctactcaggtggctgaggcaggaaaatcgtttaaacccggtagacggaggttgcagtaagccaagatctcgccactgaactccaacctgggcaactgtctcaaaaataataataataataataataataatatatatatatacacacacacacacacacatatatgtaaaatatctattattttcaggttaagaaaatcatatcttaatgtttcttaactctcttattctttgtaacatttaaatacttctcagttttcatgagatacaattcctgtggtgaatccatgaaaaaaattgaaatggaaggcctttaaaagcaaaatgaccatggattgcccttgatcaatatttgtttcatgtgtctttcgccaaagacccagtttatttcccacatttccatattccataaatcaaattaatgtgctcatttatttacatccctagtacttagcacatagtatacatttagtaaataacatttattataggaagaaagaaaggactaagaggggagagggggaaaagctagtgacctggcttagtactccttcaagagcaaaaagagagttgattgaccaggaagagaaagcccagtatatgtaagtgagcatatagtttttaggaaagcgtctactgttagaacttcacagaaaatcgtttttctcccccaagattaatcaggcaccaagtattagtcacaaggctctagtgtggtctgacaaattgattgaaaaaatctactgtctgtaaatctctaaattttataatggaaaaaaatgcaacacactagatttaacactcttattctaaggttatagaaatccttggctttggaaatttgggaaccatatagtaaattactacttaaaagcaattcctgatatcttcccaatactaatgaataacaggctcaacattggctagagccagaggtaaccctctgcagcccatttcctcaggtgctggagtagcatttgttgagagccactgctactgggacccaaagtcagaaaagatgtgtctggaagttttaacatttaatgctgttataggggacaattctggcttagagagtttgaatttggcagcctaactaaagataaaagattaataactgtagtagaaagtaagtataaggtagttttcacatagttcctgtaacagtgttgtattatgtgattcttttcttaaaaactaaggtaagtagttggtttcacattcatttgaactcctgaagtaaaccattcagtaggctagaattatcactagaaatcaaacactacatcccaatcatcttcttagtcaagccagaaaaagtcttattaactcttacaagcacatgataacagtgaagtcaattgatgttatttctggtttcacaacttgcccaattcaaaatgtggaaagatgagtagctcctagggggatgttatattcttattttgctcttataaatatgaaggattactatgaatagcatatgctttccttaattcttcaaagccccagttctttaaaggagattaaaaatttaatcattactacgttttgtgaaaggaaaaccataaacattagtagtcttactgaaacctcctgaaattgctagaatgacccagatgtttcagtctggcacagaatccacacaccttactcttgcagcctttattaacacctcagtttggtaatctatggactcgggtaaccccatttctaaatctcagaaaggtataaataagatcattttcaattgagaattataaaaatctcaaattctcagtatttgaaaaattcacaatattagatgctagaaactacttggatttgctttcttcctgtatattcattcatgcattttatttatttactttttggtaggctagtaaagtactaagagtgtttcagatatactagtttgtattgtctcttgggaaactaggattgggcgcgcagatacatcgccatctgctggtcagtttatctgtggtgaaactgcagctttcttgagacttgtctagaaattctagaaagcactgccttagaataggagaggtacaggaaatttggagagtctttttcacaagcacttcatttgacaacatttactggtagtgtatcttttttaaggttttgaaaatatttttcatagtaatttctattgaaaattataaaattttcagaacagtagatattttggtcattttttaatcaaatttaagatcctgaaaatgataagacaaagatatacatttttttctagggtcatgggggagcattttcccccatatattttgattttcatttatgcatgtgttctgtactatttgagtgcatatagaacttcagtggcatttagatattttgtgggaccaccagattaatgagacacattgaatagaataaaccagttagtatccatgactaaaaacatgtttgaaataaaattgaatctctctgagacagaaaggcaaacttattttttccccgtagcacatccgtttgtttagggctgagtaatcctttaagaattgctgaacttcccccaagtgctgaaaacctaattctgttttaaaaatagctgtaagtaattctgtcctcatacatatattttacatgtttaacaaaaaagattcttatcttcataaactgtaatgatgtcttaggcccaaactccaattagggttggtttgttttttttaagtttgtatgcttaataacgacaacttgggaagcattttcagagtgctgcgaaaaataactcataagaatacagtatttggaagcacagagactgatttttattttttggatttcagtggagtgttaatatttcaaatacgtgagaataggaaacttcctcttcagaactacaatcacagccgtaaatacagtagagtcatagcagtagatgcaatagaatctcatcatgaaactccatgaattttgaactaatcacatcaccaaaggagctccaatactgaaaaatgaaatacattgaaaatatatctcaagatgaaatgaaaattctaagtgttactaaagcttctgactaatgttctctgtgatattcatttcctttgaagtcaactgttaatctcagcattcaaaagtagtttgtttaaatactgatttaaaaaagaaaaataattctgaagagtggtacttctggtagactttccttatttgtctttgttttgttggtttactttttcactttgctcctgcactttctcatggcatactagttaatagaacgagtttctcaacccaggcgggctgtttgcaccatcactagcttgggcaagttacttctttgtgcttccttatattctgtgaaataagtaatatgtacctcacaggtttgtgtaaagattaagtgaggaaataacttgtgtagaatactaccaagcatacagtaggcatctaaaaaacaaagatgttagctgttttcatggatctctgcccagagtcccttccctgtttctgtgtttctaacatctctcctctcaacctcccgggcccaattcatttatttcactttataattagatcagcagatattaacaccttgcaacttgctattacctaatcagattttaccccattttagtcactttttaatattactgttgcttctccatgttgtttttaaagagtgctttcaacttctgtgttttcagttgacagatgttttattttttcccagagaagtttctattaaatgagttatattagtttaaaattaagtagaaaagaatacctatttagttaatgtgctaaaactaagtgatttataatggctgaatacctgacatcaaggtatatcttctggcactgattttggctttggtggtttggggccacttaactatatgcatggctcttgtggatgacccagttgcagctattaatttagagtagaacatggtgtgtcttgttttaggaatctatactaggtgtccatgtcacccaaaatcatttgcaaatttttgcttatgattggtctgtaagataagtgcttaaacactttcttatgccatttataaaagacataagacaaaaactgtggcagacagctatttgatctagtaaaccttttagttaaaaacaaaggcaatatgagcattcctatcaatagtatatctttaaaacttttccagttcattttattgagctgattgttcttttgtatgaatttaattaagatatatttcctaacttaatgtgtatttggtaatctttttgtttcttttctgtattatatataatataatgtgttaaagtgctagctagttcttacatgaaagtttacttgtgattaagaaaaaaataattttcatagtgaatagaatggtggtggcctttgttttactggcttaatccgtgtgggttttcccctatagtaagttctgtggttgtatactcttaaaatatatactaacattctctagaaaagaagcaatgttttgcatgttttattatatttgtatcttgtatgtgaggtcttctttgagagagaaacacgtttggtgagttcatatttcttaaaatatacatgattcttcagactggaatctaatgaaatagtactcccatttgaaaaccaaagagttgagggtacaacaaaggataaaagtgatcagatgattagccaggggctaatagaaattctggaaagaatgacagatattatattagaaagaaataggatctcatattcactgaagctttctacagctaaaggtccaaaagaaataatagaaaattactgaaagagatgaatgtctgaaactttagaaatgcatgtggtgttggattaatccaagcaagaaagaaagatgggcagataataaattacattttataggaagtctgctttccttgttttcaaagtattttgtcttttttcttttctgtctctctcacaagatatatttaagtaagtctaggccggtttcagaaaattcagttcacaatttttatctttgcaccatatgtgtagagttctttggaatcggtaaaatattataaaaactccaaatccttgaatggagaaggttagtctaaaccttccttctgttctgtgccaaattgatagcatttttccttacgagaatatgaacaatacagaacacattttcacatacaatcagttgtaataccccataactaaaagattttgcagaaatgtctcagtggattttagtcaacccactgagacatagctgtacttctgctagggaaaaagaaatcgttgtaaactgaaaaaatatgtatatgtatattttcatcacagagaagtgattatttaactgttctaaattttactttgacataaatacatgttattttactaaaaaaaattgagagtgtatgtttttgtgtctatagtattatctatctccatacaaatttacacgcaaagtagcatgtatcctttttttcctcaagttaaatggtcacatagcattgtaatcatgaagttcagctcctttcaaatgatgttgattgagaaatatacattcttcttaaactatttgagccttttaatcaatttttccccagatttttgccattgaaacttgactttcatttttgttcttagcttttgtaagttttgtaaggagaaagtgaaatgtttcctgatatataaataagtaataaaattaatgtgcacacaaagtatactctttattcttttttttttttttttttgaggtggaattttgctctttcacccaggctgaagtgcagtggtgcagtctcggctcactgcaacctccgccttccagtttcaagcgattctcctgcctcagcctcccaggttagctggtattgcaggcaactgccaccacgcctggctaatttttgtattttcagtagagacaggatttcaccatgttggccaggctggtctcgaactcctgacctcgtcaaccgcccgccttggcctcccaaacactctttgttcttcatgggcgtttcctttttggccccaacacatacacacaaacataatctctgggaggaaagagaatcttactctgttaaattgaagttctgactacaaatcttctgagtttctatatatttaagcttaaactcaagtatttacatatgaatgagttctgtattctgtaaccatattaaaacttttcctagtatttttatagaatttgtttttatagctacatcagaattaggatcgttattaaagtgctataaaaggtagttatttatcggactctgttagattaaatgtgagaaataatgctagcttcaggttatgattacataatatagatgaaccctgttaataaaatggaataaaagttggaagttttgtctttttaatatatttaatggtttatattgaactttctctaatctttttagagactaattttaaatgtaattcattatgtattcttttttatcctataattatatgtgttcataatgcaggggtgggtagtagagagaggaaaagaaagggacagagggaatgagacttctctgttgtggggaggcatctttctctagtaagaaggaacagataatccagttactagccatacctattaaacttctgtgtctatgtctgttgttgctaaactaacctctaatgccttagacggagtgataacatataagagagtttttgtaaaactttgtacaaaatttcatttaaaagtagcctgtaatcaagactgtttctcttacctagtttgctttggacttgaaatgtaaacaaaagatacttaatgaacttaacaattgttattcttctctacagttacttttctgtgtgtgtgtgtgtgtgtgtgtgtgtgtgtgtgtgtatgtatctttggtatagtgtgttatatgttaatcttccatatgttgtcatagctctaatggacatctcttttcctagatggattattgtttaaatggttaagaatcatagaattctaataggaacactatttattcttttgcagctatgtcatcttatcttttaattattaaaacagagcttcctgctgctattgcagaatttttgactggagactatagtaggtaagaaaaagtattttacattgtgtccgttcatgtattaatttgataaatatgtattaagctgtaaatggcaatacttgtagtggcaggtaaaataaatgtagtccttgccctcaagacagttacaaattaggcagaagtgaagcagtaatagaatagaaactactcagccaatgtttgattacccatatgaaagcgctgttctgtgaaccatatgaagcaccagatataatccttgcattccttgggggtgtgagataggctaagacaggtctgagattgagatgctcttaaggaggaataaagggtaaatttctggggatatgcaagacacaggttggggatgggagaaggttgaatatactgacagtacgggtcttaaacaaaggaggggagtgaatgatattgctgtcatttctcagcaaatcatagtgataaaaaatgtggcagttacaactatacctgtttgaaattcctattatataccatggcaaaaaaataaattatttgcaaggacttaattgtttcatttcctgtttttgaacaatattataaacaatactaaactacattgtatctcttttatctttctttaaaaaatgcatcttacatttttgactcacctctttatagggaaaaaacaaaattaattgtacttttcactgtgtagaacaagaacattctagaaaaaggaacttgaaaagacagaataaatcattttaattgccatcaagttatttcacatagttaagtttcaaaccacagtacaaaacctgtcagacttttagatttgaatactgggttgttctgcttcaataattgaacttgttctggaatgcaaggaaaggtttcaaaaattagtttttagcttttacatttcagcttccattaaagaattctacttagacaactgcaaatacatatttgtaagaaaagtgtggtgtactttagatctgaatagaaaccatcaagaaaatgtagttaaaaaaagacaagtagaagtcctaaatgatttctcttcatcagaagatattgttcctttgtatgatactttacagttaatgaggtttccacatgcattatcacatctgatactcaaaactaccttattttatctacagctttatctagttacattttgattttatgcttaggttgataaacaattcctataagaaatagctatgtgaaattcatttttgtatctgctgtaaaaaacattgagggcaccttctattactcaaattctatgtgagaaatttatattttagggttaagaactcaaggcaatatgaggtagaataaagagggctagactaagagtaaggagatatgtgttctatccatttaatattcaataatctcaggaacttaatttaacttcttttgactatataaagtacttggagccttaggtttttttatgtgatataatgggggtaccaatattgccttctcaataaagttgctgggatgatcaagtaagatatatatacacatgctaatagcatgtgtataaacaagcatgtgtgtacacaaacttacagcacagtgtggagaattaaggaattctaataattactatattaaacgtggtgtttccctttttgccctgactgccaggaagctcagagtcaaatgtgacacatttgaattaatataactgtgttaattccaacagttgtcacaagtgttttcttttttcttgatcctgaatttggtggctcctatttatattcttttattgtcatatgtcggtggaaagaggagggattagaaatatatgtaatattttagaaataattaaagtagtatgtggcagaactggtattgaaatttaggtcttctttctctaaaagtgatatttttaccgtagcttcattttaaataattggcaaatgatttacattgttgcattgatttttttgttttttaaataaaaattaaaatgaacttccatctcattcatattaatagaaaattgattaaaatgttatttttacatgttagaaatacatttttaaaatcatatacttcaaaatactgtggtcagtttgcatcatctctgttatgttttaaaattgtacatctttttaacaaccttatcttgttttaaatgtaatatatattcatttatttttggctaattatattaacttacttgaatgcagataaatcattagtcttgaaagcttgatgctagaaaataagtaagaaacaaaatatgataattgactttactatccataaaggacagtttttttctagatagacttacagtaggcagtatttcttctatgagagaaacatgatattgataagcttttattttagggtttgatatacaataaattttaattaagatctttcaggtatgctaattttctgggttatctgcgagcttggtgtacctttgaaatataaatctttataaagatatcagaatgaaactgtgttcataatattctaatagaagtcagaagctataatacttatactgaactttcatgatatatctatatatttcatagaataacttacatttttaaaatctgtggctgttaaagttggaagctctctgttaacatttaatgatcttgtcggggaatatgattgacacaattaagttgtcttgcattttagttacataattgatatgggatgtgagtaagatcctaattcagaacatatgatactcttgttccattcctttcgagaatgaaattaaagcgacttataaataaatctggttttcattaaaatatggaaaaaaacatctgcatgccaaagcatttgcaatacagctaaggatttatactctatatttcatacttggaacatttttatcatacaggattaaatccacagatcaaacaagttctctaggaagtataaaggtttttactctaattcttttggcttaaagagaatgtatatttagatcacagtaggaaaacaggagttctgttagatcgttctttattccccccttaggaaaaaattaaagttagtacattcttctgaaatgcttatttacaaaataaatgtatttaatatgtactttttgagatttctttttactagtttgtttttctcaggcagcagttttattttgtaagtttaataatttctgttctttagaaaatatccattgagaaacacaattcatttgtctgtgacacacatgtgaaatctaaactaattttactgtgctttactgtgttgcctttattgttaatgaatggtaaagaaaagcactgtatttaaaattggctttattaagatgaattattaaggataagaaatgattaacgataaccagtagccaagacaaggatagagaaattacattttacagtataattatttttatattaagaatttaaagttcaatcctatgaaaaggagaatgcaaagcatgatcttgaaataaatgaggtagtatctgaaagtatttccattgctactgtcaccttccttttgctgattttacagacatataaaatgaagttgttgagccagatgatctctaaggtctcttccagctctaacattccataactgtgattctgagttactgctgggaggaggtaaagttatcttcagtcccacagttcagtgctttggtcagttatatgacttttatggacataaatgaattgtgatctgaaatagtataaagtaactggtgtacagaatttcaaaaagtgttcctttattcctgtgcaagagaaaagagtcctggtcctggggattaaatgctcccttttgtacaactttagcttcgtgacatttttttttcttttaaagagtgaaattggcttataataattttttgttttattttattacggtaagaacacttgacatgaaatctgcactctcaacagattttcaagtgtataatgcggtattgttatctacgagagacagcaaaactaacagatggaatctcctttggtactcctttgggcatttttcctcctggcactgcaactgtctgggtctaacattgggtcccagaaggaaacacatttcagacatagagccctgggccttttgccagcttcagaaatttggttgccaggtgttcctcaatgaaagatcttttgaagtttctgttttgattcttactcaagagtgactagaagataaacacgttgagtatcatttttgtattattgatatgtgtactcttttagtacttcctgcataccaggaattgaggggcatgtgcaaatggagagagcaaagcttcaggtccactaaagctgtaaatacttatgcataggttatagtttctggcatatgtatttcctaatgatacaaattagggtggagaagggaaaagtgtcatcatggtgctgtttctgcagctgctccttctcttgttctgttaaagaggaagttgtcagcacccaacagtaacaattaagttcatgttagaagccactggttgaaatccatgtagaagacctttgcctaatttaacatggcagtgggagactggtatctggcagagaatgaaagaggatgcgttattgcaaagtgggaattttgagattatctaccaaacaatttgaaaaagtccctattggtctttgatgccccaagctcccatttttgcataagttttactttgttactattgtgcgtgtgtatgtatgtgtatacacttaagtgtaaatatctgacagctacgataaagaaaattgagaaaaaaaagcaaagaaaaatcatgcataacatctctaacctagtcactgtccttttaattcttttgaatttttcgcaaaagctttcaaaactatagttaataattatatttatatcatcatcattttccattttattcattgtgttttttcttaaagccacgtaacattccattgagtatgctgttctaaatattttcaaatgttgggtatatagagttttcctccagcttctcaatattataataatatattcaacagcttcacatacatagaattttctctattttattttcttagattgccactacatttttattgctcttgctacatataatcattgtttttccaagagatagtactaattggcacgatcactagcaatgtatgaagtccagttgtgccacatccttgaatatttttgtttactaattttgctagattaattgaaacagtctcattatttctttaattagcaccagtgattggattttcttcatgtgtatttactagttgtatttctttcatgaattgtttctcctttgcatacaaatctattgaggtcttgggaattaactttaacttttaaaaatgtctacatatgtatctcacatattgctcatattgctatcacataaaaatatctactttttggtattttaagtatatccttctggctttatatgtgcatccagttttgtttttttcaatgaacaaatacaaaatcacgttaacctacctttttctcattctgtattctaatgcctttatatgaaaattttaatattttacaattggtgattaatgccctttcctgaaatttggaaaaatgtatatagaaaactataaagaagaaaaatgacctattattttaccacccagagataatggctatcaatatattttagttcctttccatttttaatgcatccatgtttttcctcaaaattatcatgctatatacacacaaatatatgatgtttactgaatattcagtatattgttatttcaaaattatcatggtcttggaggtttgttttcaatttttattattttaaatgttttcagtaaacatctttttataaaagtctttgttcttcaggaacagaaaaccaaacaccgcatgttctcactcgtaagtgagagttgagcaatgagagcacatgaacacagggaggggaacatcacagactggggcctgttggtgggtgggggcaaggggagggggagcattaggacaaatacctaatgcatgcagggcttaaaacctagatgacgggttgataggtgcagcataccaccatggcacatgtatacctacgtaacaagcctgcacattctgcacatgttctacggaacttaaataaaataaaaatttacaaaaagtgtatgttcttattatttttaatagtcttttataagtgttttcaagtatataattatttgaaaattctttatatctattgccaaattgctttccagaaaggtaatttatataatttgcattttcaccagctttttacacacctcatcactcctcactaatgttgactattatcttatttttaaatatttattaattcagtagttggaaatggcatctctttgtttttattcatttctaaatgtcaattcattaataagaaaaataggatcccacaagaacattttaatgaaaggaagtaggcttttcctaatagctggttgtaatggttataactctgtgtgtgtgtgtgtgtgtgtgtgtgtgtgtgtgtgtgtgtgtgtgtcagaacaaacactggagtcccatgcctaaagtagaactttttttataatagatattggtatcttgatggacaaacactactaataatcatatgtgttggcattgtgttccctcttgcacttcttcccaaaataggtaagtctttatagagcacattatttgtttagaaaaaggaaagaagggagggagggaaagagagacaaatattaaggggctttaaaatttcacagtaccacatttttggcagaaggatggtggttgtgtataattttaaacttggccttattttaggttgttcagccttcagccctgcctagttaacctattacttggtttgcagtagtattttgtctgccccactaaaataaaatctttacagcggaacattaaagagcagcctttccttacagtgtaccattagtggtaagccagttccaattctgctgtacagagctacataaatgatctgtgacagatagttggaatgttgttattctgagccctaagccccagataccaaccactataatagaaaacatgcctaagatgtatagctttagttgtacgttaaaatcgctttccttataaattgctttttattttactgttattttacaggctttcttggctacacaagtagtttatcatttttctttatgatgttctttgctcttgtggtaagtttaaaatataatacattgcttatctcctcactaaaattggactcattgtgttagtcttttttacttttaactgttttgtgttgggaagggtatctcattttatttcactgtgttattaaaagcacttttgttccattaaattatttccttcattgtatctattttgaagaggcttagctagaacagcatttcaaattcagcatttcttgtggttaactagagaggagagcgtgccaattctgttaaaatcctagatggagtgtaattctttgtgtaggtgtgtaaatttattcctgtaccatactgtatgaagaatcagtctggttctaatctgtaaaatctgtttgagactagtcatcttaattttgaaactttattccattaataaaaaaacagagcttctggtactacattgaggagatctagtaagaactgggttgactgaattctattttgtctggtttattcagcatagataaattctcataaaaacactactacaaatatttttcttcacatgtgggatatattccttattttttaattagctcatttttattatataaaaatatcagatggtaaatttaacttattttgatattataaaataatataaagataagaatttaaatttatttccttctaattcttctaaaacatcttaacattctaaagatagtacctttgtgtgaaattttttaagtcttttttctttgtatagcagtttattccataatcagtatctaaatgtcaaaccttaagtagaaataaacatttttaactttccaagaatatacatgtccaaatgagcttttcataagcttggttcaactctttcttgtttttgaaaatgcatgaaagaaacagccatatgtaagagcagaacagcacatcagtagttaagccatattaaagatccagatttcaaagctgtcaaaacaacctagggtgcatttaacttaggctaagctatcttctgagacacagggataaaataactttaaattatttaaacaaagtggaagtgactctgattttagtatatataagcatttattctctattgaatgctcttaaaactaaaaacatttaacagtgtttacatttaatcatttgttgaatttaacaacattaaaatcattcctcttcttctctccccagttgtctgacttatatcttacagataagtgaattgaacatacactttgtaggctccatattgaaaaagaaaaaaactaaatatttccatcatcatttgattgttgagaagtgtggttagaagtggcctacatatgcaaatgaatgtatggatattaaagagaatcagtatagataacatattgaatttttctctcacagataattggcaatgcaatcattgcatagataggagtaatttagttttcatagccaatagcttaaagcaggttaaatgtattgatatgatatgtctactgtagttttgtttctgtcatgacagatactctttaattcaatgcagatttctaatgtagcagccatatggaaataatacccatattctacatttattgtaatgccttataaaccatctgctcagatttttacctgtgagcacagtttaatctacagtggggcaatgaagaatactctgtatgcttttttaaatactctttttaattggcatgtttattttattatttatttatttatttattttgagacagagttttgctctgtcacccagggtggagtgcagtggcacgatctcagttcactgtgacttacatctcctgggttcaagcaattctcctgactcagcctcccaagtagctgggatttcaggtgcatgctaattttttttttttttttttgtatttttagtagagatggtgtttcaccatgttagccaggcaagtcttgaactcctgacctcaagtgatccacccacctcggcctcccaaagtgctgggattacaggcgtgagccaccgtgcccagccaccatatttattttagattctctgaatgttatcttttaaaatacatagtggttaggaaaaggaaacgtatatatattaacccagaattttggaaggataccagtttttcatttattattcttgtcaatatgtgtttgtaaatatgtatagcatttatatcatattttttaaaaatcagttcaggaactattattttcttatattctttgaataatataaactaaaacctatattttatctgttctcccagatctgtattttcattaaaaaaatttaacctaaatttttgccccctctaaaatattttgcaattttaaaaataaattatatctgtctcagaatgataccatcaagatggatttacctttttttggtaaatttactttttttttggtgtattttagagcacaagcggattaccattcgttctaaaagttctatcttaagtacagattagtattctaagcaacgttttaatacgtcggtaatccagttagacaacttttttttttaagagacagaatctcactctctccagtcacccagactggagtgcagtggcatgatcatagctcactgcagactcaaactgccgggcttaggtgattcttctgcctcagcttcctgaatcactagaactacagctgcataccaccacgcctggataatttttttttttttttttttgagatggagtctcactctgtcacccaggctggagtgcagtggcgccatctcggctcactgcaagctccgcctcccaggttcacagcattctcttgcctcagcctcacgagtagctggaaccataggcacccgccaccacgcctggctaattttttgtatttttagtagagacagggtttgaccgtgttagccaggatggtctcgatctccagacctcatgatccgcccgcctgggcctcccaaagtgctgggattacaggtgtgagccaccgcgcctggccagataaatttttttttaaatgttggtagagacagagtcccattatgttgcccaggctagccttgaactcctatgttcaagtgatcctcccaccttggcctcccaaagtgctgagattataggcgtgagccactgcactggcctgaaatagagaattatttaaatggtttttagtcagaagctttgcttctactgaacactatgttaggcattttaggatgtggaaatttaacctggacactagtcttaaggatctgtcaatctagtaggggagataaatttcttttcaaacatggagaacagtgtgtgcaatatataaataagtattgatatatttgcttcagaataagagtctcaagagttgagaggagagaaggctcactgagagctagagtaaagaaggattttagaggaaatacaacttgagttgagccacaaaagaagcaaagggcttagagcagagagaaggaagggaggccttttgtgcaagtgaacaaatatttttaatacttagtctcctttttccctttgtcattccaaccccaagacttaccttcttaccaacctaagcaaggacttcctgttaatctttcctctctgttgttgggtctcgtttcactcccgttctgtacttctgctttgtgggacatcatctctatccaccccataccaccatacaggcttggagttgggatggatctttgcagagaaattagctgtagtaactgaactgtctattaatataaaatcaggctacttcttatttttttcaaattaataaaaattaatgataatattgcactttggagcattgctttgaaatattttgatttgaaagcttaagaaataacaactgataaatgaggcagctcacatacagagtttatctaggtacctggtgcacagcaagtcctcagtaaatgattttttctgccaacactaccactgttagttaggggaaaatataagaaactgaatttgggcctgtgcagtggctcacgcctgtaatcccacactttgggagcctgggacaggcggattacttgagcctaggagtttgagaccagcctgggcaacatggcaaaatctattctctacaaaaaacacaaaaattagctgggtgtgatggccacacacctgtagtcccaggcactcgggaggctgaggtggaaggatggtttgagcctgggaggtggaggttgcagtgagctgagattgtgttactgcactccaggctgggtgacagagtgagaccctgtcttaaaaaaaacaagaaaagaaactgaatttggagcagtttcaccctcacctcatcctcatcgtttttttttgttgttgttgtttttctttgaaaacctataaagataatgatggtgagattattgcttttgattttgttatttccttttggtaagttgaccgtttcattttatgtcatattgaaaacttacctagaaatgtcaaagcagcttgtctagtttatccttctacagtaatttttttcttggtgaggtttttaattaagagtgattctttagttcactcattaacttaatcctaaaagtatatgttttccttatatttgttttatcactgtgtaaaattttgattaaattagtcaaaatccaaaactaggtaaataccaagtaggaatagaaattgtgtttacatattggtctcctacaaagaacaaatacttcctttattctttcttgtccttttgtgcactgggattcaccctggagcaaacatttacagagtaattatgtgccctgaaacaacagcaacaatggtaatattgacagagccacagctataggtctgataacaggatggccacaattaagagtaaaaacatgaaacattttcattgattaattctgggaaacagcatccctctggatttcttttaatgttttttttgtttgtttgtttgtttttaccagctggagttccctagctatatgctcctattccagccagctttctccacattaaccaaaaataattcagatctgtaaaagtaaggaggggcagcacttaatgtgtacatcagaaatccctgagctccttctgagtataaagtctgtacttatttcttcctgtggcctttccataaactgctgttaaatgtttctctattcactaatacctactctacaaataaccatattcctgtgtgacagtcactgaaaacatcatgttcctgttttgagttgcacttaaaaaaaaatgccttgatgctgttggaattttgaaagttgacacaggagtacccttagtctttaatgggggagatctctacttaacaccctgcagtctccaaccgcctccctaccacaggtgaccatgttaaatgttgaccccattctaaccgggaaaagtcacagaagcagagactcttctattagcatcttatttaattgaaatgatactgacctatttcaattcagtttcttattaattttataagaaatgatctgagtgctgattctgtttacttttttaggtaataattaaaaaatggtccatcccttgtcctctgacattaaattatgtagagaaaggtttccaggtaatagcttatattttcttttcagtttcttcctttttattttaactaaaaagaaaagaaagactaatgattcttttctgattgatgaaaaagtaatggctatattgcattttagaactttgttttgaaatactttcatttgaaagcctagtaataataaattcatcatttttattgatatattctgaaatttaatggctgttggtttctctttttcccctcaatgctcttaaacagatttcaaatgttacagatgattgtaagccaaagctctttcatttctccaaagaggtgtgtaagttattaacagatacttttagttgatttttcacatttcaagttttaagaggtttgtgtaacagggtctcttaggtctttgtacctgtgactaattaattttcatgaaagtgctaagtataggattgcctaccagaagactactattatttaacacagggtggcctattatgaaacagccacctttttttttttttttttttttttcctggtatgcctttgaatggagcctgttttaaatgggcctctgcctgaaagaacagatttaccgaatgtctggtctggccaataaggtcctctgtgtataccaacttcctgttgccctctgcacttgtaaagctaaatagccaattatatcaaaaactcttcccctgtgagtagaaccttggtctgtagctaaacagcctcatcattggactagggattgagcactgccaatatatcttctggccgacattccaaagttgaaattcatgatgccaggagtagagactaggagaccaagtccctttgccttccctaaaagccataggatactggaaatgcctgtaagagcccctgagcatcagcagaggagacaagaactgtgacatggatggtctctgctttaccactctagaagagctcaaagtcttccctgttgctgcaggcttatttgtctatactttctgactctgctgaaatgctattttgtatagttcccagatgctagaatcccccctgctcatgtaaaactctattagtgtagaatgttagcttggttactccaccatgcagaattttcctttttatctctagtttttaaatgagaaatatctctctggtcccaaaagggagattaccacatcttttacatggtaaagacctccaggtgccgtaaagatctaggtaggataattgacaagccaggaaactgagcaatatatgaaatggagaatttgtgaattaaactctcattttcctagtccagcctcaggaaacactacagcttcctctctcctaacccccttcagatattttaagactctaggcattatgtcccaagataggtcttcatttctggaatttcttttgtttaagagcctgaagttagttaagtggaaatttttttagagcagaaaggagaaaatagatcaccatcgtctatttggtaaagatggtattttcacttaaatggtaactttttttgctttactctgactcttaagtattctaataataaaaacaaaacaaaaccttatatttgtatattacattggatctcttaagagtttgtaggtctagaataaatgatattcattcccattgaaagagatcctaatcaaagatgctggcaatattaaaatgtgattaatattttcagtattcccttggattgagttcatgaaagcaggttcaagagcattaactattagtgctgcttagagtaataagatacatttaaattgtgcgtacatttagaagacagagaattaaaaaagagcatttctaaaatgttatttttatctcatttaaatattatttatcttatgtaatttttaaaatcttatccagataatgtagaagtagtgattgtagtaaaagcagcatggtatgggcagccaaataaaaaatattctggctagtacaggcaagcccactatcaaataaaatatttgctggatcacaagtgtttttctcttttaaaaaattcttattttataaagagaagactcattaaagatgaaataaatgtaatcaaattgattttttaaagaactgagtttgttgtcaaatgaaataatggtttcagtagagtggcatttaataattttgtctctttaaaatttttttcagagtgcttatgccttaccaaccatggctttttcatttctctgccatacctcaatattgcccatatactgtgaacttcaaaggtactgtagaatcctggaatattttaaatatattgtgtatctttttacctctaaggctttcggattgaatgacatcctcttttattaatcctttcctctcatcagtggatcctaagtgttagtttaaaacaaaacaaacaagagttagttctgtccaagttaagaatgtttcctagaagtgtaatctttgaggctggcctgtaatcccagcactttgggaggccgaggcaggcgggtcacctgaggtcaggagttcaagaccagcctggccaacatggtgaaaccccgtctctactaaaaatacaaaaaaaatagccggacgtggtggcgggcacctgtaatcccagctacttgtgaggctgaggcaggagaatcgcttgaacccaggaggtggaggttacagtgagccgagatcacactactgtattccagcctgggcgacagagcaagactctgtctcaaaaaaaaaaaaaggaagaagtgtaatctttgtgtactaatttcgaatgaggacttctagtgtatagttattgatggagttgttcttgaatgaggaattctctcgaccagcttaggacatacttgtttctttacatataattcagatcacttattctacctttgtcatttttgtcttttagtccttcaaagaaaagaatgcagaatgttaccaatacagcaattgctttaagttttctcatttattttatatctgcactctttgggtacctcactttttatggtaagtacattttaaaattatagatgacaaaataatagttacatagatggcctcacgccaatctatagactttacctatgccttttattactaagttaatttgctcagatcaccaaattacaatgcagtactgtggtggctcttgaggcctaaacaattggattatctttcttttagaaaggtagttcaggtttaagattaatgacttcttatgaaaattttcttaaacacttaagtaaaacttcaggcttagggacatgattctttctataagaaaaaatgtgcaattttaatgattctgtttttcttaaattttgaattcaatatattagtctaattcagaagtgtgggggttgggtgagtcagtcatcttaattgcaaaagaacaagttgagaaaggaaagggttttacacagaactatatctgtatacttagatgtcagacatctctgccttcagatctaattatcacaggattcagcagatgtgcattctatgatgcaccatgaccttcctccttaattatttttacaggttcttttaaatttatgcaacaaaaataaaattgtgttttatttcttttgcaaaaactgtctgctttgtatgttgactttttttcctcttctgataagaacctcaagaaaaagtaaagttctgtgtacaccatcaggaaaagcattatttccaatgtgagcatggtgccctgctagagacgctacaaagaaagttaaaacagattgtcaagcttttctgatcatcattaataaaacaaaattacttaaatatataaactttatttttggatgttgggtttgttagtttttatacagacttgaactcaataagacttttctgtgtcaataagatactgtaacagggtctcttgggatccaaaaatattttgtatagtggaatagctatatatttcttttattaaaattgctacctggcacaaacactattatatttagggatcttcagcaataagaaaaagtccaaaaaaactgacctccttcttctccctatggataaatagaactatctggaagaaacctcagatggcttgccaatatccaggctggctgagaaattgttagatgaatcaccattaggtgcttagaaactgtattaaattgtagctgtattagattgaaagggatgtggaggaaggatggaagctaatacatttattgagctaacatttaagacagtgtcaggtattttatatatactccctaacttaatccttataacaattctgcaagctcagtgtaggttcatttaggttgagtaattagaccagatacttgaagccagttaatagtggaattgggatttgaatctagttttgtctctctccaaagccaatgcctttattactgtgttgtctactcagaaattgtgctatagaagccagatttcctttattccaagtttttgttaaggtgatcttttagaaaaatatgactcacttaagctctaggcatctatctatgtatgtatctatgtataatctatctatctaacattgctgcttgaacacaaaggctaaaggttttcatcatgtagatggcatgtttcctagacagggatttgtctaatatcaagtaaaaccattatgttgtctctgatttaatctcttctccactaatgcaaattcttcagagtatgcaaattttatataatagagaaatacacatctaagaaaatcacatggtaggtaggtatatgattgattaataggtaggtgggtaggcagatagatgggtggatgaatagatgatagattagatagatagatagatagatacatacatacatacatacatacatacatacatacatacatacatacatacataaatagaataaatgatacaaaagtagtaagttcttctccaaagacagaagaggcagatattgatttgctcttggattgtgaatcataaccaagaaaaacctttgatcatatctttctaccaggataacaggagctttgtgtcataggaagaaattgctggttgaacctgagatcttataagggctagcctcaacttaaggcttccaattcattttacagatgaacaactaaagcccagagaggtgaagtgacctgtcacagaattaaaggcaggtttcctgaatactaatccagtgttatttctgctactttgtgataatctttgtaaacttaataccctgtttgacaatgtgtattaaacaggacagcctcctgacttcaatggcatatataacttgcagagatcaccattaggccctttctgagatttgtagagatttgtctgaatccagggaagcatgcaccactctatccctcacatatgttatggctcagttaagaacacagagtgactggctcagaagaagtgttttcatcctgggaaagtagaaagtggacatgtgacatctattttgaatttgtaataaatctagttcttcaagattcaggagctgctttggatccttttatccagagctcctaaagtttaatttctaaatttgtcagattaaagggacttataggtatgtacctagattaatgatacttgctctgattacagctgtgaaaggaagagaaaagggttcctctggtgagccaggccagtgcccaaatgttgcataataaccaggccatttaaaaagtctatgaggttgttaagcaagaagtgttaatagctcattttatgattcagaaaatggaaataaaatagtttgccatatttctccaaagactcacaagtatctcacagatttggaaatagaatccagatttcctggctcttcttagtctcctacttagtccaaatcccacattgtgtaaagtatgtttttgatactttggacaattcatttctctcctgtttccattatcactagtctagttcagattctctttacctctcagtgattgtaacagtagctgttatgcctgtttggggtctctttttcttccaatccgtactcctgctttagttcagatcataatacactgttctttgtaagtcattattgcatttctgtggcctaccaggttgaggccacatctcatgcagaactgtattactaggtctgaaatgcatttccagccctatcacccacacactgtttcatccactgtagtacttactagaccacttattttctcagatgcacattccctttgctttgtttgtgctgctccttgcttctagagaatctcttcccccacatctttgaacatcagcacacattcattgactcatgtaatgttctcagtaaccctatagtttagtatatggccatccccattttaaagatgtaggaactgagagactcagtgtaagttgctagttactggtggggtttgaacatgttctatgtcatcacagtttagaatctccatagctcttgtttagaactctctggccacttacatgtgtatatcacactttctatcatagctatgtgtattcatctcatctcttcttaaagttccctgagaacagaggtatgtttccttttgtttttggtttccctcaaagtatcctttctgaaacactctcaaattaaaaggcaccattctattttaagtacaaactgatattttcccacaaaacactgatatccagtgtttctgagcaccctcagtcttctttccccttgtctgggttgaggttagggagacattgtgagaatgcaagaacactggagcaaagcttggtcggcatgtataaatcctattgctgaccaccacacactggcctactaagtaagacatttccctaacacttctctttttttcataaaacatgaatccacagatgaaacgtaacatgcaccaagctctgagattctagaaaacgttgtggtattgaggaaaagatgctgtctctagcaccaaaaagaagtaggtgtatggcactgcccctttgtgttatgtgatcttaggcaaatcatttaacacttttggacctacctgcgtattaatattgttatcatggggactaaattcaacaacacgtgtgaaagcactttataaacaaacagcacaaatgttcaaacccttagattatggaaaagttccaaagagataatttagtatacatattcattgtcataatttgagaggttctgcttattctggtttttattaaaggaaaaagggtgttaggtttcaagaagatatttaattaatgtctctgtgtttcataggctaggggaaaggccaggatttggtaatgggaatctaaaatctgttatcatccattagtgcaaaggaaaacaattttgttactattgataccttagtactttataatgtgatccttattattttatttacagacaaagtggagtcagaattactaaaaggttatagtaaatacttatcacatgatgttgttgtcatgactgtgaagttatgcatactatttgctgtgcttttgacagtccctctaatccacttccctgtaagtactcttaaagggttttgttgcctagtatagacgcttcctaatagggaaacactaattctttgcagaatagaatgtttgaatcacatctagtcttgtatatcttattcacttgtcaagtaattgatcaaagacttcatacttgcatatggccccgtaaaagcataaaaataacagtgagccactaagctaatttgtgctttttgagatttagtttagatttacgttctcccacagcattgtttccaatttagaaactatagttcttctaaagttttgggtttttcccccctttaattctgtattctgttttcaaaaaaatgtgcatgaagaggaaaaagtcaagtcaggaaaaataagctccttctgggtttattgtaaatttattttcacataagcattctagttcaatcttggtgaaaatattttatttgctctagaattgtaatttaaggggcaaaacagattttcattgcatctggttgctatacttgagaatcttaagaatttctgagaaaaagggaacaaaggctttgggtataaatgcatctgcatggatgtcttgaatctctaatgctgagttttgtaagagctggggcttcaagcctcctccctgtgtgggctgcagtgccaagattacagcagggactggataaattttttggcatgtgaccgcctgctgtgctcttagcaatgggaagtgtagtgaactattttttcatatttacaggctgtgaaacatataaaataaaatagtaagtggtatttctttcccatggcatgatttctttttctattataaattgtctgtttttttaatctgttgcatttaatgaaaatcattctttgagacttttttcatatttttattgttggtaattttaaaaattatgcaacctaaaaaaattgcatgtgaaaactttttctagcattaaagctaagtatttttatgaagcttacacagaaagggttagtatataaacagtttatgtgtataaatactttataataatagtttatgctgtatttttgaaatctaaatgatgtaggaggcaaaaatatcatggttgttgtatatgtttctctcagcaaatatctggactttgacatttcctcttcgctatatgtttatttttctgtaatacaggccagaaaagctgtaacaatgatgtttttctccaattttccattctcatggattcgccattttttgatcactctagcactcaatattatcatcgttttacttgcaatatatgttcctgacattagaaatgtatttggtgtagttggtaagttttctgtttcaaaaagttcacataataaaattgataaaattgctacccagcctcacatctgaatccagcaatatcctctcttttttttccctccactttaaaggtgccagtacatcaacatgtttgatttttatattcccaggactattttatcttaaacttagcagagaggattttctgtcatggaaaaagcttggggtaggttgtttttgtttctttctttcaagacttctattttaagaaatagtttgtcagtttatattattttacctgcatcaagaaagtcaatatattttaaaatatagaatacattattgcagagagtagagatttaacaaataatccaattgtatttttttatcttttttcttttatctttcttatcttttatcttttttcttatttccacaggcattcgttttgctcatctttggaattttggttgggaattttagtttagcactcatcatttttgattggattaataaataaaagaaatattttcctacttcttacaagaataatatacccctagttgcaagaatgaattattccggaagacaccctggatgaaaaataacattttaataaaaattattaacagaa

SEQ ID NO: 527 - DNA, 102621 bp, Homo sapiens
cgtcatcagatcaagtcgactcgctcctctccttccaggccctggtgaagtacggaatgccggaagggccgggctcaaagctccgcctctggcgcgaccgacgactggagcgcagggcaggggtagaggctcgtagatggaactggtagtcagctggagagcagcatggaggcgtcctgggggagcttcaacgctgagcggggctggtatgtctctgtccagcagcctgaagaagcggaggccgaagagttgagtccgttgctaagcaacgtaagtgggctgtgttcgcttccccgcgctgacgccctccggcttccctcaagtgcctgccaaataagacccagaaaaggaggaccgcaccgggacaggggagatgctggagcctgaaccctgggggatggggtctgaaggcagccgccgagattcagatgagattggcgcagttatgaacgtgatagcagcctagcatactctagaaagaaaagatgaaaagcgtcgggtggaagagatgcagcgttgagtggaagctgcgaacatgatgggatgagcggccctaggattatgtactcactgctgttagttagtatttttgtcaccttattttctccaccagtctcgtgaggtctttgcaagagtcacaggattttcctcttccgacttagtcatggggggagggaaaataataaacattttaatacagaaattcttagcggtagaatggaagtggcttggtagtaagtgcatagcacgttcctgaccctaaagcctgtgcagtgggcactccgctttttaactcgagtcctagacactgttcccaggactttgttcccggtgctgtttgtggggagggggatgttttcagggatactgccagaacaacgtgaattgcttctgtttataatattgtcattgcaagatattcctgaccatccttccagtttggtagaactaattcattagatatataagtagagattagttgtgcagtcctagtaattgaggagaaacaactgcccacagcagtcccaggttgactcagcaattctttagtaatcacatgagctgaggccttatccctcctctctctccccactccattcccatcctatcttcatctcttgcagtcacaaggttagtcatggcccttcctgaactctgcctgtcttgtgtactggtggaaatcattttcctaagaaaccctagattcctggagctgcagtagtgggaggtgggaaggaaaggaaaggaaattagtgttggttaagcaacgagtgtgtcatacaaaccctggtggtttgcagcttttttccataatctttcatttatggaatttctttacgaaattttaacttcaccgtccaaacatttaacactactaaatttgtgtgcttacaggaacttcacagacagcgatccccaggtgtttcatttggtttatcagtgtttaatttgatgaatgccatcatgggaagtggcatccttggcttagcttatgttttggctaataccggtgtctttggatttaggtgagtcttcatattttagcatcaaatttttttttccattttgataatatacggagaagtagagagatagattccagaagctgctattatacaatttctagttagttatttctggggttttagcatttttcttgttattcttgttgctagtgtgtaccttggagggctactacatagcttcttaaatacacagaagtgtgactagtttttaaaaatgggaacttgatccacatttcatttataatgaaatatgacacttaagagtggcatattcattgtatctccttggccaaagtgaatcaaagccatgcagattaacttccaaatagcaattttgtgagtgcaaatacaacacataatcttttcattcctcgctgtctctttgtattgttaagtagtcttatttcactttcagaggccagacatgtgttttgtgcctgttcttttttatgtttcaggacttagcttgtaggccagtttgcccaaaatagaagacaatcctggatattctgtgctttcatagtactttgtatattcattctgttattataattgttacaatgatatgtttggaaattaatgttcccactaaactgaaatcctttacaactggaggtcaaggcaggcggatcactggaacccacgagtttgagaccaacctgggcaagatggtgaaaccccatctctgcccaaaatacaaaaattagcctggtatggtggagtgcgcctgtagtcctagctacttgggaggactgcttgagcctgagaggttgaggctgcagtgagccatgattgggctactgcactctagcctgggtgacagagtgagatcctgtctaaaaaatttaaaaaatagaaaaatcctttataactggaccttattcttagcatctagcaccacatggctaatagaatgaattaacaaattggctttgtcagtagaagcagatctatttactaggaaatttaaaatgcctagggagtctcttttatgtttatttcctgcttttattccaaattttttgataagcaaagcaacttttaagtaacccaacttgcttttattatggaatgtactcacaaactttcattatttttaaaattaaaaactatatgtgacaccttaagcaagacatagtcagaggactttttttttgattctctttgaaaaatcataatttatgcaccagggtcttacatgcagatatatactgctgaatgtgtgctcacccagtcatagcaaccatcatttttggtgatgctaaagtgttattttgtgaagttcctgatgtcagtttaatgacatttgtacttttacctctcaattttatttattaacaagtattaactggaccacagagagaaaatttcttcaatgactggggcagttcactggggatagctgtatagaagcttgtcctgctggtgtcttcctaaaaatgaataggaaattatctaagttttttctttcacactgttggtgagaggacctcaatcattacattgtttgcacatttttcaaattgcatcattagaggtgtgttaactacattattttaatttagtttggtttggagagtgtgtgcgtttaatagatgctagaaaatacagcctaaataaatcttaagtacaccttaataagatgaaggtatgataaggaggtcaatatcactggaagtagagggaggaagggaaaaagagaagacaatgagattgcataagtaaaacttctgtttagacttaaaataagaagaaaaccagtcataaaaaggaaatattacaagattatttaatggctgattcagcagtcagcagacaagactgcaaaatgaggaagtttgcttgtatttttaaaaaagtttggtttttatttttttttattttaaaatcagtatattttcatttaaataaaattggtaaatacaaaaaagtagaaaagtatcttcttaatttccttaatgaacataattctgctactcagagatagttcctgtgaatatttgactgttaagcaatttgtttttgtaatgagacaccatacaaaagacaaacttttgggaggttttgaccaggtgttcttttatgttttagcttcttgctgctgacagttgctctcctggcttcttactcagtccatcttctgcttagtatgtgtattcagacaggtgagtaaaaatgttatgctgcttcatttaataaaggagtctcttgagtttgtatctacatatagaactggatgtctcaaatctaatatccagtgagcatacatttttattagatagggtgatcggaatggagaatttgaaaaaccaggatatacagacccaatactgtgggggaatatccaagcacaggatgggaggaggtaattagcatttttacctgctttcctccacaacacaacctaattttctggagtagagtagatcatgggagggtctaaaaggtgttcaaaggatccaaaccttatgcttatggagaaatcattttctcaaggagagaacaccttctcagagctactgttgccttccctgcccccatctgcctgctagtcagaggtagggatggcagaattaggattgtaggaagtaaggtcacaaagctttaatttatttagacacattttgtatttttaattgcaagtctagaatagggtagttttttcctaagagaaataagtatgtgcagttaattcaatatatttgtgtatatactttttcccatttggaattttattatgcaattcagtcatgtattgaataagttcttttaggatccagtaaataaaagtatatgaattatagaagtgcttttctaagattttccttttgtcattaacaaatattctatgttcatcagtcctggtctttttatctgtctagtctcttttgtctttggattaggtcagctttgatgccaaaatcatgggtttaattcttatatggatgagttcgttttgctttatctggccttgtgatgttcagattttaagaagaaaagtagatacacaaaatagataaaaatggatttcttaattcatttagtgtttctataaaagaatacctgaggctgcataatttataaataaaagaggtttattttgctcatagttctacaggctctgcaagaagcatggcccttcttatgaggggcttttctgctccatctgcatctagtaaggggctcaggctgctttcattcattgtggaaggtgaaggggagctaggatatgcagagatcacatggcaagagaggaagcgagagaggaggggcatgccaggttctttttaacaaccagctctcatgaaactaataaaagtgaaaactcactcattaccccaaggaaggcaccaagccattcatgagggatctggccccagggcccaaacacctcccctttggccctacctccaacactggggatctgatttcaacatgagatttggaggggtctgacaaaccaaactatatcagtgagactattctgtgctgaaacaggtgagtgaagcccagtgatgtttcttaagaattttaagactcttcagaataattctgaagccactgctctagtttgttttcctaaaacctgtccatcatcagaaatactcatagatctttttatacacagagagctctaagcctcagggattctaatttcaaaaatctgaggtgagactcaagaatatgtttttaacaaggcaaaaccagtttaggatccatagtttatagctctaacttgtaccagtgctttggccagccagtgccagatatgtttttaacaagtcctccaagtgattcttatgcaaatctagtttaggattcatagtttatagccacaacttctaacagtgctttggccatccagtgcacgcctttgctctcaaggggcttgggtgaatgtgcagacagatgaaaatactaggaagcagtacaaatattaatcctaaagtaacaggttgttcataaaagcatcctgaatttaggaataatagctttagataaatatatttgtaaatcctgctgaaacttgaattttaattgcatgtattgaaattttgctgaatgtgaaaaaaattttacttaattgtgatactttaacatcttggtagattctttcaattcattctgttaaaagattaatactttagtcaactatgtggcaattatgtctttcaagcttcattttaaaacttcattttagttttaatttaagtaaaatgttttatttcggttatgtgggagtagtattcagtgtgtggagatttctaagtaattttaattttttactccttcggttcacatgtatttaactttaagattctgacactgtgtttgttcttttctgtaactctggggcgtatgaagtgaatatatctgtttctcttcttttttctttttctttgatttctgtagcctacttgggcccatgaactaactacttcatggttctgcctgcacattgactcacctgtcttccgttgattgaattccttcaatctttgtaaaattctctgtggaggtaggcttttccttttttttttttttttcaatacatacattcatatataaagactagagtataatacgtaactaactctctcccaacagtttgttggactgtcataaaggattattatgctcagattgaattcattggtaagagaaagagctatcatgagtttttatgaaataacttcttcatttatttgctggtggtaaagggtaaagagaaattttcatctttataaaagtaaaggatttcttcacatgaaattctactttagattttatggagcgtttggggtctatcaggacttttcatgggagctgaggtggaatgtaaagaaccttattctctctagccttcgtttgtcatctgtaaaatggcaatgataacacttccttcttggaattgttctgagagtgaaataaaataatgtatatgaaatgtcaagtccttggcaaatgagtgctccctggggcaaaaatgcccactggggcaaaaatccctaaagattgcagggtgttgtacacactactatctcagaaatagttggttcgttgccattcttttggaatacttctcatgctctgatactaaacccacagctcccctccactggcttccatgtcactgtcaactggagagagtgagagtcctagaactctgcatacctctggccgaaccacaactccctagtcgttgatccctactactcactggattgtcaccattatttgccttgagaccatttggattatgacattataccatctatctcaatttgtgttagtcatttcaagtatattaggttatctttcatttctcagactcatcccatatggctgtcatctgtttctgacctcgtcttccactgctctctaactcctgaaacccttccactgtgctctctggaactcacagtcaatcatcagcaaaactcacatgtctctaattctcttctgaacatttctgtctgtttcttacactacgagaacctcctctgaggcttccctgtagttctctcaagtggtcagtcttttctctttatgtctctcatactaatttgaagatggtataggtgtcctgtttgtcccacatttctgcttctcaaccatcttcctctccttgaaccccccagcttttaatctcatgaatgtataccatctacggctctccttactattgtcatctatagactcctagaccatttcctgtcatttcatgaaagttttagctaaattttagcttctactcaccttttagttctcttcagtattacccctgttataattctggatgatttcaatatgcatgtagctaatccttctaatgctttcagttcctgaacctcttcttctctaatgatcatattctctacctacactggccacttattttctcctatggtcataccactgatcttgtcattaccaaaatagcatttgttagtatctgcccatctgccaccaccatctcctttgtttctaactcaccctctcaagtacttcaactctgacagttttcacccctaccaagacttctatcaattcattgattctaccacctttgcactgaccccccacactcattcttacttccctctttatccagttgaggttttgtagtatgttatttaatcccttgcctatcccttgaaccatcatatttccctggtaaaattccaaccatagttaaatataactctgcctgcttcacatttgcacccatgcatttgaatcttcctgaggaaaagcacaaccatgcagactgatatcactataattcaacgtctagtgtacctatgatgctatcacacaattctggttcacttctttggttcatcacttcatttagctcattcatctgctatctaggagattgcttttttatatcttctcctgtcaaaccttcgacacttttttctttgatttcacccataactgatattcttcgctttctgtttcactgaaaaaatagaagcaatcataaaagaattttataagctcttgccaccacttatttatctgtgcctatatactctgttccttgggatgaattctttgtgtttatttctaaggcctaccccccaacttgtgctatgatcccacctgctcttgcctacatcactccagccactttctcccttctttcttatttcttggcccttttctaccatttccttcctatcattttacaaatagtctaatttctgtcatcataaaaatctcttttactttgcatcttttgaatatgcctcatgtcttcatgacagcactccttaaaataattgtctaaaccaggccaggtgtggtgtctcatgcccgtaatcctagcacttcgggaggcagacccaggaggatcacttgaagtcaggagtttgagaccagcctgggcaacatggtgaaaccccatctctacaaaaaaaaatacaaaaatttgtgtgaggtgacatgagcctgtagtcctagctactggggcagctgaggcaggagaatcacttgagccagggaggcagaggttgcagtgagctgagatcatgctgttgcacttcagcctgggggacgggagtgaaaccctgtctccaaaaagaaaaagaattatctaaaccagatgtctccagttcctctcctcccactcctatcaggcttttccactgaaactgttgtagcagtgacttccacattgctaaatccaatgatcagttctcagtcagcagcatgtgacagagctgataactccttgctctctgaaagacaagtcacgctttcctagttcttcctgtttcatcaaacactccttttctcttctgttgaattctcttaatctccccatcctctaaacattggtgtacccctgggactattcctctgatctcttttcttttcccttcttttcttttttttttgagacagagtctcactctgtcacccaggctggaatgcaatggtgtgattttggctcactgtaacctccgtcctgcagggttcaagcgattctcctgcctcagccgtctgagtaggtgggattatagatgtgtgccaccacacccagataagttttgtatttttagtagaaacagggttttgccatgttggccaggctggtctcaaacttctggcttcaagtgatccacccaccttgtcctcccaaagtgctgggattacaggtgtgagtgatctcttttcttttacactcattatcgggctcatggtgattctgaaatttatatccctggcctggaactctcccctgaatttcagtctcatctccagctgcctccgtgacatctccacttggatgtctaacagctcagatttgtaaaactccccatctttatactaccaatctacactttctactgttcccatctaagtaaatggtaatgtctttcttctaattgcttaggccaaagatctttaagttattctgtatctcccctttttcccctcatcctgcatgttcagtccatgccatactgttcccttcacttcaaaaaaaattttttttcgagatagtgtcttgctgtgtggcccaggctggaatgtagtggcgtgaacatagctcactgcagcctcgacctcctgcctcagcctcccgggtagctggtaatcacaggcacacatcaccatgcacgtcaccacacctaactaacctcagcctcctgagcagctggtactacaggctatgtgcgtcaccacacctggctcattttttaattttttgcagagatgggctcttaccacgatgcctaggctgttttccaacaccagctcaagcaatcctcctgccttgacctcccagagtgcttgggattacaggcatgagccatcgtgcctggccaaaaaattaataatctgataattttctcatttaattgctaccacccatcttcagttactattaccaccatcaaaagtaatagtttatctttttgtttttacttccactcttacttcctgcagtctattcttaacaaaacaaccataatgatctgttaatgtaagttaggtcatagcattcctttgctcaaaatcctccagttgcttcccagttcaatcaaagtaaaagcaaaaatcattacaaagtccaacacaagtcttctgccctttttatctccttgatttatcttccagtactccctcactggtttcagtcacacttttaatttttatcttatgtaacatatacttatatagcacttagcatcattctaaggactttatgaatatgaatattcatttaatcttcataataatattatgaggtacgtatcaatattatttccattttttgaaatgaggtaactgtggcacagagaggttaaagtaacttgtccaagagaggtgaaagtaacttcccagttaggaagtataggagccaggattcaaacccacacagtctggctctaaaattgtgctcactcttccccagtcgtgctgggtagtctcctgcttccatacctttgtgctttctgtgctcttcttggacgtttcttcccccagtttcccacatgactttgctcactcatcaccttcaaggctttgacaaatcttacctcttctgtgaggtctttttatacaatctcatttaaaattacaaacagcaacggttgatctacagtgtcatcaaggaaggaggatctacctttctgttccattattcttgtgtgtgccttccccatccttgaggtctaggacgacttgtggagtgcagacatcgcatccgtgttctagagagcagaaagagagaaagggatgcctaccagctgaatctcacttaagactccattttcttgttgccagaacttaatatgcccgatggccatactaaattgcatagggacctagaaaatgtagcgtttattaaaggtggcaatgagcccaactaaaagtcagggttctgttactcaggtagaagaagggaagagacaaccagcagtctctaccccaccagggttccatctttatccgtacttgtactttactatctttgaataacattataaacttttatagcttagctaccaaaaataggttgacgactctcatccatgctgccgaaacatatcagctacctctgatattggagatctccatttagatgttccagaggctttgtgagctcaacgtgtttaaaattaaacttatctttcatctttaatggctcaaatgtgctcctcttcctgtaccgtacctccgtgaatggtaccaccagtttatatctccttcacctcgtacattcacccagttataaattaattttgtaaatatttctcggatctgcctaattctccttccttattgctactgtgtagatcacgccataacccctccccaggattacagtagagttaaatcataacaggtatttaagttcatgtcattttaattcatacagttcaaaagtggggaagaaaataactttaaatagtgctgggtaatcctgcctgtattctactcagtgaacatatattcatctggggactgagtgtgaggtgggaaatataataatgttgctccctctgttatattttttttctttaaagataacttttttttttttaagacaaagtctcgctctgttgtccaggatggagtgcagtggcgcgatctagccaaaccgcaacctccgcctcctgggttcaagcaattctcatgtctcagccctctggcatcttaagagacttcctatgagttcctgcctccaaacttttttttttttttttgaggcagtcttgctctgtcgcccaggctggaatgcagtggtggatctttgctcgctgcaacctctgcctcccgggttcaagtgattctcctgcctcagcctcccaagtagctgggattacaggcacccaccaccacatccggctgatttttgtattttttagtagagacggggttttacagcgttggccaggctggtatagaactcctgacttcaggtgatctgcccacctcggcctcccaaacggttgggattacaggcgtgagccaccgcacctggccagataacattttttagcatactgtcttcatggtgctgttttaagagatttgcatgtattattctcacaatagcaatgtgaggtagaaattgttacatccactttagagataggaaactgaggcactgagtgattaactagcttgcttaaggttgcacagctagctagttagaagagctaatattcgatttaggcaagctaactccagagtccactttcataacactgtgctgccatttccccactattataggaacctggaagcttattttctggagaaggtaaactaaaaggactcagcaatcatagatattaggtgtagttaaggccaagatcaccttactgaaaacagggagattaagtgaaagtctactaactgaaggagagtcccagttagtaggagttctgagactgctggcagcaagtcttctactttcacttaagggattggaggaatattttcaacagaatttctcctgcccaagagaaaagacctacaggtaaaaatagttgagggcccttcaagaaagagctgagtacctcctgtttaatcatcatatagttaagcataccactcaataagcctcttctgtgtacacagagcttgtatttagtcttttaatgcatcacacttacgtcaagaaatagccaagtatcaccagatatttcaggaaaacctttaatgtgaaagatatatactaaaacagccacatacacacacacaagccaataatgagatacctctacacatgtattagaatgacaaaaatctgaaacactgacaataccaaatactggcgaggatgtgggacaacaggaactctcattcattgctggtgggaataagaaatggtacagctactttggaatacagtttggcagttttttaaccaaactaaatataatctcatcataggatccatcagtagtgctccttggtatttacccaaatgagttcaagacatatttctacacaaaaacctccataaagatgttaataacagccttatatttaccaaaatctggaagcaactaaaatgttcctcagaagtgaaagaattttaaaaactgatatatttgtacaatgggatattattcagcactaagtagaaatgaggtgccggagccttggctcacgcctgtaatcccagcactttgggaggccaaggcgggcggatcacctgaggttgggagatcgagaccaacctgaccaacatggggaaaccctgtctctactaaaaatacaaaattacctgggcgtggtgctgcatgcctgtaatcccagctactcaggaggctgaggcaggagaatcgcttgaacccgggagttggaggttgcggtgagctgagatcaagccattgcactccagcctgagcaacaagagcaaaactccgtctcagaaaaaaattagctgggcatgatggcgggcacctgtaatcccagctagttgggaggctgaagcaggagaatcgcttgaaccccggaggcggagactgcagtgagctgagatcatgccattgcactccagcctgggcgacaagagcaaaacctcgtctcaaaaaaaaaaaaaaaaatacccagcatggtggctcacgcctgtactcccagcactttgggaggccgaggtgggcggatcacctgaggtcaggagatcaagaccagcctggccaacatggtgaaaccccgtctctactaaaaatacaaaaattagccaagtgtggtgacacacacctgtaatcccagctacttgggaggctgaggcaggagaatcacttcaacccaggtgatggaggttgcagtgagctgaaatcgtgccactgcactccagcctgggcgacagagcaagactccatctcaaaaaaaaaaaaaaaaaaaaaagaagaagaaatgaggcatcaagccatgaaaagtcatggaggaatcttaaatgtatactgtcaagtgaaagaaaccatgtgatccagcaattcctcttctgggtttatacccaaaggaaatgaaattggtaccttgtagagatatctatgctcccatgttcattgcagcattattaacgatagccaagttagagaaacaacctaagtgtcagtaagtgagtatataaaaaattgtgatatgtacgtacagtgcaatattgttcagacttaaggagatcctgccattttcaacaacatgcatagacatggagaacattatgctaaatgaaatgagccagacacagaaggaaaaatactgcatgatctcacattcatgtggaatctaaaaaagtcaaatacatatgaacagagtagaacagtggttatgtgggggatgggaagatgttcatcaaagggtataaagttgcagttatgtagaatgaataagtctacagagctaatgtacagcatgatgactatatgtaatattgtttactgaaaatttgccaagagagtagatttcaggtgcttttaccacaaggaaggaagaaagggaggaggaagggcaagagggaaggaagggagggaggaaagaaaagataactgtgagagggtagatacgttaatttgcttgactctagtaatcatttctctgtgtatatcaaaacatcatgttgtacaccttaaatgtatataataaaacaaaaaaatctgaaaaggctacatactgtatgattccaagtatgtgacattctggaaaaggcaaaactatgcagaaaataaaaaagatcagtggttgccagagtttagcagagggagcgtgaataggcagagcaccctcacctttaggacagtgaaatgaatctgtatgatactataaagtggacacgtgtcattatatatttgtcaaaacccatagaatgtacagcactaaaagtgaaccctataatgtaaattatggactttgtgtgataatgacatgttaatatagatacattgattgtaacaaatgtaccactctggtgcaggatgttgattgtaggggaagctgtgcatgtgttgggggcaggaggtatatgggaactctgtactttctgttcaactttgttgtgaacctaaaactgctcctaaaattattaaagaaaacacaaggaaagaaacagactcagaggaaaagaggaaacagacaatacaagaccagatgaaaacttaaaaagctacatttaataactttagagaactaaaagaagatcctgcattcttgaaacaaaaataaggaattataaaaagggtatattcagaaaaccaaaagtcctagaagtcaaaattagttcaattgttgggttgggagagttacagaagtttcctgggggtggaaaaaaagagaaagcttgaaaatgggagagaaaagataagaaaattagaagatcagtccaggaagtccaacatgcaaataatagaaattctgcaacaagaaaaaagtaaaagggatggtagaaaattattaacaaaataatacaaaaattgatgtaactgaaggaaattagtttcaagattaaaagttttcctcccggtatccagtataatacttgtaagataattgttacccaagacatactgtgaatgatcagaaatccagttatatagataatattctaaaagcttacagagagaaggaacaaacaacacaaaaaaaattcctgcaaagaatcaagaaccacagtagtgaaagtcttcctaggagcaatactgtaaactagatgactataaaacaatgccttcaaaattcctggggggaaatgattttaatatagaattctataactagccaaactgttgcttaagtgtgaagtttgaacaatgacattttcatatatacaaggtctcaaaaatttttattcacccttacttagtgaacaatagagtataccctttaccaaagttagagagtaacaaagaaacaaggaatcaggcacaggaaagaagtggagggaattcccaggacataactaagcagcagatctaagcaccatctacagattggagttgtgaggttttttgtggttttgggagggggtgtttagatgggatctcactctgctgcccaggctggagtgcagtggtgtaatcttggctcactgcaacctccacctcccaggctcaagtgatcctcccacctcagcctcctgagtagcttcccacctcagcctcctgagtagctgggactacaggtgtgcaccaccacacctggctaatttttgtactttttgtagagatggggtttcaccatgttggtcaggctgatctgaaactcctaagctccagcgatttgcccacctcagcttcccaaagtactgggattatagatgtgagccactgcctggctggagttgttcttttcacaaaggcacagtcctcgctccaggtcatgcctgccctctggattgtgttcaggatggaaactcttttcttattcctctgagtaaagggattgtctttctcatttgtcggtctaactcttaatttgtgttaacagtgcttgagtagattagcagtcaggccgggctgttaaaaaagtcagaataaaatagggattgaaccaaggtagtaataaggtgaataaaagaaagaaacaggttaacaaatggtggggtgcagcagagttccagttgagaggagctgatatctgagtaaatgtggacaataaaggagaagtagatgtctggtgtatctcccaggtttccggcttgagccactggattaatgatagtgtcatcaatgaagataggaacacagtaggaggaggttgttcaaaataaaaatgagttcagttttagacttatatgtaggtggacaaggcttagaactgaagcacaggctagaaattcattcattcaatactcttgtctactaataagaaagagataaataagagccagttacttccctgaaaaagctcatagtctaataggggaaacaaatacataagcaaataatttatatctagtatgataaatttaacagtttaaatatgtataaggcatagtgatatcttagaagagagagtgactttgatatgggcaggaggcagggaaatactgggtagaagagggtggttccccagcaaaggcccccaccccccaagcctggaaacccatggccctaattgggaacaggcatttctgttttcatgtccaaatgttgccttctgcctgccatccccgcatcctgtacccatataaaccccaaattccaggtccacaggcaggagagcagacaaacagaggagcagaagaggagcacagtaaaggagagaagagaaggagtgtttgaacgtcaaggagaggtcggttggggacagctggagaggagattggccatgggacagcagaactccaggggaagatcatcttcccactccatcccctttccagctccccatccatctcactgagagccacctccatcacctaatacaattcccacattcaccatccttcaaatccgtctgtgacctgattcttcctggacacaggaaaagaatctgggtacgaagagggcactgggctggttaatacttaagcaatctgtggaaggcagagctaaaagagcactgtagcatgcccactggggcttcaggagttgcaggcatgtattcctagatgctgctgtggggctggagcccaaaagcgctctccccgccccctacacctgccggtctgcgagctccgcctcctgtaaggggtttgagagtgcagcagccgaacagaacagacaagccacagccctgtcgcaggccctgcccttcgtgggggatcaggggactctcccgtttcaactttcccttagttggagggtgagggtcagtaaatgttcatggacaactaagctgaaaaggaatttgactagcagacaaggcaagagagaatattccagcatgtgcaaggatacaaagccatatactacctattgtattcaaagtaccaaaaatagtttactgttattagtagtacataaagtacaaaggagaaaattaaactggagagttagacaagtctcagatcccaaggaatttgtagtttttgctgaagcagtgagaagccactgaggttgttgaaaaagagtcaaagtagatactggaatccactgttggttgcttccaaaaagaattttggtcctttctagtgcccagaacataatctctttctctggcaaagaaaacgtagtcttctgtcttccttttcctaaagaaggttacaattattttatgaagattgtaattttgagtaatgataatggaataaagaaggagtgaaatggcctttgtgtgctcctcattttttttcttttttaaggcaaaaaggttttaaaaccctctggagcactgattctgaataccttctttttataacattttctaaatgctccctttactatatgaaatgaaattcccataggtattataccctactgcagtgagctgagtaatgcttcccgaaaaggtagccacatcctagtccctgaaacctgtaattgttaccttatatggcaaaaaagaactttgcagatgtgactgagttaagatgttgagatggagagattatcctggtggactctaaattcagtcacatgtatcatggagggaatatcatagaggagatgcaggcaacatgacctctgaggcagagattggaatgacatgaccacaaatcaaggcatgccagcagctaccagagactgcaagaggcaaggaatggattctttctagagctttcagaagagtggccctgtggacaccttgatttagacatcgtgaaactggttttggatttctggactttagaactgagaaagaataaatttctgttgttttaagccatgaagtttgtgataatttcttacagcagccttaggaaactaatacactacttacataatataatgccataacaatgaaataaagaagacacaaaaagtaaatgttagtgatgtgactttccatttaggaaacaattttttgcaaagttccaaacaaaacaaattatagtcttttctgcatttacatggtaattgtatttctggaaaatttaatatatattcaaaccattaaccaatgtttgtagcatctgccatgtgcttgacacacagagagtatttaataaaagctggatacatgggtgatgaatagatggatgtattaaagctacaaagagagtacataagttccaaaataaacatgcaaggcaaaaattatgtgtagtcaaacgtatctttaaaaattcttgggcaggcccagtggctcacgcctataatcccagcactttgggaggacaaggcaggtggatcacgaggtcaggagttcgtgaccagtagcctgcccaacatggcgaaacccatctctactaaaactacaaaaaattagccgggcgtgatggcgggcgcctgtaatcccagctactcgggagcccgagtcaggagaatcgcttgaacccgagatgcagaggttgcaataagctgagattgccaccactgcattccagcctgggcgacaagagtgaaactccacttccaagggaaaaaaaaaattctttacatagcttatcaaatacagtgttcaatatctacatgacgtactggacactgacacataccatttctcaataaagagctgacagccctctctccccattccctcagcatcgtttgggtatcttatgaaggacatgagttgttttagggatgtaatgaattccattcagcactatgaggtactctcaccgacaatcacagaagaattaaaactgactgaaaggcaatagatatgtttcccatttcaaagctcactgtggacattttcttatggtttggaatggttgtgagctgtccaaactatattttgatgtgtttttcttcttttgatcagggatcatagttcagtaaacccacagttaaactaagtgggctgatcgtatgggtctatctaaagtgaatttgtgtacttgtctcatccttcttattaatgagtggttctaaactggacttggtttttctcccatggggcatttggcaatgtctggaggcatttctgattgtcacagccggggattggggagggcagggtgaggcaaggggctattggcaggtagtgggtaaaggccaggaatgatgctaaacattctgcaatacacaggacagcccccaacaacaaataatgatctgggcccaaaagtagtggcaaggttgagaaaccctggcaacattatgtgtgtgctccccttgtgtagtgattcctttgtagtgtttgccttgacattagattaagtgttcccttaagcagaagctgaattttttgttattgagttgcagtgaaggatgggtgtgaatctctgcagggttaaacatttttacattaacctttcctttttatttttatcaaaagtaatatatggttacatgtatgtgtgcatgtgtgcacacacttatgcagaacttagaacagttccccacccattcttccctagttttatcgcatttcccagagttagcaacatgtaaagagttttgtttttaatttttttggtgattgcctctctaagtctaaataatagcttttggttatctattgatttaagagattatctattgactcttcactgcagaaggttagcaaaagctcagctacactaatccctccccttcttccttctaatattcattagtttatattcgattgtcctttcattgattattttgtaattctaaattaaatacatataaacatttaattttgttccatcaactttagtcagtatctttttatcttctgcctttattatactagcgcttctgttctttcaccttccttattcctatttcctatagtctgtctgctgtacctttacattgtcagattgacaatatttactttctgttttataattatatttgtttgtttttatccataggttgaagccaaaagttgaaaactattaccatttataggatataactgtaaatattgttcactgaagagctaagtagtatactgagatcccagaatcatctctatatatgcaatatcacatcctctgtgccatgagaaagaatgttcctagtattctagcattctgttttctgtgttgagtgttttaaaatcatgccacattcagttggcacactggcatctaaacacatactaagaaagatcagaagtgtcaatgaaattgcatagtgaatattcaaaaaatgaatgacctgcatgggcaaataatacaaaaaaaaaagatcagaggaaaatgatagaaaacacaagaaagacaagaatttcaaaataataagggtacattcccaatggccagctttctgagagttgaactgtatttgaataactcatgtccctcaacccagatccaaagataatattgctgctgctgaaacctgggctctttactatgaccagagtttattaattgtcctatttcattgaggaaaaaatgcaaaacagaacactggaatgactagctggaaatattccactatttcatgggaagcaggtttctaaacgattcctgtggaggccaaactcttgctctcgccaaaatattatagcattaaagtgtgccttgatggtacattaaggaagaaattttccccgaatttacttaagatttatagcctttctgctctcacaaaacgtagcattgatttctttaatatcaaaaaaagtttcctaaaataaactgctaatgattgctttcagtcatttgtttacttgaggtcagtcatgccaagtactgtttgtatcaattcttgtaaaagactcaattaattttgtaattgtcataattactgttattcctgttctgtaggaatatgctattaatgtaactggacatcaccacatcttatttttgtatctctcaaaacatctttcataaaactttgatggtaggaaagagctgaaaaaaaatctcctgttagtagaccaagtagtacttcaattactaaacaccagagaaaattaaaattacaccttaaataaaaccaaccagatatttggtagagaaaatggaactgtacaaaaatatggtttttaaaaataaaattctaccacttgtattatattcattatagactattggaaaccgttccctgccaaaaaaagaaagaaaaagaaaaaagtttgtgaccatttgtaattcattttagtctttttatgtatttttttcacctaaaataatatgggcatttaaatattttaaatatagttttaaatggctacatattattctatcaaaaatacctaccataatttatgtaaccactttctcattgttgagcatttaggttagttttgtttttccagttgaaacaataccccctgagtatctttgcatataatgatttctcttgattttagttttaagacaagctcttaggggtcaaatgttttaaatattttaaaggttcattgttcaaattgcatttcaacagtcaataccagtttacactgttttcagcattttaagaaattgcccaaatgacagagcagaattttaaaagtatttccctagtgttgatttggtttatatgctgagatgctgcagattttttgttgttaaaaagtgagtatgtggagatcaaacatttggctgactgtgtacacattttatttagtaaagcctcaatgttaagcaagaagccattactcatattcatgttgtctcaggaatggaaaagtgcttctaatttttgcaacaaaagaagtctgatggcagtgacagaaaggaatgactagctagatatgctgaccggaaagctagaattaggatttgaccattgtagtcagtctccatttaagagcctaatggttttttcttctcaatttggaagtttgctgcatttagagatattcttataaaactaaaaaaaatagacccagggagcaagtttgaggttactaaaatgtatcccattattgtcagagttgcatttcaaactgtcttcattaaactgttagtttgattacattttctcaaacagtaactgttgtgttttaattttttaaattaaaaataagttttaaatttcaggtaattgaaagaccaattctttttggaatctttcagtattatggttttggttcacagcgaaggtatttgcttgctacatttgctaaatatactatctatacttcattttgttgcataaaaataagacatactccggttagcctttttgatgggtattaccttgatgacttgctcactgacagagaaactgatgtaaaataggtcatttgaaaagcaggtgtttgatatatccccatatgtaacactgaaaagccttcttgctctagatttttggaaggaaagctttcttaagaaagaacggaaaagagagaagaaccaaatagacgcaataaaaaatgataaaggggttatcaccactgatcccacagaaatacaaactaccatcagagaatactacaaacacctctacgcaaataaactagaaaatctagaagaaatggataaattccttgacacatacaccctcccaacactaaaccaggaagaagttgaatctctgaatagaccaataacaggctctgaaattgtggcaataatcaatagcttaccaaccaaaaagaatccaggaccagatggattcgcagccgaattctaccagaggtacaaggaggaactggtaccgttccttctgaaactattccaatcaatagaaaaagagggaatcctccctaactcattgtatgaggccagcatcatcctgataccaaagccaggcagagacacaaccaaaaaagagaattttagaccaatatccttgatgaacatggatgcaaaaatcctcaataaaatactggcaaactgaatccagcagcacatcaaaaagcttatccaccatgatcaagtgggcttcatccctaggatgcaaggctggttcaatatacgcaaatcaataaatgtaatccagcatataaacagaaccaaagacaaaaaccacatgtttatctcaatagatgcagaaaaggcctttgacaaagttcagcccattcatgctaaaaacaataaattaggtattgatgggacgtatctccaaattagaagagctatctatgacaaacccacagccaatatcatactgaatgggcaaaaactggaagcattccctttgaaaactggcacaagacagggatgccctctctcaccactcctattcaacatagtgttggaagttctggccagggcaatcatgcaggagaaggaaataaaggatattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaagtacctaggaatccaacttagaagggatgtgaaggacctcttcaaggagaactacaaaccactgcttaatgaaataaaagaagatacaaagaaatggaagaacattccatgctcatgggtaggaagaatcaatatcatgaaaatcgccatactgcccaaggtaatttatagattcaatgccatccccatcaagctaccaatgactttcttcacagagttggaaaaaactaaagttcatatggaaccaaaaaagagcccgcattgccaagtcaatcctaagccaaaagaacaaagctggaggcatcacgctacctgacttcaaactatactacaaggctacagtaaccaaaacagcatggtactggtaccaaaacagagatatagatcaatggaacagaacagagccctcagaaataatgccgcatatctacacctatctgatctttgacaaacctgagaaaaacaagcaatggggaagggattccctatttaataaatggtgctgggaaaactggctagccatatgtagaaagctgaaactggatcccttccttacaccttatacaaaaattaattcaagatggattaaagacttaaacattagatctaaaaccataaaaaccctagaagaaaacttaggcattaccattgaggacataggcatgggcaaggacttcgtgtctaaaacatcaaaagcaatggcaacaaaagccaaaattgacaaatgagatctaattaaactaaagagcttcttcacagcaaaagaaactaccatcagagtgaacaggcaacctacaaaatgggagaaaattttcacaacctactcatctgacaaagggctaatatctagaatctacaatgaactcaaacaaatttacaggaaaaaaacaaccccatcaaaaagtgggcgaaggacatgaacagatacttctcaaaagaagacatttatgcagccaaaaaacacatgaaaaaatgctcaccatcactggccatcagagaaatgcaaatcaaaaccacaatgagataccatctcacaccagttagaatggcagtcattaaaaagtcaggaaacaacaggtgctggagaggatgtggagaaatagaaacacttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacatatgtttattgcggcactattcacaatagcaaagacttggaaccaagccaaatgtccaacaatgatagagtggattaagaaaatgtggcacatatacaccatggaatactatgcagccataaaaaatgatgagttcatgtcctttgtagggacatggatgaaattggaaatcatcattctcagcaaactatcccaaggacaaaaaaccaaacaccacatgttcttactcataggtgggaattgaacaatgagaacacatggacgcaggaaggggaacatcacactctgaggactgttgtggggtgggaggaagggagagggatagcattaggagatatacctaatgctaaatgacgagttaatgggtgcagcacaccagcgtggcacatgtatacatatgtatctaaccttcacattgtgcacatgtaccctaaaactttaataataataaaataaaataaaataaaagaacagaccagatgcagtggctcacaccagtaatcccagcactttgtgaggccaaggtaggaggatggcttgagtccaagagtttgagattaacctgggcaacatagtgaaaccctgcctatacaaaaagtaaaaaatgaaaagttagcctgggcctggtgtatttgcatgtgcctgtggtcccagcaactccaggggctgaggcaggaggattgcttgagcccagtagttcaaggctgcagtgagctgtgattgtgccagtgcactctagcttgggttacagagtaagaccctgtctcaaaaaaataagaatgtacatatttaattgtaatatgaaacggatgctgaaaatgaacaccgatataagtgacatatcagagatgctctggagacttggttcatataatatggaacaaaattaccttctcaatgccaaattagaaaatgatatgtacataattttcaggtttaaaatatatataccaaggctttgggatgttaaatataaggaatgttgcccatgtataacattatcaattaagcttaagaatattaaagatttgttgattaaaataattactaatttttgtgatagcttttactttagaatatgtgatttgaaaaaaaagaatgttgacatttcacatagttggaaaaaattctagttcttagttttgtaacttaattttatgttctaaaatatgtctcaaatccacccttgtaaaattattagtcttttattattaaagcataaagtttgctactcataaatcaaattatatatctcaaattcaaagctaaattgcccttgtgcattgtttagcagtatgtaaatacattttagaaaagggctgtatcattcatgaagtttccaaattcgttgatcaattctgataataaagttaaaatttttgttcttaattagtagatctcattattttttcagcattccactgacttctttctaactttgtagtaatgataggtaaagactgtatctggcttaaaaaatgcttatttttacatacatgtaggtctttgattatgaaagtaccgaggagttcttttgtttatacagtggcagttgaaagaaaacccatgtatatcttgagaagatttattggaactagctttgagaaatgatgagccatatctttaactcaataaaagatatgtattgctgtaccaagccttggtatctgctattctctttagtgtaagcacttttcaaactataggattatacaaatagtagcatcactagttaaaacataaagctatatgatctaaagacatagttttggttattttttgagccatttaattttcatcttttctgtgaccacatttattaaacatgtgacatgaaaatggaatactcttttatgatgacaaaagaaagtatatgcccagccaattatgggataagagtattattttttgtgaacacattatcatcattctagacacctggagaagtgaatatctctgaaagtatcatacatttatactttaactttatttacatatccagttttcagaaaccattgccaatgaaacatttggacaatgtggtatgcaagtactgtatagtaagaagtagggatgttcttgagtaattgttccatttgaattaatccagcatgggtagttgttagacaaccatgaaatgtgctaagctttacctattctaagaggactctattcttacagaccataagcgttcaaaagttttccaagaaaaaaaggttacttctttaaatttagtctgcccattcaaaagctacaataaggcaggtggattaaactgctaggagttgcaatgttagtattgagagcatttaagcaatttaaaatctttcagaatgcctaagatcacaaatttacccctgatcagcctacacagattaacttaaaatacatacagagagatgtcagatagctagagggtcataaattagtgaccaaaattacatcaatctgcatgttgacattgtttaccttatattgattagaaacttttgcttaggaaaaaggggaaataacttttattttaaattatactttaagttctagggtacatgtacacaacgtgcaggtttgttacatatggatacatgtgccatgttggcgtgccgcacccattaactcatcatttagcattaggtatatctcctaatgctatccctccccctcccccaccccacagcagggatgtgtgatattccccttcctgtgcccatgtgttctcattgttcaactcccacctatgagtgagaacatgtggtgtttggttttttgtccttgggatagtttgctgagaatgatggtttccaatttcatccatgtccctacaaaggacatgcactcatcattttttatggctgcatagtattccatggtgtatatgtgccacattttcttaatccagtctatcattgttggacatttaggttggttccaagtctttgctattgtgaatagtgccacagtaaacatacgtgtgcctttgtctttatagaagcatgatttatgttcctttgggtatatacccagtaatgggatggctgggtcaaatggtatttctagttctagatccctgaggaatcaccacactgacttccacaatggttgaactagtttacagtcccaccaacagtgtaaaagtgttcctatttttccacatcctctccagcacctgttgtttcctaactttttaatgattgccattctaactggtgtgagatggtatctcactgtggttttgatttgcatttctctgatggccagtgatgatgagcattttttcatgtgttttttggctgcataaatgtcttcttttgagaagtgtctgttcatatccttcgcccacttgttgatgcggttgtttttttcttgtaaatttgtttgagttcattgtagattctggatattagccctttgtcagaagagtaggttgcaaaaattttctcccattttgtaggttgcctgttcactctgatggtagtttcttttgctgtgcagaagctctttagtttaattagatcccatttgtcaattttggcttttgctgccattgcttttggtgttttagacacgaagtccttaacagcccatgcctatgtcctgaatggtattgcctaggttttcttctatggtttttatggttttaggtctaacatttaagtctttaatccatcttgaattaatttttgtataaagcgtaaggaagggatccaagttcacctttctacatatggctagccagttttcccagcaccatttattaaatagggaatcctttccccatttcctgtttttctcaggtttgtcaaagttcagatagttgtagatatgcgacattatttctgagggctctgttgtgttccattggtatatatatctgttttggtaccagtaccgtgctgttttggttactgtagcctcgtagtatagtttgaagtcaggtagcgtgatgcctccagctttgttcttttggcttaggattgatttggcaatgcgggctctttttcagttccatatgaactttaaagtagttttttccaattctgtgaagaaagtcattggtagctcgttggggatggcattgaatctataaattaccttgggcagtatggccattttcacgacattgattcttcctacccatgcgcatggaatgttcttccatttgtttgtatcttcttttatttcattgagcagtggtttgtagttcttgaagaggtccttcacatcccttctaagttggattcctaggtattttattctctttgaagcaatggtcaatgggaattcactcatgatttggctctctgtttgtctgttattggtatataggaatgcatgtgatttttacacattgattttgtatcctgagactttgctgaagttgcctatcagcttaaggagattttgggccgagatggtggggttttcgagatatacaatcatgtcatctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaatgggctgttgaattttgccaaaggccttttctgcatctattgagataatcatgtggtttttgtctttggctctgtttatatgctggattacatttattgatttgcgtatgttgaaccagccttccatcccagggatgaagccgacttgattatggtggataagctttttgatgtgctgctggattcagtttgccagtattttattgaggatttttgcatcgatgttcatcagggatattggtctaaaattctctttttttggttgtgtctctgccagactttggtatcaggataatgctggcctcatacaatgagttagggaggattccctctttttctattgattggaatagtttcagaaggaatggtaccagctcctccttgtacctctggtaaaattcggctgtgattgcatctggtcctggactttttttggttggtaggctattaattattgcctcaatttcagagcctgttattggtctattcagagattcaacttcttcctggtttagtgttgggagggtgtatgtgtcaaggaatttatccatttcttctagattttctagtttatttgcatagaggtgtttatagtattctctgattgtagtttgtatttctgtgggatcggtggtgatatcccctttatcattttttattgcatctatttgattcttctctcttttcttctgtattagtcttgctagcggtctatcaattttgttgatctgttcaaaaaagcagcttctggattcattgatttttttgcagggttttttgtgtctctatttccttcagttctgctctgatcttagttatttcttgccttctgctagcttttgaatgtgtttgctcttgcttctctagttcttttattgtgatgttagggtgtcaattttagatctttcctgctttctcttgtgggcattttgtcctataaagttccctctacacactgctttgaatgtgtcccagagattctggtatgttgtgtctttgttcttgttgatttgaaagaatgtctttatttctgccttcatttcattatttacccagtagtcattcaggagcaggttgttcagttgccatgtagttgagcggtgttgagttagtttcttaatcctgagttctagtttgattgcactgtggtctgagagacagtttgttatcatttctgctcttttacatttgctgaagagtgctttacttccaactatgtggtcagttttggaataggtgtggtgtggtgctgaaaagaatgtgtattctgttgatttgggttggagagttctgtagatgtctattaggtccacttggtgcagagctgagttcaattcctggagatccttgttaactttctgtctcgtggatctgtctaatgttaacagtggggtgttaaagtctcccattattattgtgtgggagtctaagtctctttgtaggtctctaaggacttgctttatgaatctgggtgctcctgtattgggtgcatatatatttaggatagttagctcttcttgttgaattgatccctttaccattatgtaatggccttctttgtctctttttatctttgttggtttaaagtctattttatcagagactaggattgcaacccctgcctttttttgttttccgtttgcttggtagatcttcctccatccctttattttgagcctatgtgtgtctctgcacatgagatgggtctgctgaatacagcacactgatgggtcttgactctttatccaatttgccagtctgtgtcttttaattggagtatttagcccatatacatttaaggttagtattgttatgtgtgaatttgatcctgtcgttatgatgttagctggttattttgctcgttagttgatgcagtttcttcctagccttgatggtcttcacaatttggcatgtttttgcagtgactggtactggttgttcctttccatgtttagtgcttccttcaggagctcttgtagggcgggtctggtgatgacaaaatctctcagcatttgcttgtctgtaaaggattttatttctccttcacttatgaagcttagtttggctggatattaaattctgggttgaaaattcttttctttaagaatgttgaatattggcccccaatgtcttctggcttgtgaagtttctgccaagagatcagctgttagtctgatgggcttcccattgtgggtaacccgactttctctctggctgcccttaacattttttccttcatttcaactttggtgaatctgacaattatatgttttggagttgctcttctcgtggagtatgttagtggcgttctctgtatttcctgaatgtgaatgttggcctgccttgctaggctggggaagttctcctggataatatgctgcagagtgttttccaacttagttccattctccctatcactttcaggtacaccaatcagacgtagatttggtcttttcacatagtcccatatttcttggaggctttgttcatttctttttattcttttttctctaaacttctcttctcgcttcatttcattcatttgatctttcatcactgatagcctttcttccagttgattgaatcggctactgaggcttgtgcattcatcacgtagttctcgtgccgtggttttcagctccatcaggtcctttagggacttctctgcattggttattctagttagccattcgtctaattttttttcaaggtttttaacttctttgccatgggttcgaacttcctcctttagcttggagtagtttgatcttctgaagccttcttctctcaactcgtcaaagtcattctccatccagctttgttccattgatggtgaggagctgctttcctttggaggaacagaggtgctctgatttttagagtttccagtttttctgctctgttttttccccatctttgttgttttatctacctttggtctttgatgatggtgacgtacaggtggggttttggtgtggatgtcctttctgtttgttagttttccttctaacagttaggaccctcagctgcaggtctgttggagtttactggaagtccactccagaccctttttgtctgggtatcagcagcagaggctgcagaacagcggatattggtgaacagcaaatgttgctgcctgatcgttcctctggaagttttgtctcagaggagtacccggccgtgtgaggtgtcagtctgcccctacaggggggtgcctcccagttaggctcctcgggggtcagggacccacttgaggaggcattctgtcccttctcagatctccagctgcgtgctgggagaaccactactctcatcaaagctgtcagacagagacatttaagtctggacaggtttctctgccttttgtttggctatgccctgcccctagaggtggagtctacagaggcacgcagggctccttgagctgtggtgggctccacccagttcgagcttccagtccactttctttacctattgaagcctcggcaatggcagcgcccatcccccagcctcgctgcagccttgcagtttgatctcagactgctgtgctagcaatgagcgaggctccgtgggcataggaccctccgagccaggtgcgggatataatctcctggtgtaccatttgctaagaccattggaaaagcgcagtattagggtgggagtgacccgattttccaggtgccggctgtcatccctttctttgactaggaaagggaattccctgaccccttgcacttcccaggtgaggtgatgcctcaccctgcttcggctcatgctcggttcactgcacccactgtcctgcacccactgtccaacactccccagtgagatgaacccggtacctcagttggaaatgcagaaatcacccatcttctgtgtccggaaataacttttaatatgtacagcttgagagaaagaatctttcagaaatgagatagagaaacataataaaagaatccttggtgattttcttaaaaagtaaaaaccgtcactactgagaaaaagacatgttttacaaagacatctgaaaatcataggtattgtggcttatgttttgggatggaaatgaaagatttgatgaaaattaccagagatttttacataaaacagctgattaaagccaaccatcctttttagtgttgcctttatttgaggatgttagggagaattttctcattttgtgtttagtcctgattggcctggatcataagaattatactgtatttagtttgtagtaggacctgctcttctctttaggacctgacacataaatagttttgtgtaaaagtgaacattgtaatttctcttaacagctgtaacatcttatgaagatcttggactctttgcatttggattacctggaaaggtaattttttttcctcctcattgtgtccaaaacccaaagtggcatttttccttttgtttcaagttaaaagagacaagtatatacaagaggaagacattagaggaataaaaggaaactaaagtgagaaaagagagaatgataggagcaggcaaagaaagagaagtctttgtgtccttcctaaaaatgcatcaatacatttaattcaatgcttgaatcttttaatatttttcatcctaataaagtagcacaatgacttgaatgactttaaaagagtaacgatgacctgttttaagttgtattaattttgattatgtactcatatgagtaaaccctcataaagacaagaaaagaaaagcaacatcgaattcaaattgtagcatggctatttacaaaaccagtaatcagaagatcatatcacttaagaattgaacattgctacaagattatctagctatcctctcatttataggtgaggaaattaaggaccagagaaattaagggacctatttgtcaactattatataaagccagtaccacatcctagaactctagatctactgcttttcttactcagaataagagaaataacagcagtatttatggggcacccacttgcaatagggatactacactagtttaataggtagagaaaaataattgtcttccaccagtaatcaggagttgaacgttactgttagtgctatagtatatatattttttaatttctgaagaactactatacttctaaaattcatattcattttggctccaaacaggaattcttttgtttgtaaatctgttgtttgtgtttttatgttttcgattgacaaatacaaattgtatatatttattatggacaacatgtcattttgaaatatgtaaacattgtagaatggctaaattgacctaattaatatttgcattacttcacatacttaccattttttgttttatttttattctaaaaggatactctatctgtaactggctaaactaacttctgaaagtgagtctggaggaaatatatatagctatacaatggaaagaaaacctgtatttacattccagttaactttggtggagttttttgtttttgttttttcagacagagtttcgctcttgttgcccaggctggagtgaaatggcatgatctcagctcaccacaacctccgcctccctggttcaagcgattctcctgcctcagcctcctaagtagctaggattacaggcatgtgtcaccaggcctggctaattttgtatttttagtagagacagatttctctatgttggtcaggctggtctgggcctcccgacctcaggtgatccacctgcctcggcctcccaacgtgctgggattacagcgttagccaccgcgcccggccctaactttgtttttaaagtacaaaaaggaatgcttaaatcatatactatatagcatcatggcttggaccttagtcacctgaaacttaaacaaaacagaatatgttacttgagggtaaaaggttttgttaatcttccttagtagcaatgtttctgttctagaggattaggatgtttggtgtagccagggatcagtttcctccatctagtttaaacaaagaagaaaatattttttgtatgagaaaattccacaattaatataacataacctataaacataactctaagtatcaacactgacatcactgtcatttcatgttcatatttcctgcgttgcttgtatagcagcaaagtttaaagagtagggactgctgagagtcttcttttcctaaacctcttagagtagttgtgttgtcattttaatacatgcaccaaaaaagttcatagtaggcaggaacactagacaaagcatactctgaatgaggagttgttgtttggttgcttgtttaaattttctccacacttccacagttgggttgaaacttaaccatttccttctatccagatgttatatagttataatatgggataatattatgataaagaaattttttgaaatgttttgaacttgttaaagatttatttcaatgtctataaattggtatttattcaccagacaaatatttattgatcaaatactttgtaccatgtactgtgctaggcattaaaaatataagtaggtaggcaggtgggtagatagatagatattctagctttcaagatattaaatgcttaaattcagccaaagaatgaaagaataatcatcaataagttaatattactgttttttgcaatatattaattgaaaataaaaccaaatttcatgtatacctactactgacagtaggtatcatttgtactgaagatagtatacacaagttcaaaatagtcttttcacaaataacttcgacattttggaactaagttttacataggctgaaatgcagaattttttctggagagcgttcaagtggcaatcaccacatctccaaagacactttgccagattttcatatcattagccctcctctgcaaacctcaaggctcctaggtcctaataacttagattgttttcagtgtaggcaaatgctgtgccactgatagaattcctaacaaagatgggcatgaaagattatctgttcccaattcatgtagaactgaatgattctagacagctagtcagctccaggcatacgttggggttccgatccattaagacttgagtgattgaaaggcccacatggaagcacagtgttttactgtttcctctaagcatatctgattaccttgagttccccaggaatctcatcaaagatgataagctaacaagcctacagactgaatttagtcctcaggcacattttatatggctcaaatattttttatttttaactgattaccaactaagcatcattaaagtatgaaaaaatttcatttctgactttctttgaaaaatcagatctggctacattggatccacattctcacatattatcaactggccagagctgagtagcacctgccccattgaagggggaggaattctccaatatcctacagttcttgccaactcccattgtcttatattcagcttaattcacattattgagtttggaacattttgcctatattttcagggtttgagagtaattgggctctagactttattaatctctgggactgggatgctcaaagtctgggatgctgatatagtcagaaaacttatatcatttccttttaggcaatatagcattggcatagcacacccagccggtctttttctacttatttaagcagtgtgataaaaccagcaagaagggaatgagacaccactcccacacttttaatttttatacttgataatcatcgattactagcttttaacacttttaacaatttaaaagtgactgccaagaaaaatttcaaaaacttctttatagtaactttggaactattaaagaaatactttttaatgtgatgattattaattttatgtatttcaaatgactggcagatttctttttagtttctcctcacaacttctgcatctgcttttttagtaatagttactggattttaataaaatactgatccttttatattgtttccccttctatcttctgaatatttctgttcttttacagttggtggtggcaggcaccataataattcagaatattggaggtaagcaattgcaagtgcactgtttatacataaatgtgatggcaataatgtcctttgaattgttatcttactacagatctagctgggaacttctgtagacatagctatcttcagaagcctgtgtgttggcctctttactctttttttttttggatcctttttagcagcacttgtgacagtagcttctaaattcagtttgagctaaaccctgattgcagtcgtgttattaggtctgcaacacacctctaaaacattggctttctgtgattctgaaggtaggatacagtctggaaaagctctcctggtgattttaaaatattttccctctacttttgttctaatcaccctattggcagatactactttagagggattagtgttccgtgggctgtgaacaagcaagtatggacaacagtgtcctcttgtaaccaagaatttaaaatgaccaagtggtttaaaacataaataaatctgagataaataagcattctcacatttatcctgtatcttgttcctattaataaccaattctagaaatgatctcaatattgagaactatgtagaaataaaactactgttaattatagacagttactgagtaaatgtattaaacatttaaatccaaaatatgggtatcatgtgtgtatatgttgtaaagaagttgcgtagtgctgaacaatatcttcgttttcttttatcattgactggagtgctaaataaatgctcttaaaggaaaatacacagaaaagtttgacatgtactttggatcttatacaggattgtatagtcagaggacattttaatcttattttttacatgtaacagtttaattcaaagatgacagttttaataaacttcagctctcataatcaagaggtctgagctatatcactttaagtattgttcaatcaaattccatcgttaataggtttttttggttaaggaaaaattgacattccaccagtgaattgtgctgccattgttttagaatcctgttttaattctttgaattttcatgaaaaaatatgaataaaaagaatgctttcttgcatgccataccaaataattttctcctaacacacactacttcacacttcacagtagaaagtcaagaaaaccagtctcttcatttatgaatttattatagtcattgattttaagatctattttggaataatttatttagcaactaagtattgcttaactgtgcactgataatgtttctgaatatgatgtatatttttatatttttaatccctctttatcctctctgtatagattctaagaactatcacatattgtttaggttagattgaaccattgtttaacagtttatgtagactgttcagttcagcaatttagatccaaatttgtgaccctggcacaaggcccactgttgtattctttgtccctttcaccttgattccttccttgttctctaatcttgtttataactgttattggagatggctatactgtagcacttggctgctactagatttaacttctctgtatgtatgctcctgtaccccactatattgttaagttcctttagctcaaaagtatgcctcatttctctttgtactcccagcacctattacacctgggaattgataaacttgttgagcagaatagagctgaaatgatttgtataatctctttctaagtaccttaaatattctagatatatttatcaagaagagaaaagggaaatgctagaccggcatctagcttcaggtatttgaaagactgaacatgaaatataaaaaagacactagactaattcaagtattgttccagagggcagaactggtgctaatgtatagaaatctacagagaagctgttttgggttttcttattcggagtacccttgtaactaagctgtgtgataatgaggatggcctacatccctttgaaaatgctccttagccctgaaaacattcaaacagagctggttggtcagttgccagaattctagaaaggattcttgcatttggaggtggataaatcatgagttttcccaactcttaattttgttggtttgcttgcttgcttattttagaacttttttttaaaaaggtgatttagagtggtcacagcagtttttaatgtcccttaaatttagaaaagctagtaatgcttatttagtttttagaatgatatcctcatgattttcttcacattggttaaaagtgtattaagtgcccagtcagtaataaccaaatacatattttcagagttttttctgtcttttttcgtagccagatgtacataaaccatttctttattataatagaattggaagcttgctcttgtgagcagaacactagattggaagtcagataccttgaattctgtctactccagtctctgccattgggtagccatgtgtcttgtggaaatccctcactctcactgtcttggcttcagttccctctttgttaaattgttggacggtagagtgggaagcagggagtttaaggtcccttcttaccccaaaatttgaattcaaatttggcacattgggaggcatattaattattttaacgtattaacgtattttattacaggaaagttcaatgcgagggttatacttggttcaaaagatgatttggccctttcttaggtatctttaacaaatcaataactattgccctaaaagcattcatggatgctattttttgtcactaagcaaaagggaacttcagttcttaggactaccctttagaacctcctcttaggttaaagtctaggaaccctagccttaaaaagtagtttcttgattgatatatacagaatctgtggaacttctagtccatgtatgcttgcaaacaacatacttatttgggaggatatttaatatactgtgtcattatattaaataagtatatatatatatatacagttttattataataaataagttaatcgtacaatgaccaatgttacttcattaaaatggattttgattattttctttattaattggaaatatattggatatttaaaagattatattaagtgtaaatcagattgaatttttacacatcttaagtgcctgtctgcaaataatgtagttcagataacttttttttaaaagaatgtttgttagtataaattatctgacttttgcagtggttgtttacattaaaactgaaaaataatgtaatagattctatttaggtcaagcactctactagatactttaattataacaactcttcaatatagatattatcttcattttatagagaagagatcagtgtgcagtggagataagtagcttgctcacatttatcccataatgaagcttggattcaaaccttgctcagttggcctttattctttctgctatgatatagcaaatgtttgaaaaatgtgaaaagattaaatgttgaagattttctaacttcttggggacaggaactatgtgtttttatttgttttcctaactttacctagtttctgagaagagctcaataagtagtatttgttgaatgaattggacagtttttaaagttctgcttaaaagcctaagattttgcctcaaagagacaattgaatatactatgtaagtgataaaaaaagaaacttgaaagaccatagaatgacttctagtttagaattatataaaaatttaaaagttcaaaatactggggagagttagatctcatttatgtaaaatgggttaacaatatattgaaataggctgggtgtggaggcccacgcctgtaagcctagcactttgggaggccaaagtgggaggattgcctgagctcaggagtttgagaccagcctgggcaacatggtgaaacccagtctctactaaaaatacaaaaaattagccaggcttggggttgtgtgcctgtaagtcccagctactcaggtggctgaggcaggaaaatcgtttaaacccggtagacggaggttgcagtaagccaagatctcgccactgaactccaacctgggcaactgtctcaaaaataataataataataataataataatatatatatatacacacacacacacacacatatatgtaaaatatctattattttcaggttaagaaaatcatatcttaatgtttcttaactctcttattctttgtaacatttaaatacttctcagttttcatgagatacaattcctgtggtgaatccatgaaaaaaattgaaatggaaggcctttaaaagcaaaatgaccatggattgcccttgatcaatatttgtttcatgtgtctttcgccaaagacccagtttatttcccacatttccatattccataaatcaaattaatgtgctcatttatttacatccctagtacttagcacatagtatacatttagtaaataacatttattataggaagaaagaaaggactaagaggggagagggggaaaagctagtgacctggcttagtactccttcaagagcaaaaagagagttgattgaccaggaagagaaagcccagtatatgtaagtgagcatatagtttttaggaaagcgtctactgttagaacttcacagaaaatcgtttttctcccccaagattaatcaggcaccaagtattagtcacaaggctctagtgtggtctgacaaattgattgaaaaaatctactgtctgtaaatctctaaattttataatggaaaaaaatgcaacacactagatttaacactcttattctaaggttatagaaatccttggctttggaaatttgggaaccatatagtaaattactacttaaaagcaattcctgatatcttcccaatactaatgaataacaggctcaacattggctagagccagaggtaaccctctgcagcccatttcctcaggtgctggagtagcatttgttgagagccactgctactgggacccaaagtcagaaaagatgtgtctggaagttttaacatttaatgctgttataggggacaattctggcttagagagtttgaatttggcagcctaactaaagataaaagattaataactgtagtagaaagtaagtataaggtagttttcacatagttcctgtaacagtgttgtattatgtgattcttttcttaaaaactaaggtaagtagttggtttcacattcatttgaactcctgaagtaaaccattcagtaggctagaattatcactagaaatcaaacactacatcccaatcatcttcttagtcaagccagaaaaagtcttattaactcttacaagcacatgataacagtgaagtcaattgatgttatttctggtttcacaacttgcccaattcaaaatgtggaaagatgagtagctcctagggggatgttatattcttattttgctcttataaatatgaaggattactatgaatagcatatgctttccttaattcttcaaagccccagttctttaaaggagattaaaaatttaatcattactacgttttgtgaaaggaaaaccataaacattagtagtcttactgaaacctcctgaaattgctagaatgacccagatgtttcagtctggcacagaatccacacaccttactcttgcagcctttattaacacctcagtttggtaatctatggactcgggtaaccccatttctaaatctcagaaaggtataaataagatcattttcaattgagaattataaaaatctcaaattctcagtatttgaaaaattcacaatattagatgctagaaactacttggatttgctttcttcctgtatattcattcatgcattttatttatttactttttggtaggctagtaaagtactaagagtgtttcagatatactagtttgtattgtctcttgggaaactaggattgggcgcgcagatacatcgccatctgctggtcagtttatctgtggtgaaactgcagctttcttgagacttgtctagaaattctagaaagcactgccttagaataggagaggtacaggaaatttggagagtctttttcacaagcacttcatttgacaacatttactggtagtgtatcttttttaaggttttgaaaatatttttcatagtaatttctattgaaaattataaaattttcagaacagtagatattttggtcattttttaatcaaatttaagatcctgaaaatgataagacaaagatatacatttttttctagggtcatgggggagcattttcccccatatattttgattttcatttatgcatgtgttctgtactatttgagtgcatatagaacttcagtggcatttagatattttgtgggaccaccagattaatgagacacattgaatagaataaaccagttagtatccatgactaaaaacatgtttgaaataaaattgaatctctctgagacagaaaggcaaacttattttttccccgtagcacatccgtttgtttagggctgagtaatcctttaagaattgctgaacttcccccaagtgctgaaaacctaattctgttttaaaaatagctgtaagtaattctgtcctcatacatatattttacatgtttaacaaaaaagattcttatcttcataaactgtaatgatgtcttaggcccaaactccaattagggttggtttgttttttttaagtttgtatgcttaataacgacaacttgggaagcattttcagagtgctgcgaaaaataactcataagaatacagtatttggaagcacagagactgatttttattttttggatttcagtggagtgttaatatttcaaatacgtgagaataggaaacttcctcttcagaactacaatcacagccgtaaatacagtagagtcatagcagtagatgcaatagaatctcatcatgaaactccatgaattttgaactaatcacatcaccaaaggagctccaatactgaaaaatgaaatacattgaaaatatatctcaagatgaaatgaaaattctaagtgttactaaagcttctgactaatgttctctgtgatattcatttcctttgaagtcaactgttaatctcagcattcaaaagtagtttgtttaaatactgatttaaaaaagaaaaataattctgaagagtggtacttctggtagactttccttatttgtctttgttttgttggtttactttttcactttgctcctgcactttctcatggcatactagttaatagaacgagtttctcaacccaggcgggctgtttgcaccatcactagcttgggcaagttacttctttgtgcttccttatattctgtgaaataagtaatatgtacctcacaggtttgtgtaaagattaagtgaggaaataacttgtgtagaatactaccaagcatacagtaggcatctaaaaaacaaagatgttagctgttttcatggatctctgcccagagtcccttccctgtttctgtgtttctaacatctctcctctcaacctcccgggcccaattcatttatttcactttataattagatcagcagatattaacaccttgcaacttgctattacctaatcagattttaccccattttagtcactttttaatattactgttgcttctccatgttgtttttaaagagtgctttcaacttctgtgttttcagttgacagatgttttattttttcccagagaagtttctattaaatgagttatattagtttaaaattaagtagaaaagaatacctatttagttaatgtgctaaaactaagtgatttataatggctgaatacctgacatcaaggtatatcttctggcactgattttggctttggtggtttggggccacttaactatatgcatggctcttgtggatgacccagttgcagctattaatttagagtagaacatggtgtgtcttgttttaggaatctatactaggtgtccatgtcacccaaaatcatttgcaaatttttgcttatgattggtctgtaagataagtgcttaaacactttcttatgccatttataaaagacataagacaaaaactgtggcagacagctatttgatctagtaaaccttttagttaaaaacaaaggcaatatgagcattcctatcaatagtatatctttaaaacttttccagttcattttattgagctgattgttcttttgtatgaatttaattaagatatatttcctaacttaatgtgtatttggtaatctttttgtttcttttctgtattatatataatataatgtgttaaagtgctagctagttcttacatgaaagtttacttgtgattaagaaaaaaataattttcatagtgaatagaatggtggtggcctttgttttactggcttaatccgtgtgggttttcccctatagtaagttctgtggttgtatactcttaaaatatatactaacattctctagaaaagaagcaatgttttgcatgttttattatatttgtatcttgtatgtgaggtcttctttgagagagaaacacgtttggtgagttcatatttcttaaaatatacatgattcttcagactggaatctaatgaaatagtactcccatttgaaaaccaaagagttgagggtacaacaaaggataaaagtgatcagatgattagccaggggctaatagaaattctggaaagaatgacagatattatattagaaagaaataggatctcatattcactgaagctttctacagctaaaggtccaaaagaaataatagaaaattactgaaagagatgaatgtctgaaactttagaaatgcatgtggtgttggattaatccaagcaagaaagaaagatgggcagataataaattacattttataggaagtctgctttccttgttttcaaagtattttgtcttttttcttttctgtctctctcacaagatatatttaagtaagtctaggccggtttcagaaaattcagttcacaatttttatctttgcaccatatgtgtagagttctttggaatcggtaaaatattataaaaactccaaatccttgaatggagaaggttagtctaaaccttccttctgttctgtgccaaattgatagcatttttccttacgagaatatgaacaatacagaacacattttcacatacaatcagttgtaataccccataactaaaagattttgcagaaatgtctcagtggattttagtcaacccactgagacatagctgtacttctgctagggaaaaagaaatcgttgtaaactgaaaaaatatgtatatgtatattttcatcacagagaagtgattatttaactgttctaaattttactttgacataaatacatgttattttactaaaaaaaattgagagtgtatgtttttgtgtctatagtattatctatctccatacaaatttacacgcaaagtagcatgtatcctttttttcctcaagttaaatggtcacatagcattgtaatcatgaagttcagctcctttcaaatgatgttgattgagaaatatacattcttcttaaactatttgagccttttaatcaatttttccccagatttttgccattgaaacttgactttcatttttgttcttagcttttgtaagttttgtaaggagaaagtgaaatgtttcctgatatataaataagtaataaaattaatgtgcacacaaagtatactctttattcttttttttttttttttttgaggtggaattttgctctttcacccaggctgaagtgcagtggtgcagtctcggctcactgcaacctccgccttccagtttcaagcgattctcctgcctcagcctcccaggttagctggtattgcaggcaactgccaccacgcctggctaatttttgtattttcagtagagacaggatttcaccatgttggccaggctggtctcgaactcctgacctcgtcaaccgcccgccttggcctcccaaacactctttgttcttcatgggcgtttcctttttggccccaacacatacacacaaacataatctctgggaggaaagagaatcttactctgttaaattgaagttctgactacaaatcttctgagtttctatatatttaagcttaaactcaagtatttacatatgaatgagttctgtattctgtaaccatattaaaacttttcctagtatttttatagaatttgtttttatagctacatcagaattaggatcgttattaaagtgctataaaaggtagttatttatcggactctgttagattaaatgtgagaaataatgctagcttcaggttatgattacataatatagatgaaccctgttaataaaatggaataaaagttggaagttttgtctttttaatatatttaatggtttatattgaactttctctaatctttttagagactaattttaaatgtaattcattatgtattcttttttatcctataattatatgtgttcataatgcaggggtgggtagtagagagaggaaaagaaagggacagagggaatgagacttctctgttgtggggaggcatctttctctagtaagaaggaacagataatccagttactagccatacctattaaacttctgtgtctatgtctgttgttgctaaactaacctctaatgccttagacggagtgataacatataagagagtttttgtaaaactttgtacaaaatttcatttaaaagtagcctgtaatcaagactgtttctcttacctagtttgctttggacttgaaatgtaaacaaaagatacttaatgaacttaacaattgttattcttctctacagttacttttctgtgtgtgtgtgtgtgtgtgtgtgtgtgtgtgtgtgtatgtatctttggtatagtgtgttatatgttaatcttccatatgttgtcatagctctaatggacatctcttttcctagatggattattgtttaaatggttaagaatcatagaattctaataggaacactatttattcttttgcagctatgtcatcttatcttttaattattaaaacagagcttcctgctgctattgcagaatttttgactggagactatagtaggtaagaaaaagtattttacattgtgtccgttcatgtattaatttgataaatatgtattaagctgtaaatggcaatacttgtagtggcaggtaaaataaatgtagtccttgccctcaagacagttacaaattaggcagaagtgaagcagtaatagaatagaaactactcagccaatgtttgattacccatatgaaagcgctgttctgtgaaccatatgaagcaccagatataatccttgcattccttgggggtgtgagataggctaagacaggtctgagattgagatgctcttaaggaggaataaagggtaaatttctggggatatgcaagacacaggttggggatgggagaaggttgaatatactgacagtacgggtcttaaacaaaggaggggagtgaatgatattgctgtcatttctcagcaaatcatagtgataaaaaatgtggcagttacaactatacctgtttgaaattcctattatataccatggcaaaaaaataaattatttgcaaggacttaattgtttcatttcctgtttttgaacaatattataaacaatactaaactacattgtatctcttttatctttctttaaaaaatgcatcttacatttttgactcacctctttatagggaaaaaacaaaattaattgtacttttcactgtgtagaacaagaacattctagaaaaaggaacttgaaaagacagaataaatcattttaattgccatcaagttatttcacatagttaagtttcaaaccacagtacaaaacctgtcagacttttagatttgaatactgggttgttctgcttcaataattgaacttgttctggaatgcaaggaaaggtttcaaaaattagtttttagcttttacatttcagcttccattaaagaattctacttagacaactgcaaatacatatttgtaagaaaagtgtggtgtactttagatctgaatagaaaccatcaagaaaatgtagttaaaaaaagacaagtagaagtcctaaatgatttctcttcatcagaagatattgttcctttgtatgatactttacagttaatgaggtttccacatgcattatcacatctgatactcaaaactaccttattttatctacagctttatctagttacattttgattttatgcttaggttgataaacaattcctataagaaatagctatgtgaaattcatttttgtatctgctgtaaaaaacattgagggcaccttctattactcaaattctatgtgagaaatttatattttagggttaagaactcaaggcaatatgaggtagaataaagagggctagactaagagtaaggagatatgtgttctatccatttaatattcaataatctcaggaacttaatttaacttcttttgactatataaagtacttggagccttaggtttttttatgtgatataatgggggtaccaatattgccttctcaataaagttgctgggatgatcaagtaagatatatatacacatgctaatagcatgtgtataaacaagcatgtgtgtacacaaacttacagcacagtgtggagaattaaggaattctaataattactatattaaacgtggtgtttccctttttgccctgactgccaggaagctcagagtcaaatgtgacacatttgaattaatataactgtgttaattccaacagttgtcacaagtgttttcttttttcttgatcctgaatttggtggctcctatttatattcttttattgtcatatgtcggtggaaagaggagggattagaaatatatgtaatattttagaaataattaaagtagtatgtggcagaactggtattgaaatttaggtcttctttctctaaaagtgatatttttaccgtagcttcattttaaataattggcaaatgatttacattgttgcattgatttttttgttttttaaataaaaattaaaatgaacttccatctcattcatattaatagaaaattgattaaaatgttatttttacatgttagaaatacatttttaaaatcatatacttcaaaatactgtggtcagtttgcatcatctctgttatgttttaaaattgtacatctttttaacaaccttatcttgttttaaatgtaatatatattcatttatttttggctaattatattaacttacttgaatgcagataaatcattagtcttgaaagcttgatgctagaaaataagtaagaaacaaaatatgataattgactttactatccataaaggacagtttttttctagatagacttacagtaggcagtatttcttctatgagagaaacatgatattgataagcttttattttagggtttgatatacaataaattttaattaagatctttcaggtatgctaattttctgggttatctgcgagcttggtgtacctttgaaatataaatctttataaagatatcagaatgaaactgtgttcataatattctaatagaagtcagaagctataatacttatactgaactttcatgatatatctatatatttcatagaataacttacatttttaaaatctgtggctgttaaagttggaagctctctgttaacatttaatgatcttgtcggggaatatgattgacacaattaagttgtcttgcattttagttacataattgatatgggatgtgagtaagatcctaattcagaacatatgatactcttgttccattcctttcgagaatgaaattaaagcgacttataaataaatctggttttcattaaaatatggaaaaaaacatctgcatgccaaagcatttgcaatacagctaaggatttatactctatatttcatacttggaacatttttatcatacaggattaaatccacagatcaaacaagttctctaggaagtataaaggtttttactctaattcttttggcttaaagagaatgtatatttagatcacagtaggaaaacaggagttctgttagatcgttctttattccccccttaggaaaaaattaaagttagtacattcttctgaaatgcttatttacaaaataaatgtatttaatatgtactttttgagatttctttttactagtttgtttttctcaggcagcagttttattttgtaagtttaataatttctgttctttagaaaatatccattgagaaacacaattcatttgtctgtgacacacatgtgaaatctaaactaattttactgtgctttactgtgttgcctttattgttaatgaatggtaaagaaaagcactgtatttaaaattggctttattaagatgaattattaaggataagaaatgattaacgataaccagtagccaagacaaggatagagaaattacattttacagtataattatttttatattaagaatttaaagttcaatcctatgaaaaggagaatgcaaagcatgatcttgaaataaatgaggtagtatctgaaagtatttccattgctactgtcaccttccttttgctgattttacagacatataaaatgaagttgttgagccagatgatctctaaggtctcttccagctctaacattccataactgtgattctgagttactgctgggaggaggtaaagttatcttcagtcccacagttcagtgctttggtcagttatatgacttttatggacataaatgaattgtgatctgaaatagtataaagtaactggtgtacagaatttcaaaaagtgttcctttattcctgtgcaagagaaaagagtcctggtcctggggattaaatgctcccttttgtacaactttagcttcgtgacatttttttttcttttaaagagtgaaattggcttataataattttttgttttattttattacggtaagaacacttgacatgaaatctgcactctcaacagattttcaagtgtataatgcggtattgttatctacgagagacagcaaaactaacagatggaatctcctttggtactcctttgggcatttttcctcctggcactgcaactgtctgggtctaacattgggtcccagaaggaaacacatttcagacatagagccctgggccttttgccagcttcagaaatttggttgccaggtgttcctcaatgaaagatcttttgaagtttctgttttgattcttactcaagagtgactagaagataaacacgttgagtatcatttttgtattattgatatgtgtactcttttagtacttcctgcataccaggaattgaggggcatgtgcaaatggagagagcaaagcttcaggtccactaaagctgtaaatacttatgcataggttatagtttctggcatatgtatttcctaatgatacaaattagggtggagaagggaaaagtgtcatcatggtgctgtttctgcagctgctccttctcttgttctgttaaagaggaagttgtcagcacccaacagtaacaattaagttcatgttagaagccactggttgaaatccatgtagaagacctttgcctaatttaacatggcagtgggagactggtatctggcagagaatgaaagaggatgcgttattgcaaagtgggaattttgagattatctaccaaacaatttgaaaaagtccctattggtctttgatgccccaagctcccatttttgcataagttttactttgttactattgtgcgtgtgtatgtatgtgtatacacttaagtgtaaatatctgacagctacgataaagaaaattgagaaaaaaaagcaaagaaaaatcatgcataacatctctaacctagtcactgtccttttaattcttttgaatttttcgcaaaagctttcaaaactatagttaataattatatttatatcatcatcattttccattttattcattgtgttttttcttaaagccacgtaacattccattgagtatgctgttctaaatattttcaaatgttgggtatatagagttttcctccagcttctcaatattataataatatattcaacagcttcacatacatagaattttctctattttattttcttagattgccactacatttttattgctcttgctacatataatcattgtttttccaagagatagtactaattggcacgatcactagcaatgtatgaagtccagttgtgccacatccttgaatatttttgtttactaattttgctagattaattgaaacagtctcattatttctttaattagcaccagtgattggattttcttcatgtgtatttactagttgtatttctttcatgaattgtttctcctttgcatacaaatctattgaggtcttgggaattaactttaacttttaaaaatgtctacatatgtatctcacatattgctcatattgctatcacataaaaatatctactttttggtattttaagtatatccttctggctttatatgtgcatccagttttgtttttttcaatgaacaaatacaaaatcacgttaacctacctttttctcattctgtattctaatgcctttatatgaaaattttaatattttacaattggtgattaatgccctttcctgaaatttggaaaaatgtatatagaaaactataaagaagaaaaatgacctattattttaccacccagagataatggctatcaatatattttagttcctttccatttttaatgcatccatgtttttcctcaaaattatcatgctatatacacacaaatatatgatgtttactgaatattcagtatattgttatttcaaaattatcatggtcttggaggtttgttttcaatttttattattttaaatgttttcagtaaacatctttttataaaagtctttgttcttcaggaacagaaaaccaaacaccgcatgttctcactcgtaagtgagagttgagcaatgagagcacatgaacacagggaggggaacatcacagactggggcctgttggtgggtgggggcaaggggagggggagcattaggacaaatacctaatgcatgcagggcttaaaacctagatgacgggttgataggtgcagcataccaccatggcacatgtatacctacgtaacaagcctgcacattctgcacatgttctacggaacttaaataaaataaaaatttacaaaaagtgtatgttcttattatttttaatagtcttttataagtgttttcaagtatataattatttgaaaattctttatatctattgccaaattgctttccagaaaggtaatttatataatttgcattttcaccagctttttacacacctcatcactcctcactaatgttgactattatcttatttttaaatatttattaattcagtagttggaaatggcatctctttgtttttattcatttctaaatgtcaattcattaataagaaaaataggatcccacaagaacattttaatgaaaggaagtaggcttttcctaatagctggttgtaatggttataactctgtgtgtgtgtgtgtgtgtgtgtgtgtgtgtgtgtgtgtgtgtgtgtcagaacaaacactggagtcccatgcctaaagtagaactttttttataatagatattggtatcttgatggacaaacactactaataatcatatgtgttggcattgtgttccctcttgcacttcttcccaaaataggtaagtctttatagagcacattatttgtttagaaaaaggaaagaagggagggagggaaagagagacaaatattaaggggctttaaaatttcacagtaccacatttttggcagaaggatggtggttgtgtataattttaaacttggccttattttaggttgttcagccttcagccctgcctagttaacctattacttggtttgcagtagtattttgtctgccccactaaaataaaatctttacagcggaacattaaagagcagcctttccttacagtgtaccattagtggtaagccagttccaattctgctgtacagagctacataaatgatctgtgacagatagttggaatgttgttattctgagccctaagccccagataccaaccactataatagaaaacatgcctaagatgtatagctttagttgtacgttaaaatcgctttccttataaattgctttttattttactgttattttacaggctttcttggctacacaagtagtttatcatttttctttatgatgttctttgctcttgtggtaagtttaaaatataatacattgcttatctcctcactaaaattggactcattgtgttagtcttttttacttttaactgttttgtgttgggaagggtatctcattttatttcactgtgttattaaaagcacttttgttccattaaattatttccttcattgtatctattttgaagaggcttagctagaacagcatttcaaattcagcatttcttgtggttaactagagaggagagcgtgccaattctgttaaaatcctagatggagtgtaattctttgtgtaggtgtgtaaatttattcctgtaccatactgtatgaagaatcagtctggttctaatctgtaaaatctgtttgagactagtcatcttaattttgaaactttattccattaataaaaaaacagagcttctggtactacattgaggagatctagtaagaactgggttgactgaattctattttgtctggtttattcagcatagataaattctcataaaaacactactacaaatatttttcttcacatgtgggatatattccttattttttaattagctcatttttattatataaaaatatcagatggtaaatttaacttattttgatattataaaataatataaagataagaatttaaatttatttccttctaattcttctaaaacatcttaacattctaaagatagtacctttgtgtgaaattttttaagtcttttttctttgtatagcagtttattccataatcagtatctaaatgtcaaaccttaagtagaaataaacatttttaactttccaagaatatacatgtccaaatgagcttttcataagcttggttcaactctttcttgtttttgaaaatgcatgaaagaaacagccatatgtaagagcagaacagcacatcagtagttaagccatattaaagatccagatttcaaagctgtcaaaacaacctagggtgcatttaacttaggctaagctatcttctgagacacagggataaaataactttaaattatttaaacaaagtggaagtgactctgattttagtatatataagcatttattctctattgaatgctcttaaaactaaaaacatttaacagtgtttacatttaatcatttgttgaatttaacaacattaaaatcattcctcttcttctctccccagttgtctgacttatatcttacagataagtgaattgaacatacactttgtaggctccatattgaaaaagaaaaaaactaaatatttccatcatcatttgattgttgagaagtgtggttagaagtggcctacatatgcaaatgaatgtatggatattaaagagaatcagtatagataacatattgaatttttctctcacagataattggcaatgcaatcattgcatagataggagtaatttagttttcatagccaatagcttaaagcaggttaaatgtattgatatgatatgtctactgtagttttgtttctgtcatgacagatactctttaattcaatgcagatttctaatgtagcagccatatggaaataatacccatattctacatttattgtaatgccttataaaccatctgctcagatttttacctgtgagcacagtttaatctacagtggggcaatgaagaatactctgtatgcttttttaaatactctttttaattggcatgtttattttattatttatttatttatttattttgagacagagttttgctctgtcacccagggtggagtgcagtggcacgatctcagttcactgtgacttacatctcctgggttcaagcaattctcctgactcagcctcccaagtagctgggatttcaggtgcatgctaattttttttttttttttttgtatttttagtagagatggtgtttcaccatgttagccaggcaagtcttgaactcctgacctcaagtgatccacccacctcggcctcccaaagtgctgggattacaggcgtgagccaccgtgcccagccaccatatttattttagattctctgaatgttatcttttaaaatacatagtggttaggaaaaggaaacgtatatatattaacccagaattttggaaggataccagtttttcatttattattcttgtcaatatgtgtttgtaaatatgtatagcatttatatcatattttttaaaaatcagttcaggaactattattttcttatattctttgaataatataaactaaaacctatattttatctgttctcccagatctgtattttcattaaaaaaatttaacctaaatttttgccccctctaaaatattttgcaattttaaaaataaattatatctgtctcagaatgataccatcaagatggatttacctttttttggtaaatttactttttttttggtgtattttagagcacaagcggattaccattcgttctaaaagttctatcttaagtacagattagtattctaagcaacgttttaatacgtcggtaatccagttagacaacttttttttttaagagacagaatctcactctctccagtcacccagactggagtgcagtggcatgatcatagctcactgcagactcaaactgccgggcttaggtgattcttctgcctcagcttcctgaatcactagaactacagctgcataccaccacgcctggataatttttttttttttttttttgagatggagtctcactctgtcacccaggctggagtgcagtggcgccatctcggctcactgcaagctccgcctcccaggttcacagcattctcttgcctcagcctcacgagtagctggaaccataggcacccgccaccacgcctggctaattttttgtatttttagtagagacagggtttgaccgtgttagccaggatggtctcgatctccagacctcatgatccgcccgcctgggcctcccaaagtgctgggattacaggtgtgagccaccgcgcctggccagataaatttttttttaaatgttggtagagacagagtcccattatgttgcccaggctagccttgaactcctatgttcaagtgatcctcccaccttggcctcccaaagtgctgagattataggcgtgagccactgcactggcctgaaatagagaattatttaaatggtttttagtcagaagctttgcttctactgaacactatgttaggcattttaggatgtggaaatttaacctggacactagtcttaaggatctgtcaatctagtaggggagataaatttcttttcaaacatggagaacagtgtgtgcaatatataaataagtattgatatatttgcttcagaataagagtctcaagagttgagaggagagaaggctcactgagagctagagtaaagaaggattttagaggaaatacaacttgagttgagccacaaaagaagcaaagggcttagagcagagagaaggaagggaggccttttgtgcaagtgaacaaatatttttaatacttagtctcctttttccctttgtcattccaaccccaagacttaccttcttaccaacctaagcaaggacttcctgttaatctttcctctctgttgttgggtctcgtttcactcccgttctgtacttctgctttgtgggacatcatctctatccaccccataccaccatacaggcttggagttgggatggatctttgcagagaaattagctgtagtaactgaactgtctattaatataaaatcaggctacttcttatttttttcaaattaataaaaattaatgataatattgcactttggagcattgctttgaaatattttgatttgaaagcttaagaaataacaactgataaatgaggcagctcacatacagagtttatctaggtacctggtgcacagcaagtcctcagtaaatgattttttctgccaacactaccactgttagttaggggaaaatataagaaactgaatttgggcctgtgcagtggctcacgcctgtaatcccacactttgggagcctgggacaggcggattacttgagcctaggagtttgagaccagcctgggcaacatggcaaaatctattctctacaaaaaacacaaaaattagctgggtgtgatggccacacacctgtagtcccaggcactcgggaggctgaggtggaaggatggtttgagcctgggaggtggaggttgcagtgagctgagattgtgttactgcactccaggctgggtgacagagtgagaccctgtcttaaaaaaaacaagaaaagaaactgaatttggagcagtttcaccctcacctcatcctcatcgtttttttttgttgttgttgtttttctttgaaaacctataaagataatgatggtgagattattgcttttgattttgttatttccttttggtaagttgaccgtttcattttatgtcatattgaaaacttacctagaaatgtcaaagcagcttgtctagtttatccttctacagtaatttttttcttggtgaggtttttaattaagagtgattctttagttcactcattaacttaatcctaaaagtatatgttttccttatatttgttttatcactgtgtaaaattttgattaaattagtcaaaatccaaaactaggtaaataccaagtaggaatagaaattgtgtttacatattggtctcctacaaagaacaaatacttcctttattctttcttgtccttttgtgcactgggattcaccctggagcaaacatttacagagtaattatgtgccctgaaacaacagcaacaatggtaatattgacagagccacagctataggtctgataacaggatggccacaattaagagtaaaaacatgaaacattttcattgattaattctgggaaacagcatccctctggatttcttttaatgttttttttgtttgtttgtttgtttttaccagctggagttccctagctatatgctcctattccagccagctttctccacattaaccaaaaataattcagatctgtaaaagtaaggaggggcagcacttaatgtgtacatcagaaatccctgagctccttctgagtataaagtctgtacttatttcttcctgtggcctttccataaactgctgttaaatgtttctctattcactaatacctactctacaaataaccatattcctgtgtgacagtcactgaaaacatcatgttcctgttttgagttgcacttaaaaaaaaatgccttgatgctgttggaattttgaaagttgacacaggagtacccttagtctttaatgggggagatctctacttaacaccctgcagtctccaaccgcctccctaccacaggtgaccatgttaaatgttgaccccattctaaccgggaaaagtcacagaagcagagactcttctattagcatcttatttaattgaaatgatactgacctatttcaattcagtttcttattaattttataagaaatgatctgagtgctgattctgtttacttttttaggtaataattaaaaaatggtccatcccttgtcctctgacattaaattatgtagagaaaggtttccaggtaatagcttatattttcttttcagtttcttcctttttattttaactaaaaagaaaagaaagactaatgattcttttctgattgatgaaaaagtaatggctatattgcattttagaactttgttttgaaatactttcatttgaaagcctagtaataataaattcatcatttttattgatatattctgaaatttaatggctgttggtttctctttttcccctcaatgctcttaaacagatttcaaatgttacagatgattgtaagccaaagctctttcatttctccaaagaggtgtgtaagttattaacagatacttttagttgatttttcacatttcaagttttaagaggtttgtgtaacagggtctcttaggtctttgtacctgtgactaattaattttcatgaaagtgctaagtataggattgcctaccagaagactactattatttaacacagggtggcctattatgaaacagccacctttttttttttttttttttttttcctggtatgcctttgaatggagcctgttttaaatgggcctctgcctgaaagaacagatttaccgaatgtctggtctggccaataaggtcctctgtgtataccaacttcctgttgccctctgcacttgtaaagctaaatagccaattatatcaaaaactcttcccctgtgagtagaaccttggtctgtagctaaacagcctcatcattggactagggattgagcactgccaatatatcttctggccgacattccaaagttgaaattcatgatgccaggagtagagactaggagaccaagtccctttgccttccctaaaagccataggatactggaaatgcctgtaagagcccctgagcatcagcagaggagacaagaactgtgacatggatggtctctgctttaccactctagaagagctcaaagtcttccctgttgctgcaggcttatttgtctatactttctgactctgctgaaatgctattttgtatagttcccagatgctagaatcccccctgctcatgtaaaactctattagtgtagaatgttagcttggttactccaccatgcagaattttcctttttatctctagtttttaaatgagaaatatctctctggtcccaaaagggagattaccacatcttttacatggtaaagacctccaggtgccgtaaagatctaggtaggataattgacaagccaggaaactgagcaatatatgaaatggagaatttgtgaattaaactctcattttcctagtccagcctcaggaaacactacagcttcctctctcctaacccccttcagatattttaagactctaggcattatgtcccaagataggtcttcatttctggaatttcttttgtttaagagcctgaagttagttaagtggaaatttttttagagcagaaaggagaaaatagatcaccatcgtctatttggtaaagatggtattttcacttaaatggtaactttttttgctttactctgactcttaagtattctaataataaaaacaaaacaaaaccttatatttgtatattacattggatctcttaagagtttgtaggtctagaataaatgatattcattcccattgaaagagatcctaatcaaagatgctggcaatattaaaatgtgattaatattttcagtattcccttggattgagttcatgaaagcaggttcaagagcattaactattagtgctgcttagagtaataagatacatttaaattgtgcgtacatttagaagacagagaattaaaaaagagcatttctaaaatgttatttttatctcatttaaatattatttatcttatgtaatttttaaaatcttatccagataatgtagaagtagtgattgtagtaaaagcagcatggtatgggcagccaaataaaaaatattctggctagtacaggcaagcccactatcaaataaaatatttgctggatcacaagtgtttttctcttttaaaaaattcttattttataaagagaagactcattaaagatgaaataaatgtaatcaaattgattttttaaagaactgagtttgttgtcaaatgaaataatggtttcagtagagtggcatttaataattttgtctctttaaaatttttttcagagtgcttatgccttaccaaccatggctttttcatttctctgccatacctcaatattgcccatatactgtgaacttcaaaggtactgtagaatcctggaatattttaaatatattgtgtatctttttacctctaaggctttcggattgaatgacatcctcttttattaatcctttcctctcatcagtggatcctaagtgttagtttaaaacaaaacaaacaagagttagttctgtccaagttaagaatgtttcctagaagtgtaatctttgaggctggcctgtaatcccagcactttgggaggccgaggcaggcgggtcacctgaggtcaggagttcaagaccagcctggccaacatggtgaaaccccgtctctactaaaaatacaaaaaaaatagccggacgtggtggcgggcacctgtaatcccagctacttgtgaggctgaggcaggagaatcgcttgaacccaggaggtggaggttacagtgagccgagatcacactactgtattccagcctgggcgacagagcaagactctgtctcaaaaaaaaaaaaaggaagaagtgtaatctttgtgtactaatttcgaatgaggacttctagtgtatagttattgatggagttgttcttgaatgaggaattctctcgaccagcttaggacatacttgtttctttacatataattcagatcacttattctacctttgtcatttttgtcttttagtccttcaaagaaaagaatgcagaatgttaccaatacagcaattgctttaagttttctcatttattttatatctgcactctttgggtacctcactttttatggtaagtacattttaaaattatagatgacaaaataatagttacatagatggcctcacgccaatctatagactttacctatgccttttattactaagttaatttgctcagatcaccaaattacaatgcagtactgtggtggctcttgaggcctaaacaattggattatctttcttttagaaaggtagttcaggtttaagattaatgacttcttatgaaaattttcttaaacacttaagtaaaacttcaggcttagggacatgattctttctataagaaaaaatgtgcaattttaatgattctgtttttcttaaattttgaattcaatatattagtctaattcagaagtgtgggggttgggtgagtcagtcatcttaattgcaaaagaacaagttgagaaaggaaagggttttacacagaactatatctgtatacttagatgtcagacatctctgccttcagatctaattatcacaggattcagcagatgtgcattctatgatgcaccatgaccttcctccttaattatttttacaggttcttttaaatttatgcaacaaaaataaaattgtgttttatttcttttgcaaaaactgtctgctttgtatgttgactttttttcctcttctgataagaacctcaagaaaaagtaaagttctgtgtacaccatcaggaaaagcattatttccaatgtgagcatggtgccctgctagagacgctacaaagaaagttaaaacagattgtcaagcttttctgatcatcattaataaaacaaaattacttaaatatataaactttatttttggatgttgggtttgttagtttttatacagacttgaactcaataagacttttctgtgtcaataagatactgtaacagggtctcttgggatccaaaaatattttgtatagtggaatagctatatatttcttttattaaaattgctacctggcacaaacactattatatttagggatcttcagcaataagaaaaagtccaaaaaaactgacctccttcttctccctatggataaatagaactatctggaagaaacctcagatggcttgccaatatccaggctggctgagaaattgttagatgaatcaccattaggtgcttagaaactgtattaaattgtagctgtattagattgaaagggatgtggaggaaggatggaagctaatacatttattgagctaacatttaagacagtgtcaggtattttatatatactccctaacttaatccttataacaattctgcaagctcagtgtaggttcatttaggttgagtaattagaccagatacttgaagccagttaatagtggaattgggatttgaatctagttttgtctctctccaaagccaatgcctttattactgtgttgtctactcagaaattgtgctatagaagccagatttcctttattccaagtttttgttaaggtgatcttttagaaaaatatgactcacttaagctctaggcatctatctatgtatgtatctatgtataatctatctatctaacattgctgcttgaacacaaaggctaaaggttttcatcatgtagatggcatgtttcctagacagggatttgtctaatatcaagtaaaaccattatgttgtctctgatttaatctcttctccactaatgcaaattcttcagagtatgcaaattttatataatagagaaatacacatctaagaaaatcacatggtaggtaggtatatgattgattaataggtaggtgggtaggcagatagatgggtggatgaatagatgatagattagatagatagatagatagatacatacatacatacatacatacatacatacatacatacatacatacatacataaatagaataaatgatacaaaagtagtaagttcttctccaaagacagaagaggcagatattgatttgctcttggattgtgaatcataaccaagaaaaacctttgatcatatctttctaccaggataacaggagctttgtgtcataggaagaaattgctggttgaacctgagatcttataagggctagcctcaacttaaggcttccaattcattttacagatgaacaactaaagcccagagaggtgaagtgacctgtcacagaattaaaggcaggtttcctgaatactaatccagtgttatttctgctactttgtgataatctttgtaaacttaataccctgtttgacaatgtgtattaaacaggacagcctcctgacttcaatggcatatataacttgcagagatcaccattaggccctttctgagatttgtagagatttgtctgaatccagggaagcatgcaccactctatccctcacatatgttatggctcagttaagaacacagagtgactggctcagaagaagtgttttcatcctgggaaagtagaaagtggacatgtgacatctattttgaatttgtaataaatctagttcttcaagattcaggagctgctttggatccttttatccagagctcctaaagtttaatttctaaatttgtcagattaaagggacttataggtatgtacctagattaatgatacttgctctgattacagctgtgaaaggaagagaaaagggttcctctggtgagccaggccagtgcccaaatgttgcataataaccaggccatttaaaaagtctatgaggttgttaagcaagaagtgttaatagctcattttatgattcagaaaatggaaataaaatagtttgccatatttctccaaagactcacaagtatctcacagatttggaaatagaatccagatttcctggctcttcttagtctcctacttagtccaaatcccacattgtgtaaagtatgtttttgatactttggacaattcatttctctcctgtttccattatcactagtctagttcagattctctttacctctcagtgattgtaacagtagctgttatgcctgtttggggtctctttttcttccaatccgtactcctgctttagttcagatcataatacactgttctttgtaagtcattattgcatttctgtggcctaccaggttgaggccacatctcatgcagaactgtattactaggtctgaaatgcatttccagccctatcacccacacactgtttcatccactgtagtacttactagaccacttattttctcagatgcacattccctttgctttgtttgtgctgctccttgcttctagagaatctcttcccccacatctttgaacatcagcacacattcattgactcatgtaatgttctcagtaaccctatagtttagtatatggccatccccattttaaagatgtaggaactgagagactcagtgtaagttgctagttactggtggggtttgaacatgttctatgtcatcacagtttagaatctccatagctcttgtttagaactctctggccacttacatgtgtatatcacactttctatcatagctatgtgtattcatctcatctcttcttaaagttccctgagaacagaggtatgtttccttttgtttttggtttccctcaaagtatcctttctgaaacactctcaaattaaaaggcaccattctattttaagtacaaactgatattttcccacaaaacactgatatccagtgtttctgagcaccctcagtcttctttccccttgtctgggttgaggttagggagacattgtgagaatgcaagaacactggagcaaagcttggtcggcatgtataaatcctattgctgaccaccacacactggcctactaagtaagacatttccctaacacttctctttttttcataaaacatgaatccacagatgaaacgtaacatgcaccaagctctgagattctagaaaacgttgtggtattgaggaaaagatgctgtctctagcaccaaaaagaagtaggtgtatggcactgcccctttgtgttatgtgatcttaggcaaatcatttaacacttttggacctacctgcgtattaatattgttatcatggggactaaattcaacaacacgtgtgaaagcactttataaacaaacagcacaaatgttcaaacccttagattatggaaaagttccaaagagataatttagtatacatattcattgtcataatttgagaggttctgcttattctggtttttattaaaggaaaaagggtgttaggtttcaagaagatatttaattaatgtctctgtgtttcataggctaggggaaaggccaggatttggtaatgggaatctaaaatctgttatcatccattagtgcaaaggaaaacaattttgttactattgataccttagtactttataatgtgatccttattattttatttacagacaaagtggagtcagaattactaaaaggttatagtaaatacttatcacatgatgttgttgtcatgactgtgaagttatgcatactatttgctgtgcttttgacagtccctctaatccacttccctgtaagtactcttaaagggttttgttgcctagtatagacgcttcctaatagggaaacactaattctttgcagaatagaatgtttgaatcacatctagtcttgtatatcttattcacttgtcaagtaattgatcaaagacttcatacttgcatatggccccgtaaaagcataaaaataacagtgagccactaagctaatttgtgctttttgagatttagtttagatttacgttctcccacagcattgtttccaatttagaaactatagttcttctaaagttttgggtttttcccccctttaattctgtattctgttttcaaaaaaatgtgcatgaagaggaaaaagtcaagtcaggaaaaataagctccttctgggtttattgtaaatttattttcacataagcattctagttcaatcttggtgaaaatattttatttgctctagaattgtaatttaaggggcaaaacagattttcattgcatctggttgctatacttgagaatcttaagaatttctgagaaaaagggaacaaaggctttgggtataaatgcatctgcatggatgtcttgaatctctaatgctgagttttgtaagagctggggcttcaagcctcctccctgtgtgggctgcagtgccaagattacagcagggactggataaattttttggcatgtgaccgcctgctgtgctcttagcaatgggaagtgtagtgaactattttttcatatttacaggctgtgaaacatataaaataaaatagtaagtggtatttctttcccatggcatgatttctttttctattataaattgtctgtttttttaatctgttgcatttaatgaaaatcattctttgagacttttttcatatttttattgttggtaattttaaaaattatgcaacctaaaaaaattgcatgtgaaaactttttctagcattaaagctaagtatttttatgaagcttacacagaaagggttagtatataaacagtttatgtgtataaatactttataataatagtttatgctgtatttttgaaatctaaatgatgtaggaggcaaaaatatcatggttgttgtatatgtttctctcagcaaatatctggactttgacatttcctcttcgctatatgtttatttttctgtaatacaggccagaaaagctgtaacaatgatgtttttctccaattttccattctcatggattcgccattttttgatcactctagcactcaatattatcatcgttttacttgcaatatatgttcctgacattagaaatgtatttggtgtagttggtaagttttctgtttcaaaaagttcacataataaaattgataaaattgctacccagcctcacatctgaatccagcaatatcctctcttttttttccctccactttaaaggtgccagtacatcaacatgtttgatttttatattcccaggactattttatcttaaacttagcagagaggattttctgtcatggaaaaagcttggggtaggttgtttttgtttctttctttcaagacttctattttaagaaatagtttgtcagtttatattattttacctgcatcaagaaagtcaatatattttaaaatatagaatacattattgcagagagtagagatttaacaaataatccaattgtatttttttatcttttttcttttatctttcttatcttttatcttttttcttatttccacaggcattcgttttgctcatctttggaattttggttgggaattttagtttagcactcatcatttttgattggattaataaataaaagaaatattttcctacttcttacaagaataatatacccctagttgcaagaatgaattattccggaagacaccctggatgaaaaataacattttaataaaaattattaacagaaaagcagaacaaaatggcagtgggtatggggaagtaagagtgtggcagttttaatcaaaaaaagaaacaaactcgaaatgctcttaaatatattgggttgatcttttgttttttaaattaatatttttatggtagttttatgtttgcagaaatactgaacagaaagtacagagttcacatataccgttttaccccaacatacagtttcccctattattaactcttgcgttcatgtggtacatttgttacatttgatgagccaatattaactattattattaactaaagttcatagtttaccttaggtttcattcttggcagccactagcaaccactgatttttttttaacttttattttaggttcaagggtacatgtgaaagcttgttacataggtaaactcgtgtcacgggaatttgttatacagattatttcatctcccaggtattaaacccagtactcattagttacgttttctgctcctctccctcctcccaccctctacccaccagccccagttgtttttttctttgtgttcataagttcttactatttagctctcacgtagaaatgaagacatgcaatatatggttttcttttcctgtgtgtgtttgctaaggataaaagcctccacctccatccatgttcctgcaaaagacatgatcttattttttatggctgcatagtattccatgatatatatataccatattttctttatccagtctgtcattgatgggtatatagggtgattccatgtcttggctatagtgaatagtgctacagtgaacagtgctacagtgaacatttacgtgcatgtgtctttatggtggaataatttatgttccttggggtatatattcagtaatgggattgctgggatgaatggtagttttgcttttagctctttgaggaatcaccatagtgcttccacgattgttgaactaatttacactcccaccaaaagtgtataaatgttcccttttgtccacaacctcaccagtatgttattttttgactttttattaatagccattctgactgatgggagatgataatctccttgtggttttgatttgcatttctctaatgatcagtgctactgagctttcttatgtgcttgttggcagcatgtatgtatgtcttcttttgagaagtgtctgttcatgtcctttgcccactttttaatggggtggtttttctcttgtaaatttgttcaagttcctcatagatgccggatattagacctttgttggatgtatagtttgcacatattttctcctgttctgtaggctgtttggttttttttgctgtgcagaagctcttaagtttaattagatctcatttgtcagttaatttttgcttttgttgcaattgcttggtgcctttgtcatgaaatctttgcccattcctatgtctgggatggtattgcctaggttgtcttccagggtttttaaagttttgggttttacatttaagtctttaatccatcttgagttgatttttatatatggtataaggaaagggtacagcttcaatcttctgcatatggctagccagtcattccagcatcatttattgaatagtgagtcttttccccattgcttgtttctttcagctttgttgaagatcagatggtcataggtgtgtggccttatttctgggttctctatactgttccattggtctatgtgcctgtttttataccactgtcatgcagttttagttcctgtagtcctgtagtatagtttgaagtgggttcatgtgatgcctccagctttgttctttttgcttaggattgccctggctattcaggcccttttttggttccatatgaattttaaaatagttttatctagttctgtgaagaatgtcattggtagttttataggaatagcattgaatctgtaaattgctttagccaatatggccattttaatgataacgattcttcctatccatgagcatggaatgttttttcatttgtttgtgtcttctctgatttatttaagcagtgttttataattctcattgtagaaatctttcacctccctggttagctgtattcctaggtattttattctttttgtggcaattgtgaatgggattgtctgatttggctctcagtttggttattggtggtgtataggaatgctagtaatttttgtacattgattttatatcctgaaactttgctgaagttatcagctcaaggagcttttgggtggagaccattctagatatagaatcatgtcatctgcaaacagagatagtttgacttcctctcttcctatttggatgtcctttctttctttctcttgcctgactgctctggctaggatttccaatactatgttgaataggagtggtgagagagggtatcctcgtcttaacgccagttttcaagggaaatgcttccaggttttatctattcagtataatgttggccatgagtttgtcatggatgcctcttattattttgaggtatgttcctacaatacctagtttgttgagagtttttaacatgaagcagtgttgaattttttttttttttaagtctttttctttttttttttctttttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtatctgttcatgtccttcgcccactttttgatggggttgtttgtttttttcttgtaaatttgtttgagttcattgtagattctggatattagccctttgtcagatgagtaggttgcaaaaattttctcccattttataggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaatgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccaagagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggaggttttgggctgagacgatggggttttctagataaacaatcatgtcgtctgcaaacagggacaatttgacttcctcttttcctaattgaataccctttatttccttctcctgcctgactgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattctgaaatacgtcccatcaatacctaatttattgagagtttttagcatgaagggttgttgaattttgtcaaaggctttttctgcatctattgagataatcatgtggtttttgtctttggctctgtttatatgctggattacatttatttatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtaggattcagctgtgaatccatctggtcctggactctttttggttggtaaactattgattattgccacaatttcagagcttgttattggtctattcagagattcaacttcttcctggtttagtcttgggagagtgtatgtgtcgaggaatgtatccatttcttctagattttctagtttatttgcgtagaggtgtttgtagtattctctcatggtagtttgtatttctgtgggatcggtggtgatatcccctttatcattttttattgtgtctatttgattcttctctctttttttctttattagtcttgctagcggtctatcaattttgttgatactttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcgtttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcacttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgttgggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcagctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttccgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctgtttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctcgttgccgccttgcagtttgatctcagactgctgtgctagcaatcagcgagattccgtgggcgtaggaccctctgagccaggtgtgggatatagtctcgtggtgcgccgtttcttaagccggtctgaaaagcgcaatattcgggtgggagtgacccgattttccaggtgcgtccgtcacccctttctttgactcggaaagggaactccctgaccccttgcgcttcccaggtgaggcaatgcctcgacctgcttcggctcgcgcacggtgcgcgcacacactggcctgcgcccactgtctggcactccctagtgagaagaacccggtacctcagatggaaatgcagaaatcacccgtcttctgcgtcgctcacgctgggagctgtagaccggagctgttcctattcggccatcttggctcctcccccaagtgttgaattttatcagaagccttttctgcacctattgagatgatcatgtggtttttgtctttagttctgtttatgtgatgaatcacatttattgatttgcatatgttgaaccaaccttgcatcccgtataagtgtacttgatcatggtggattaacttttaatgtgttgctggattcagtttgcaagtattttgttgaggatttttgcatcaatgttcatcaaagatattgacctgaagttttctttttttattgtgtctctgtcatgttttagtatcaaggtgatgctggcctcatagaatgagttaagaggagtccctcctcctcaatttttttggagtagtttctgtaggaatagtacctgctcgtctttgtacatttccactgatcattttactgtctccatagttttgtcttttccaaaatgtcatatagttgcaatcctatagtatgtagccttttcagactgccttatttcgtttagaaatatgcaattaagtttcttctatgtctttttgtggcttaatagctcctttctttgtagcactgaatagtattccattgtatggatgtaccacagtttgtttatccattcacctgttgaaagatctcttggttgcttccaagtctttgcaattacaaataaagctgctctaagcattcgtgtgcaggtttttttgttttgttttgttttgttttgttttgagacagagtcttactctgtcacctaggctggagtgcaatggtgtgatctcggctcactgtagcctccatctcccaggttctagcaattctcatgcctcagcctccccagtagctgggattacaggcacccaccactacgcctggctaattttttctatttttagtagagatggggttttaccatgttggccaggctggtcttgtactcctgacctcaggtgatccatccgcctcgacctcccaaagtgctgggcatgagccacgatgcccagcccctgtgtaggtttttatgtagacataatttgcagcttatttgagtaaataccatggagcacagttcctacactgtatggtaagaatgtatttagttttatgagaaattgccaaactaccttccaaaatggctgtaacattttatattccagagagcagtaaattagagtttctgttgtcttacatcctcaccagcatttggtggtgtcagtgttttagattttcaccattctaattggcatgtagtggtatctcgttgttttagtttgcagttccctaatatgatattgagcatcttttcatatgcatatttgccatctgtttattttctttggtaaagtatctgtttagctcaactctcttttgccttttttttttttaaatactgggtcttgctatgttgccccgactggatttaaattcctgggctcaagtgatcccagtgcctcagcatactgagtagctgggactgcaggcacataccaccatttgttaattgttttctcattgttgacttttaagcattctttttagattttatatttctggggttttgttttgtttttttgagacagagtctcacttccgtcacccaggctggagtgcagtggtataatctcggctcactgcaacctctacctcctgggttcaagcaattctagtgcctcagcctcctgcatagctggaattacaggcgcacgccaccacacccagctaatttttgtatttttagtagatagggtttcgccatgttggccaggctggtcgcaaactcctgacctcaagtgatctgcccgcctcagcctcccaaagtgctgagattacaggcatgagctaccatgcccagccaatttctgttctttatatgtgttttgcaaagatttttttttccccattttgtggcttgctgttttattctcttaacagtgtctttcaaagagcagaagtgtttaaatgttcttaaatatattgggtcaatcttttgtttgtttgttttaagaaatcagtgtattaaatttatatacaaaattgattcttagctatgttttaattttgttagcatcagtcactaataacaaaactgagattgttctacttggtagaatttagagggattttgccctccctctaaatcctatctaaaaacttttataactttcctcttctgttcattatgagatagacctgtgatgactgcctgtgtacttcaaagtcctttctctgagttttcttagttggtcactaaaacaggcaacattctacttggcagagacaaaatgttgatcatttctataatattttgtttggaggttataaatcattgcagcttctcattgacatggcttatttcaggttaggaaccagaacctagggctctcctcccatgaaattctactaaagccagggtgtatcagtaaaaatgtaatcctaccccagtacacatgtaaagtagagaattgcatgcaaagtgccggttttcatatatggaaatacactcttttgcaggtgcacctttgcttctcacttaggaaataagccgaaaaattgacaactgagcttctcttttgagaagatcaagatatttagcaactggagaacagtgtagtgtaatggtaaaagaccaagctcttgggttagaaagacttggattcaagtctcagtgtaaggcacactacgtaacctctataagcctccatgttcacatctgtaaaatggagttaatgcctattatacagggtcatattgatagaattaaatgctctgtataaattaggtgcagaccaaaacagactcttttgatagattaaatgtttatcccctttgtccattcccttatctggaccaatgaaatgagtttgctttccactaaggacatggaaacataccttgaatttcttcatcttgcatgagaattattttcagaatctttctctagccttcactcacaggggaactggccccaggtgcacgttttgagtgctttcccacagtttacctcagctgtactctcctactaataatgccttcctgaaactaggcacttagaatggtcccaggccacagccagacatggcctcccatgtggcttcaggtcagccagagccagtcaatccgatatcctactactcgtaccctcttcttctgtttatgacattatggatccaaatacagataggtgtgcagctacttaaataagtctaactccagtaataccaaaataaccctaaatctgcaacagatgcaaggatgccccctgggggcaattgttaagtgtgatgacagctgggcatcaattaatacatttgtcacctgctcatgagataggatcatgggaggtttggcaaagggacagtctgttgaacactgcacaaaacttagtagcaagaaaaattatttgtgcaggtattcatttttattttactttaatgttctgccttatctagttgcctgttttgagtcacaactttctctgtgcatttagatgaggttaataagatggctggtgagagcagtgcccccttcagccaagattaccaaaaaaaaccttgttcaaatgcccctcagaatttttcctgggaaatatgggccttctcattatgggcttaatgttcataatttattaggtaataactatttaaaataaaactaagtaaagcagaaaatatatacttttctaacatttggagacttgtttgctaaattaaaagacgaagtgccaagactataaattactttcgtatgttgagggtgaatgtttaaattgtacttttttatttttaacagaatgtttactcatgagcttagcatttaaatggttaaaacaaggctttgaagttaacactccattaagatgaatgggggtaattcacacctctgcttgtgctatattatttcagtctggttgcagagaaaacaagacagcagtaggttgatttactgtgtgaaggccctttaaacacccaaggtctggaaatctttggggtgtgtgtgtgtgtgtgtatgcttttccatctagaagcaggatctgaaattcaatacaatctaggtatagaatcgaggtcttgaaaatactaaagattctctgctatccagcaattccatatctggcatttgacgggtagcacgttactggatcaacccaacctctctggctttgtttgctactgtactgtagtgtttcttcctaccacagcattttttaaacttcagcttagtatactggtaaatccatcagtggaaaagcagaaacgaattatccattttccggtgaactttgtatgtgccttcagatgggttatgagctaagcattggtcttcatgtgctcctttttaaaacattttcatctttgcaaaatctcctgttctatatttacctacatataaagcatctacctttaagaactttacaattttttctcatatccctggggtagtgaagtaagcagagatcagttgaaaaagagacatttctttctcaatgtgtcctttaaaccagttctatattgtatttgaaatgtgtattccacccattggtggaagtgctacagccatttgaccctgaaatgattcattttagggcctgggaataaggttatcttaacacaaatgaaatggcaaacactgtataagatgttaatgagtttggaagatctatctttaaggtaaacagatttttctcttctctcttctctgtcctgcatgtttgcaggctcaggttactgggtaatctgtgggtagctaggtgtggagagtacttccactctggctggctgtagtgctgacactgccaatacagtatatacagagagaaaatagatgctagaaacagagggactcaaactgaattaattttaacctgtttttctttttggcatgttaacagctctctgtggctgtgttagaattagccctatgttaaacatactttacttcctgcaaatttttctgcctagattttaggtgtcataatttttgaccttagaacatttcagaatctttttattgtactgagaaatttgttttttaaaaaactcaaatacacaatttattcttctgataatcttcctgtattttttccataaggaggtaggaaaagtaggaaacaaaattttgatggaggatgaataaagatattgtggacatggtttctttattgcaatcagaatcctttctgtttgtcacccttcctaaacaatctgataaatgtgtttattatcacagtaatctgttgtcctgctttgccaagctgtcagtcaggacaagcaattataaggaacaggaagactcatcttggctgatggccaggtgggcaggtgggaataagaggtttattcacctgtggtacaaagtaaatgggtagaaaggaaaattgagttgccagggagaaaaaaaaaacacaaaaacagatggatgaaaagacattgtaatatgggatgctataaagaaaaagacttgcagagaaatgtttctcacttgtttgagtgtacagtcatcccttgggggattggttccaggatctccctcatatatcaaaatccatgcacattcaagtcctgctgcagaaccacatatacaaaatatcaaccctgtgtaaacatgcgcagattttgcatcctgaaaatactatattttttatccgtatttgattgaaaaaagtcaactgttagtgaacccgtgcagttgaaacccatgttgttcaagagtcaactgtgtatatattttatctagtgttcatcagtggacagatacacaacacaagcaaaagggctggctaattcattcagcaaattcttagcacatattatgtcctagaagttgagctagtcccaaggtcatgaaactatgtaagacatacatacatcttgcttgaaaaaagttcagatacaacttttatttttctgactgaacattttcagaccaacttgataagtgaaattgcttaaatgaaaaattatacatgtatttttaatatatacatatgtttttaaaaaaagattttggagtcaaaattacctgtgttcgaatcccagcttctgtctctttctatatctttctaattttggacaagttactattctctgaacttgctgaagactcaatatttgactgggttttctctcaaccagaggaaactctccttcaagtgagattacatatttgggaaaaactcgagtaagccgttaagcattgaatatacgtacacttttattactttactgtccctcaaatcacataacttccaaccatgttgtctcttctgccgtctctgcttcagacatttagtcagcagcctgactagaaaacggtattctagaaatatcctgaccaatgcatttattttcactactgatgtatttttccccggaaaaagtaattcttgtagtttcatagtaaatattatccacatattttgactttacatcagcatttttagcaatgacattacacttttggcttataaagtatgtggtcagaaaagctgcaggccttttttaggtaaattaccctggtttctagaaccctgtacttgtgctgttgatttacattttttaaatatgagggaatatacatgcacacacacacacatatatatatatacacatatgtataggtacacatatacatacatacatatgtatctgttatctatgtgttaaatttcatcctgttagcttcagtgcaccacttaagcagttgagatcttttttttgaatcttgattctagtgcatcagtcaccattcccgcttttgtgacattcttcatcatacttacattttttcatcccattcacagataaaaatgttaaatgagacaagactaaccagagggccctgcagcccaccgctatcagtatttctcttgagttgttattaatctatactttggatgaagttgttaatattcctgtagtgtcatctaacctgcatttcctcacttcccttggaagtgacccccaaatcagtgggtacagcctaaactcctatctgttttctgtatttctagttgcttcagaacatttctgcttgggggctccacaatcacttcaaacttaacatgtccaaatccattcctcactacagttttctcatatctgtcagcagcccctgttttcatccaacatcccaactggctttcttgcttccattcctgctacctacagtccactttcatactgcaaagtagttgtttaaaaattcaaatcagattatattgctaccctgattaatttcctccaagggctttccatctcacttagaatgaaatccatgccatggcctacaaggctcaattttgtctgtacctacttatttctctgatgtcaatgtatctttcattctccagccacactggcctttctgcccctggaacacaccaagcttgttccctcacacttactgttttccctacttagagcataattttcaaagacctttgcaagccgggcttcttatttaagcctcgggtcaactgtcaccccctcagagaggtctgccctgcctgtcttatggtcatgaccgtcttatggcccccaacacatggtagtgcttttaactttaccctgttatacaggtcactgctggaaatcttgtttatgtgttgtctgtgtccactagactgaaagtttcataagaactgggacataactgtcttatttataaccaaatcctcagagcttaggacagtgcctggtactttggagtggcttaatatttgttgaatgaatgcataaaggaatctaacagactgtgtccttctactctttacctctaatctgtcacaatgtcagttcttctttgaaatgcctcctagatttgcttttatgctgacccagcctcctgccagactcctatctaaatctcagccttcatctctttgtgcctgaagtattgcagtgattatcacttcaggctgttctttggcatcacttgggcaactttgcaaaaattaccacatgcaggttccaccccaaccagttaaatccaaatctctgagggttacgacccaggcatcgataaacttcttagagcttcccagatgactccaatgcacaactactggattgccatatctacctgctagcagatgtatgtcttccagcccattttgcctgttactgttctctggtctccttggaatcctgctttcatagtattactctcttgctcaagaacctataatggctcactactacccccattaatcccagataatggctcactgctacccccattaatcccagataatggctcgctactacccccattaatcccagattcccttgcctcatccactaagctatatttgagccctttcttacgtatgttctacaatacccttaaactgttttttctgtctagcacttgatttgccttttattaccctcttctatattgttactcctctccctactcccacttccaggtacatacccagaatgtgacttattttccacctatccaaatgcttctcattcttcaacacccagctcaaatcccacttctgtaaacactttattctccactctagtctaccccttattatctgtatgattattttggtataccattagtaccttgtaagatttttcgtatttttttcataaactacttttgtaattttgtattcagtttttgagtgggtaatgtgcacatggtacagattttaaatttacaaaaataccctcccatccaattctatccccagcatccagttttcctccttggaagcaaccacttttacaactttctgtgttcttcccagtatattctatgcctctcttagagagagagagagagaatacacaaacacaaggagaatacacggatatacacccgcaaatgttggcatacaacatgaaatcctttgcccctttgacttctctttacttaacattatgactttttttagttgtgctaaaacaaaaaataaacaacacctaacatgaaatctgccctcttaacaaacttgtaagtgtacgatatagtgttgttaattatatgcacattgtatagtagatacctaaaactttttcatccggcatgactaaaactctgtgcctaattgaacagcaactccctatttccctgttcctgcagtccctggcaactgccattttactttttgcttctatgagtttgactgctctcgccatcttgtaccaaggaatcatgtagtattttgtccttttgtgactggcttgtttcacttagcatattgtcctcaagtattatgcatattgcagcacatggaagaattttcttcattctttaaggctgaataatattccattgtatgtgtataccacaatttctttatccatgaatctgccaatagacatttaggttgttttcacctcttggctattgtggataatgcagcaacaaacatgggagtgcaaatatctcttccaagattctgttttcaatcattttgtttaaatatccagaagtgagattgctgtatcatatggtagttctattttaaattttttgaagaatctctatactggtttccttaatggttgcactattttatgtttctatcagcagtgcacgagggttccaatttctccatatccttgccagcatttgttttttgttattttgataatgatcatcctaacaggtgtgaggcaatatctcattgtggttttgttttgcatttccctgataagtagtgatgttgagcatcttcatataatgtctggtcgtttgtatgtctttggggaaatttctttcatgtcctttgcccattttaaaatttaatttttttgttactgagttgttgtagttccttctatattttgtatattaaccccttatcagatatgcggtttgcaaatattttctctctccttaagatttttattctgttgattatttcttttgctgtgcagaatctcttctgttggatgttgtcccacttgtctatttttgatttagcattatgttttggagattattttgtatcagtatacacaaaactccctaaatattttaacagctgcatagtattctgttaatgcatagaccataatttaattagctagtttcctatcaatgcatattgagggattttttattttcaaatgttgcaattttatataatgcttcaaatgttatctttgtatacatatgtcatttagcacatatattaatatatctgtagtatatatttctatccatttaactggaattctgggtcaaagggcatgtgcatttttaattttggtaggtattactacattgaccttcattaaagattttattggctgggcacagtggctcatgcctgtaatcacagtactttgggaggctgaggtgagtggatcactcgagcccagaaattcaagaccagcctgggcaacatggcaaatccctctctctacaaaaaatacaaaaattagccaggtgtggtggcgtgtggccatagtccgagctacttgcgaggctgaggtgggaggattacatgatcccagggaggttgaggctgcagtgagttgtgattgctctactgcactgtagcctgggtgacagagtaaaatcctgtctcaaaaaaaaaaaaaggaaaaaagaagatatactgatttatattcacaacaactatgtaggaattaccctttcaattttgtgttgttatttagcttttcacatttaaatactttacctctctgactccgttgtaattaacccaaagacaggaactatgacattacatattagcatctctcacagtagttggtgctcagtaaatatttgttaaatcttgtgtatttagggagttttcccatgagtggcgtttctgatgagtcccatgtgagaattgtcccctttgcatgtttgctgtttccaggaaagggtgtgattgtgtgtgatattcttaggcgagatgcttagtctattttgtgttgctggagcctgggaaatccaatatcaaggtaccaacacgtttggtgtctggtgagggccttgtctccactcccaagatggcctttgaatgttccaccctctggaggggaggaatactgttcctcaaatgacacataagtgaaaagagaaagcccgcttccaaaggcacttttattttattttatttttattatttttatttttaatctttgtgagtacatagtaggtgtatatatttatggagtacatgacatgtttcgatacagacatgcaatgtgaaacagtcacaccatggagaatggggtatccatcccctcaagcatttatcctttgtgttacaaacaatccaattatacttagttatttttaaatgtgcgattaagtaattattgactatagtcatcctgttatgctatcaaatagtaggtcttactcatattttctatttttttgtgctcatttaccattttcaccctgcccctactaccccacaacccttgtcagcctctggtaaccatccttctgctctgtatgtccatgaattcaactgttttgatttttagatcccacagataagtgagaacatttgatgtttgtctttctgtgtctggtttatttcacttaacataatggtctccagttccatccatgttgttgcaaatgaaaagatctcattgtttttatggctgaatagcactccattgtgtatatgttccacattttctttattcattcatctgttgatggacacttaggttacttccaaatcttggctattatgaacagtactgcaacaaacatgggagtgcagatagctcttcagtatacctattttctttcttttgggtatacactcagcagtgggattgctggaccatatggtagctctatttttagttttttgaggaacctccaaactgttctctacagtggttgtactaatttacatcccccccaacagtgcataaaggtcccctttccccttttctccacatcctctccggcatttattattatctgtattttttataaaagccatttttattggggtgagatgatatggcaattttgatttgcatttctctgatgatcagtgatgttgagcaccttttcatatgtctgttagccatttgtttgtcctcttttgagaaatgtctattcaaatattttgcccattttttgattggattattatattttttccaatggagttgtttgagttcctcatatattctgattcttaatcccacttcagatgggtagtttgcagatattttcttctgaaagcacttttattatgatattaaacctactgaggaaggtggagccctcatggcctaatcacctcttaaaggctccatctcccaataccattacattggcaattaaatttcaacgtgagttttggggggaacaaacatttaacccatagcagacaccattcatttatatttttcttccaggatcctgtattatcattaactcagaaaggccaactaatccttggatctattatcaaatttggtttgtttgaataattaagtataaattagctaaatggaaaggctctcctctgtaagttctttaccatctttttatgatgaaaaattttaaacatgaatgcaagttgaaataatatgcccatatacctaccactgaaacttagcatttggtcgtatttattttgtgactcacatataaattatatttatatgtaaatatacagttaactttagaacaacatgggttttctaactgtgtgggtccacttatatggggatttttttctgcctctgccaccccgagaaggcaagaccaacccctcccctgccttcttctcagcctcctcaacatgaagacaatgagaatgaagacctttatgatgatccagtttcacttaatagtaaatatgttttctctttcttatgattttcttaatgacatttttgtttctctagcttactttattgtaagaaaatagtatataatacaaataacatacaaaatgtgtgttaatcaactgttattggtagggcttacagtcaacagtaggctattagcagttaagttttggtgggagagtcaaaaattgtacacagattttcaactgtgtggtgggtgggcacctctgacccccacattgttcaaaggtcaactgtaaatacatttatatttgctgaataatttgcaaagtaagttactgacattccatgaagcagtaagtaaagttgaaaattattttttgtaaaagtcaccatctaccttagctcaggctactataacaaaataccatagattggatggcttaacagaaatttatttctcatagctctggaagctgggaagtccaagaacatggtgctggctagaattattttggtcctggtgagggcctcttcctggcttgcaaatggctgccttcttgtgtcctcacatggtggagaaagagtgatctctgttcctcttcctataaagccactaatcccattatgagggtctcaccctcatcacttaatctaaccctgattatctcccaaagaccccatcttgaaatacttgtgggttagggcctcaatatgaattgaggggttggaggagacacaattctgtccacagaactttctgtgaacaagcctattattccctccctccctccctccctccctccctcccttccttccttccttctctttcttttctttctttcttctttcacaaatgttgtccctttctccaaaaggataagaagctgcttgatgcagctgtcaccagaacttctcttagtaagggaaatatccttaatgtctttttttttttggtggtggtggggaatatcttgataagtcatttaggtatgaacggtgaattcttatacagtggcacagcaatgtgagtttactaaatgcctgtgaattgtatactttaaagagggtcattttatgttatgtgaatttcacctcaatcaaaaaaaatgtgaccctatgaaaatggttggcaagaggagaggaagtgagagagatagctaaaccactctgcataaaagagaaaatgtgaatttgggaactggagaaaagcaaagggaaagaggcagagagtgctaacccagtggtgggagtctagaggaaaagtggctgacgggcattttaagaacagaagcgtttaatattcagttttaatttgcctgtctctgtctcctgaaactaataaagtcagtagacacaaaaataccttgtgtgaacagaattgtgcatgtaaacccttctttagactcacatgggacagaacacatacagccttatgctatccaggtgatccagaaacctcaaaaagtgaaattcaaaggcagagatggccaagaaaaaatgtaagccacttgcttcctcccagagtccgtgggcacatcaggagggttgtgggacgatcctcatatgagggatgtgattgaaccaacttttcctaattctcaaagtgtattgaactttccttgacatctcattggcaatatattgtcatttcattgctttaagggctcattatttactagtcatcaattgtacctgtaggggaatgcctctttttagagacaagagaccagacctccacagaggtagatcttggagattggagcagttctagaatttctaacatttccccttacggtcatcttgctaggttctctgtaacaaagcctggtagttcagaaatcaggctccaagaacgtgccatagatcaacctgtttgtgtgtgtgtgtgtgtgtgtgtgtgtgtgtgtgtgtgtgtgtgtgtgtgtgtgtatgtatttgggatcagagccactcaacttcctttttttttgaaacggagtttcactttttttgcccagactggagtgcaatgctgtgatctcggctcactgtaacctccacctcccaggttcaagcaattctcctgcctcagcctcccaagtagctgggattacaggcatgagccaccacacccagctaattttgtatttttagtagagacgaggtttctccatgttcatcaggctggtcttgaactcccgacctcaggtgatctgcccgtcttggcctcccaaagtgctgggattgcaggcatgagccaccacacccggccttcaactcaacttctacttagatggtggcagtaggaatcagagggagtggggcccctagggaagagcactcccatggaaaaagagtagaaacaaattttataattccctggttttcttacccagttctccaacctgctaaaatctgaaaaagtttcatactttaaatgaatggaagatcattagtctcataaaataatatgacactactgagctggcacttcggtgtatagaccaggttctatgccaagcacattctcatgtaatctgaggtaagcacagttatattccccatttaatagattagaaattaaagtttagagagactgtaaggttaaatgacttgttcaaggttatacatccttaagatgccatcctaagaatagaaactgaagtttgactataaaggctgtgtgcttaattaccatgtaaataaagtgtatccaactgttggagtttttttctacaaaaaggttctgctcatagcagatacatagtcaatattgactgtgttgaaggctgctttattcatttaaaatgtggcacctaaatctgttctgttacatcagccagacagtattttggccggccttgtgtcctcttgagtcatggttcattgccacagcactgttgtttctcctttgttaagtatttcagaggaaattctggacaaaggaaaggtatatgggtcttcaagtagagcagggatgtgttccagtagttgtcaactagactgagaaaacttggatgtcttacgaaacaatgtcagaaatccatttctgtgttctgtgactttctacaaacacaatttttaaaaatccaaatatagcttagaccatcagtagtctaattcagtgtttcccagatttgagatttcttttggaactttagaacgtcaaaatgaatcttgggacattgataagattgcagactttttattttataaattgattaaggatattaaacttgccactttcaatataaaaaattaaggaaggttataacctttgtgaaaaacttgctacatagttatttatctcatcaaagaccagtgaaaactttctcatagaccaacacttggaaactatcagtctaaataaccagtctatattcaaaaattcagtaaagatttcttcacttctaatgctcattgacttcagttatcttataggtggaaagaagtagatacaaaaacagatcttgattacaaaattcgttgatgacctagttgactctttccccagtcattactaatcctaacctttgggagcgaaaaatatctaaataagttctggtttacaaatttgcaaaatttttgtcaacacttcagaattcagaaaaaaacacaggacatttttactatataacttcctaagtttatatgatatatcaaaagtcagtaaggattataccataataatatttacatttcacagggaagcaaaatacttggagcctctccttgtctttgtctaaagatttgtcattcatttgcattcaaataaattctttgctttcattcatccagaatggttctcaatttattagctcatgagactacataaatagacttgtattcatacattttaatttcagtgtaaaatggctttcctcaatttttttttctactcaactctcccaaaagatgtctaatcactcccacactcagttacttaaacatttcataatgttgttacttctatagtaaaacaaaaagtaatttgcttttaataaatcagagagccctactgtagcaatctagaactttattctggcgagagcaaattctcaaattatatttccagcctcatttgtgaatagctgattttccctgtcacaaagcattgttaggtaggtacagtatttttctttagttggtaaactactggaacttacaatccaatggaggtgacctctatacaatacctgggacggtaataccctgaagcgcagggtgtggctattgcatgtgccacatgcacatgaggccatctgtgcgtgcttgttgaaagaatgacatatcttggtgagtaatatgaacattaaaagctctgctggataagctcatagaggtggggttcactgccttctgggtgagtggggaagactttgtgaagaaagcaacaactgaagtaaaattgaaggataaccaaagtagaaatgagaatgaaaggaagatactcctgtttggaaagaaaatactaacaatatgtacaggaaaatacaaggtatactttggagatgacaagtaaaaattttgccaggagcacagatgtaatagcaatttgagaagtaaagctgaagggtaggatcctgatgtagagaatgctggacccaggctgagcttggactttacatcaagtagaagtggtagagaaagattaattgcctctctgcattggactagtgccatcgtcttccaaaagctaaaaagaagcactttaggccttcaagggctagttatctaaaaaccacacttgatttgttcttaagtctcagctcctgggcatatgaggaactttttctggagttttggaaaattcctcatgccctcagatcctattaagacctctggcatctttttttttttaattatttaatttatttatttttattttttattttatttatttatttatttatttattttgagacagggtctcattctgtcgcacaggttggcgtgcagtggtgtgatctcagctcattgcaacctctgcctcccggactcaagcaatcctcccacctcagcctccagagtagctgagactacaggtatgcgccaccatgcccagctaatttttgtactttttgtagagacagggtttcaccatgttgcccaggctagtctcgaactcctgagctcaagcaatccgcccactttggcctcccaaaattctgggattacaggcgtgagccaccgagccaggtcaagacctctggcatcttaagagacttcctatgagttcctgcctccaaacttttttttttttttttttttttgagacagagtctcgctctgtcgcccaggctggagtgcagtggcgggtattggcttactgcaacctctgcctcccgggttcaagcgattctcctgcctccacctcctgagtagctgggattacaggcacacactactacacctagctaatttttctatttttattagaggcggggtttcaccatgttggtcaggctggtctcgaacttctgacctctggtgatctacccacctcagcctcccagagtgctgggattacaggtgtgagccactgtgcccggcctcctgcctccaaacttttgcacaaaccattcatgttgtttttctctttcccctccaaagcgtttcttctccctcaaaacctgtttccacactcaacctcctctagaaggacttacctgactatgacttaatgtaactgctccattactcaggaaacctatgctcaacatcttgatgctacatttaatttctctaaatgataaaatatacaaattcttgtatatttgtatgtctaaccaccctgcgacagcctttaggaaaggttccacatctgccaactcctttgtatcctccatccagaacctgcctcccatccctactttacccatccacctcagagacttcatggtacagtgcagtatacttggtgagtgttgatggtttaagagtgtgccctgaacaacgaaggatttctttgaggctgaaatcctgtgggatccatggaatgggagtttcacctgtctttggcttctgctcctttccccagcatgtgtagagcttctagaacagtccccagcaagagaggatcacttggtacacctctttcttatcctcactgtctccagtctctgctgtaggcctgctagtgatgatcaggatacaggttttaacatggccaagctgttaataacctgagattgggcaccatgaacaataagcattaaaaggcaataacaacaacaacaacataacctgttaattttatgcaggcttaattttttaaagaactatttcttcctaacttgcttttactcttcttcatctactttctcatacctatgactgacaatgataaggacacccacccactatacacacctaattccatccctccaaatttgatttcgtgttctctagagctggcgtgttatgtgacctattgtggggagaggctcagctgagggactctgtgatgccaaatggacaaaggcacacttttttctccaggtcccagcctggtgaaagtcatagcacctgagaatttggagctgactctctcctttggaaattgtgccttccaaaaatatatcttacactgcctgtacctgcatgcaataggttttggttcttaccaactgcagcttcagtctgaacttgagttctaccctcatggatgcaaatcaaaacagctcagaatcaagtctgggaagcaagtcgaagtggtttgatttgcatggggagcttttgtctctgcatgaaggcagccaaattccctaggctccccagccctccggaaatatgctttacaggacccgggggcccaggcccagtcgggtgggtgtgatttgaatgttctctgctacagctgctgcaccgggccctggtcactgctgttggtttcgctccattttactgcctcagaatccccctgtgcatgttagtggttaatacagcagccaggagacgccagacagctctcggcacctggttcaaatttaaggctcatttacacatgatgtcacacacgcattgtcagcgcgagggaggtcaggatggttcattttgggaaggttcacattgttgagtctttacaacactcactgctattaatgctttaaccatctgacttggatttcggttttctggcatgaggtaatcccaggcactagatttatatgctgaatgggaagccagcaatggtggctaatcatgctggtttgcagatctgcacctctggagccttgggatggaattagagggccacatggcaagtagcaaatcataggcgttttgagcaggagaggaattagccagacctggaagcaggggccatagatggggtgttgtctgagccaggaagtttgattgaagaatggaaaccaaggtaaattggacaaggatctgggcccagagaccacaggaattattctactttgaccagtgctttgggtcattgcttgaactgtccttttgctcatcactcatagaaatcccagacccatcttcccaggtccagcgtaagtctttcatgttccatgaagcctttcctgaccacccatcccacagcaggggctgaggtggttagatcaccagaggtcagaagttcgagaccagcctgaccaacatggtgaaaccccatctctaataaaaatacaaaaattagctaggcgtagtagtgtgtgcctgtaatcccagctactcaggaggtggaggcaggagaatcgcttgaacccgggaggcagaggttgcagtaagccaatacccgccactgcactccagcctgggcgacagagcgagactctgtctcaaaaaaaaatttctctcctgaatccctaagtacttttgttactgagtacttaatttgtgcgactagctcattttaccctcacaattccaaagggaaggctttattatttctcttttacagatgacaagacaggttcagagaggttaaataatgtatccagtgtcaaacttttaaaagtcaggatggaatcctgattccaagcttaggttctgaaccactggggtaggctgtgtagtactacattttctgtggaacgtggtatcggtaacatgggagagacaggctgtgcctcaggaagatgccacatgggagtgcacagcagtgctgtagtgcctcgtgtttatgtgtagtcccaggtgcctggctgtaaacaactgcagggcagtgaccatcacctctgcttttctgcatccccacacttcctaacacagtgtcccccaaagtgtgcatcaatggatggatgaatattagcacccccgcaccaccctcacctaaaacatactgaaaagtttgagatctttggataaccaccccatcccctgctgttgtcttctgtcatacggctgaaatcgtaaaactggtctgcctgtcacagctccagtgagcctacttactcactggaaattcagagaatgtctttagtcctgttgactgctttgattttgttttttaacttgtaccaagacctgttgccatgatgggtctctgcaaatgggctttcttgttccatgagtctctgttttagtcaagtgaagggcacactccttttcattggccacctcttacttttcctccaagaggagtactcactcccagaaccctttgctgggctctcatgccgagcttaggtgccccttcagtgtgcttctgcagcactcattaccccgtagtagcattgtagtttaattcctgtttgcttgactgaagcagagactcacctgcagacgcctgtaggtgccttccacgttgctcagatgaacagtagagaagggtcaggcctgccctaggtttctacccctctcctcaaggccctttctagtcaccacgccacatcctgctcatgactgcagggatcatgcctctgggcctctgtccatgcagctgcctctgcctgcactccaggacaggggccttctctgctgtccactggagccctgtggaagggactcctgaccctagccttagggaagtcatctctaaaggctgttttattacagtgtttcctcagaatgaccctatagacacagtgttttctcagtgtcctctcacctttgaacatatccgggaataattgaaaaaaccaggcaatcaaatgtgcctctcataaatcaccatcacttcagagcagaacttaagagtttggtttgcaagccacaccaaatagtttgagcttggccctctaccatttcctcctgctctgagcccagaggttcacctagtggactgtagcaatggattcccttgcccctggcttcctgttgggttcagccagagagcagcaccagtgggagcctacagagggaggaaagtgaggtcaaggtgtctgctgcctcctccctgcctgccaggccactgtgggtagactacacctcaggtggccctccccatgtgtagccatgcttgccaggttctgggttctggaaacctccacctcctcttgccccttcagtcatagggtggtagcccccttcattgctattagctgttatgcactcaattgtgttccaaccccaaattcgtaggttgaggccccaatccccaggacctcagaatgcaactgtatttggagatagggtctttaaagaagtaattaaattaaaatgaggccattaagccctaattcaatgtgactggtgttcttgtaagaaaaggaagagataccatggagatgtgcacccagaggaaaggccacgcaaggacacagcaagaaggcaactgtttacaagccaagggaagaggcctcaggagaaccaaacgtgtccacaccttgatcttgcacttcccaacctccagaactgtgagcaaataaatgatgttgtttaatcaccca

SEQ ID NO: 528 - DNA, 244043 bp, Homo sapiens
attagaccattaccattttatttgtattaagaattatttaaaataagtataatatatatatttcactgagcctaagttgagcaggctaaaagttgatacattgagtatgtagctacaactgtaacaaaactgacatatgttcttgaactttcatacaatcgtgaccacaattcagttgctggatttcacactctccttaggtttatacaaactgaaggacaggagatgaatagtatagaaattgctacaactttttgaatttcaactatgtttacacacagaaaagatacaaaaatacatgtataaaattgcaggtagtatctatttggaatgctgaggcagtccaggttgctggtggaggttagtagggaatcctagttgtttaaaaggcaaaatggatgcctgactaattaaattaagtatatatgaagatttgtgttttaaagttttttagtggggaaaaatactttttaccactaattgcttcagaaattgagttgcgtaaagtggcctagagctaaaaatcatttctaaaattttaattaccaatgagaagaaaccagatattaaacatcttttgaggaaaattacaaaatgttttactccatgcaaagtcttactgtgctctaaaatatgctctttatgactttgttggtatggatgaacgcaagaaaactgaaaaataaatttaattaaacgagggatgcaaattaattttctttttaaaaaattgcatctctcatctaaattctcttttgcaaagtttaatatccagttctttgccacataagtaaaacaaaatattgcccataaatatagatgtagttgttgcagtctcaatcagccaactcatatatcctgaacaaacccagctatgaggacagttctatagagactcttctataaaattatgatcttgatatacatccagaatggggggtccaataatgtcaagtgttaatattgatatctaaagaactttgcattcaatatgtcttgctacctaaatggatgacactggtcttttattgctgtcttttatcagttctcagaattatgcaaacattagaagggggtaatagtaaatactttaaacatgtaaattatcttggcttttaataaatcaaatgacgagttactgggttcagcacaccaacatggcacatgtatacatatgtaactaacctgcacgttgtgctcgtgtaccctaaaattcgaagtgtaataaaaaagaattgtggggtataaaaaaagaaaaagaaaagcaagtctccaatgttaacactgaaatttaccactatgcactgagcttgagaaacaaaaactggtagagataattaatcagcctaaatatctatgtctttttttgtgataggataaaagagaccattccataacctgttactgtagcacctgattttaaatctcgccagagtcgataattttgtgctgcagtcatggttaggcctggcaaaaggacaaagtctgctttgtttgcttttgtaaagtctttcattgaacttgaaataagagaaaaatgaaggtgaaaaaataaattgaaaaaaattagtccaaaacaaacatgcaaatttgcagtgcacgattgagcatttctgtccatgaaaagtgcttctgtacagctctctgcaggcagctcttcacagtcaagaaggccattttcttttagtgtagctggcaaaagtctctgatcatccttataattagtttaggagaaaggtctggatgtaaatctgtcttttaatccattcgacgaaatatgacacattactataaacgccaggccccaggactttggaaaagcagacggagccccatgaagttaatccaaataatgtccaccgtcctccaggcttctcacaaacaagaggcccaccgctgtcaccctgcaataagtaacgatgggagttaggaactggcatttcagggcagtaatgtgtgtccatgctatcctgaggatactataaagctaaacccagattaaccaacttggaaagtttcaacaaagctttccttgtcagcctgtggaggagttgtgctttccactgtaaaaacagaactttcaaataaacatcttaaactctgatcattaaaagggtggagtggcttgggaagaaattatatttttcccccaggaaattacctttttcaggcattttctgcacttataaaaatatgtcataaagtttttaaaaagtatcagaactaattacctcaaaattgacctcattctaatttaagcttgacttatgactgtggaaagtacccaaaatggaataaagatcccccccacacacagtactgcaaacatattctaaaatatctattttcaagattcttgctttgtgaatgaatacattaagcataacacaatttggggtcccttactacacttcttaatagttcttaggactttttaatttggcatagttgaatacaaaataagaccacttaaaattataatgaatcattaatagcctgtattttatttcatatatatagggattttcattcatgatatttaaggattccagttgaactatattcagtttttcccccaaatatagttaatgataaaatgctatggcattagagatagcaatacttgctacatctgaaaacaaaggtgtattctgcactgcctcaaaaaagaagagctgatatcatggaaaataaaagagtaaatacgtgaattcattgtggaaggttacaaatactccttgacctacaagactttcaaaattagaagcatatctatggtcttcctacttggtattgttgaagaacataggactaatgtttcctgatcctcttctaaacattttccacatattagctcatttaatctttacaaaatacctaagagtttatattatttattatatctgttttggagatgatgaaacagaagcacaggttaaataacttattcattggcagaggctagatttgaatccaggcagtctggtaacaggattccaactctataactactaggctaccctgcttcttaggaatattagggaatattattgctatgaaagagaaattaggcccggcgtgctagctcacacctgtaatcccagcactttgggaggccgaggcaggcagatgacttgaggtcaggagttccagaccaacttgatcaacatggtgaaaccctgtctctactcaaaatacaaaaattagccaggtgtggttgtggaaacctgtaatcccagctacgctggaggctgaggcaggagaatcccttgaacccaggagttggaggttgcagtgagctgagatcacaccactgcactccagcctgggagacagagtgaaactccatctcaaaaaaaaaaaaaaaagaagaagaaagagattaaaattttgattgtgctgtatgcttttgtgtaagtgatgatctttaaatttgtaactttccaataccctaagccaaaatcataagcatagaacttgcaaggagctgaatttttctgcctaagagcctaattgaatttttttaaagcaaaatttctttgttacatgtatataatgcttagacgaaaaagaaaaatttcctggaaacatttcacaaattattttcacaaatttgttttcacacatttcatatgcatagggtatttcattcttgatctctccttatataaaataaataagatgctcagctattgaagtggaactattatgtcagagggtgattaaaatggaatgtgtttagaatgtcagcacattttcacttccagatcagacatttagtaaaataattatttagcatctactctttgcaaagttctgtgctagtgtataaacaaacgaataaggcactgtttttgtcccagaacagccaaaagtcagcttgggtaacaaggataaccacatgaaagcaaaatctaatggctagaaagaggaggtcaaaggaatgagtgatgacttccaggtggagaggaataaaaaatgccttcctgagatgtgggttttgagttaggcttagtgagtcaggtaggcaccccattaagtgcaaaatgaaaggtgaaaagcaagcaattaaaaatgaaagggagactacagctaaaggcacaactgatctggtctgttcttttggtcctctttgtaatattgggcttgaaaccaacatttatatttggcttcagtattcagtattcaggtttatagattgtcacggagtaactcacgcttcattatgtcctgttgatacaattaaggaaaataatatctgtcatataatagaggtctaagtagaaaaatttgctcctgatatagtaaaaagtaggttttgtttggttttctacctgaagttgtgttagagaatatctggtatgcatttagtatacccagtactaaatgaacttccactgaactcagtatacaccactgaactcccactactaaagaagtcggcaagacctggttcctattaggcatcatgataagaacatgcccatgcctgtgtctgtgggccttcagctctctgtcaaggaatcatctcccttcccctcctttagcaactgccaagagatgatcttgaacatgtgccaagaggtgctagtttttggtaaacctccaaatgacattggagagaggaagaaatgtagttatattaatcattgctgccagactgactggtttcatgtcctcagtctaccaccttcatgctggctgatttggggcaaattacttaacctcctgtattcttgatctgtttagggaaaataaagacactgccatatgggttgattgtgataattaaatgagttattagaaagcgttttgcagagagcccgaaacataataagcactaaattgatagctgttaatattggtgtaattactattcattgaatgtctaagtatgtgccagatatcatatacagatatgtgaaagatatgggcttccaaatacattcacttagttaatcctcatggacagaattagtcccattttactcatgagaaagctatctagagaggttagataacttccccgggttatactggtctcactggcagagatgaattccaacccagatatttcaggcttcaaatcctgtgccccacacccacatcatgctgcctcctacaacactttattttgggcctgggaaatcaaacccagtcctcctgtagagaagggagggattcctttaccaccatccacgtcagcaggatgacttgtggccatgaagcagaaaggagggtggtctcagcgaaatgccaagggagctgtctgcctccctctttcccatgacaactatctaaggaatcaccacagggccattttcaataccctgatttttccattctaaaatggatcatcaaaaatatagtttatttaaattgagttagtacttaagagcactgttgtatcttttcttcattactaaactgtagggagcaatttactcccaattaaaggtgcttcacagcagcatagtataataactgtcttccccagtttttgttacaagcttatttgagcacttgcacttttccctcctttcctgggagccagtccagtataatgttcgatgtgtgtctattaagtaaaaataaaaaggcacctctacactattatgttaatatgttctgcaaactctcatggccatgaatcctgagtatctaaaggttgagttcagtgacatttgaggacatgctggcaatcaagtgagggcccagacaacaccagtgtgatgacccctgagacagaggtagtcctgtctcacaccctggaagttggggtgttgatgtgtggcttcctgccatcaccctaatggctgacaatgtcctttcatgccttccctgcttccccagggcagccaggtggaagccatggttactactagctcctcttagaacctcatttatcctagccactaaaatggttgaatgagatgaacaggaaaaattgtttttctcctgttgctgaacaagggtgatgttccccatatagtagatgagacagtagaaggcaccctgaataaagaggatgggtgtaattgtggggattgcttgtgtaccagctgcaggaaaatgtgctgttaataattaaacatttggcaacaaatgattttcaaaaaatgtttccaaagggccatacgtaataatgagtttataggaatccactgaagttattgttgaactgaatctccttggtaaccagaaagcaacttaccatgcatgaatcaactgtgccagactcatagccagcacatatcatccgagtggtgatggtcttcatgtcaaagtaggactgacaatgttccagagaaataatgcggacctctccctcttgcagcttaaatggcactgaatttttaaaaaataagaatatatatatgatgataaaatgactcaaaagtgaggctagtgaggctagccaaatatgaaatgcaaatataatataaatatttttataccaagagaggcatattctttacttgaaatgccattttaaagacatggctggtttggaatcagaattttctagttagaagcattcatagcaattatccggtgaaactcctttattttattaatgggtaaaccaaggcctagactggttaagtaagttggttcatccttaccatatgctacaaccaaaacaatagctactacaaagaaaagaaaaaaatcaagccagagctctgctggctgccagataggaggctgccagctcggcgtcaactcagcatgatagtcctgctctgctaaagtagagaaaacctgtttaatctaacagggaagggttgtcctattcttgatgaaaagaatatgcctcaatatgtgccccagcagccattacttgatgtaagaacctctaatcctagaggatatgacagagagatatcgaaaagcacaaagccatcccttggtattgacagagagaatatgtgaattccatcttgcttaaaagttcttgaagaatgacaatggatttcttgaagcaagacagcatgaatctttcactgtttagccattctgcaaaattatacacactgttcttcttttaaacagtgatggtgaagcactactgggtaccttattggaagaaagagccatttttaggaaaatcaatgtgatgcagacagtggatgtttcacaggttgtcaaaagaataagaacaatagctaacatttattgggcactagtgggtctcattgcctttaatctttacaatactcctgtgagttaggtagttgctatttttttccattttatagtaagcttgaaagttatacagtcagatcagtcaggtctttctgactgaattcagcagatcttttttttttttttgagacagggtctcattctgtcacccaggcagtggtcacttgcttactgcagcctccaccttggctcaagaaatccttggctcactgcagcctccaccttcaaggctcaagaaatcctcccacctcagcctcccaagtagctgggactacaggcacacacccccatgccaagctaattttttttttgtagagacagagttccaccatgttgcccaggctggtcttgaactcctgggctcaattcatgctatactacatgtgtggagtgtgcgttatgttgcactattgctctgagttcaatatggatattgtaggaggaatataagcagaaacaatatcaagcatagtctgctcttaaattacagaattaatcatagctttgaaaaaaaacagatgcataggagtggtgacagcatgtctaacattgccttcaaaattgttacatgtgagtttttttgaaaaagtcattgacttctgcctattgaatttcctttctgttctgtaattgatgaaatagaaaagaaactcaatgtaagtcaaaccttatctgactaaattttaagaaaaaattccttcaaatatacaatttctaaggccaataacagaatgccaatatacattattattcttgaaagccatggcattatacttgatatggacagagtaggcagcacttacagttttttttttttaagtttcaggtgggtggatcacctgaggtcaggagtttgaaactagcttggccaacatggtgaaaccccgtctcactaaaaatacaaaaaacaaaattagccaggcgtcatggcacatgtctgtaatcccagctactcgggaggctgaggcaggagaatcacttgaacctgggaggtggaggttgcagtgagccgagattgtgccactgcattccagcctgggtgacagagtgagactccgtctcaaaaacaaacaaataaacaaacaaacaattattatttctaaagtaggtcaaactgaatgagagagtccattataggggtttagagtaaatacagagtacacattttaaatttctatgtgttttatatgttaagtcatctacagagccaaactattttaatcaatttaaatagtcaaatagcaaatcaatatactttcttgaaggatttatagtttgtactacagatgttgataagaccaaatcacaacatagaattggaaatatgaccatgcagcttgactgcagagattcccagtgactgtctctatcattgggctatctgcaggcagatagagagagtccaaagcacagttcagtgacaggtctcctcctgccacaaggaagctccaaaacattaatagtaagctcccagagagagattctgaagtgtggagagggatttttgagattgcatctgagcttggccattttaaatgccatggttcattattaatgtctatgatttgcacagcagatgaagtgtgacacatcgctaagtatttaccatttgtggctatatttttgtaagagaaaatgggaaattacggccaaaagctacctagcttttgggtctgggtactgggtctcattctgttacccaggcagtggtgagatcttggctcactgcagcctccaccttccaggctcaagaaatcctcccacctcagcctcccaactgaggaacacaatgtttctcaggctcctgaagatcctggctgatatggtttggctgtgttcccacccaaatctcatcttgaattgtagttcccataatctccacgtgtaatgggagggatctggtgggaggtaattgaaacatggggggcagttaccctcttgatagtgagttctcacgaggtctgatggttttataaggggcttttcccccttttgctcagtacttctccttgctgctgccatgtgaagaaggacatgtttgcttccccttccgccatgattgtaggtttcctgaggcctccccatccctgcagaactgtgaatcaattaaacttctttcctttataaattacccactctcaggtatgtgcttatagcagcatgagaatggactaatacactggcttacttttattgcccatgtggccccagcctgtgatatagcagtacgtgtcaggctctagccactgctccgggttgggcaagcagacaggccggacgtagccagtctcactgatgtcttcactcagctcaacgatgctgatgtcatagtccaccactgctcgactgtagcggggatgcaggatgatggtcttcacaaagcgtgtctgcatgaacactgatggatggtctagattgttgatgccaagcaccactttccaaactgcagcattctctctcctaaaattataattcaagagctattggcatcttaaactctagtttatcatgtgaaattcacatgtaattttaaaacattttatttatgtaaataatggccattttcatgcccacctctcaatgtattcatataagtggcatttatataatagcctgagtgattagcaagtaagtattattgttgcagaaagcatagctcatgattcctgaatggggctagtctttaacataaaacttcttcagttttaaaggcaggcagagttagttacttgcttcacagaatgagcaagataatgaaaagctatgaagaagagagaggagcaagaggaaaagtgaaaaagaagaggaagccaagactaagagattcctccaagaaagagcaagtgacttgaagaaatgccaggggaacctcctacagatttccagctcagggcttaaaaaggtcacccacgacctccaatggtcattcccatactccactgtttttgaatacttgtcaacaatattttagtcgattcccaccttaaaacactttcttcacttggcttccaggtcttgccatgctccaaaatttcttccaatctcatggacctttccctctcagtcttttcttctgggttctcctctttggctctcagtctccatgttgaaatgctctggaatttcactctcagctgtctattctcactccatactcccttgatttcatctagtccaatggttttaaatcccaccatacgctggtgaccccaaatgtatatctccagctctgtcctttccctgagctgcagacttaatgttcaatggtctatttaacactctcagttggatgtttcagccaacatttattgagggcttaccatgtatgccacagtatttaatcattcaggattcagtttacaggaacttaatactataatcaacccaggtgaatcttctctttttcttacacccaacactgaatgcatcagcaagtctttgccaatcctgctttcaaatatatcccacatcttactgtttctccctcctccatggctataatcctaatctaagctactctcaactacatggaccatgcaatggcctcccaaatcatggtccttcttctaatcttagtccctgtagtccattttccttactatcaggatatatattgactatatcctctatattagtcagagcaatatttaaaaaaaattagatcaatccatcttctgctcactattctccaaaagctttgtatcacacttgagacaaatcctagactcccctggcctctgaggccctacaccatatgttcattctcaacccaaggactttcttgctaattttgaacatgccaagagcatcctcaactcaggagctatttcccctgatgttcccccagctctcacatgggtcctaccattactccttctcttcatccaggtctcaactcaagcatcatctgctcagagctgtttccccagccaacctgtctcacccttactctgcccccttcactctacttgacactgctttacttttcttctcatactatccattgatatcaatgacattgatataaccatttgtctattctctgtcttggcccctagaatatagttatcactgtgaaggcagggatttggctggtctttttcactgctttattcacagggcttggtacctggcctacagtaggtcctcaacaagtacctatttaatgatggctcaatgaatgtttttgactctaaccacaaagtcaaggtctgttcttcatcactccctccatcccttccttcactcccagtctctcctccaccagagtggtcaggataaaaaatgtggacatttattggaccacattgttggggcaagggtagagctttaattgtgggcatttccttatactctggtaatgtgagtcagccacactaccactgttcctgcttgggagcttgtgatcaaatcaactaaagtaggttgatttgaccagctagaccaattgtttttcaacccaggctgaacactgaatcctctgggagcctttaaaatagtgattctctgggcgtcacttctaaacagaagctcatggactggggcctgggagtctgtatttttaagagctctctagggaatcttaggcaaaaccccacccacaacccttcttttcttggcacgcctttctttaccatcagcatgccaaagattcgaaaggctgagatttcaagggagttaggaaggaggagccaaggtaggcactcacttggtttttagtattgttggatacttggggcagactctactaacagaccccctctatatagtcatgcatgttgtcctttttccattaaacaaatagtaatttcagggatatcagaggaacggacatcattcagtgaatagagagatagagatatatagcaattttctctatgccaagcattgtgttagggattacaagaataagcaagaaaagcatgattccctgcctatacaaacattgtaattgagtgaaggtagacaattaaataaacaattagattaaaatgcaggtagtactatcacatgaacattacaagataatgttacagaataatttctttttttttcttttcttgagtcagggtcttgctctgtcacccaggttggagtgcagtggcatgatgatagctcactgcagtctcaatctcccaggctcaagcgatccactggcctcagccccccaccaagtagctgagactacagacacacaccaccatatctgactaaatttttttggaattttagtagagataaggttttgctgtgttgcccaagctggtcttgaactcctgagctcaagcaatcctcccgccttgggcctcctaaagtgctaggactgcaggccaccaagcccagcccagaagaattatttttcattacataaagccgtcactagaagaacatgcttttcttatccttccttccttcctaccttctttccctccttcctttcttccctccttccttccttcctttctttttctttccttttttccttctttcttttacttctttcttcctttccttttttccttcttttccttatttcttccttctcttcctcccttctctcctttcttctttctctcgttccttcctttttcactaaacagtaataagtgcattaccatctgagaagttcaatatgtatttgtgattctattgtttcagacacctgaaatcaagcaataatttatttcaaatttctgactacttaatagcttcttgcccttgaatagcgttactaagttttggctgtgaaaaacattcatccacatgcttaaatcataagcagtattttgaataatcgaacattccaaattatttgtaacaaaattgaataacatcaaaattctggacttaattactgtattgagattaatgtaattctaattataaaaaattagtgtcaataaaactgctgaacattaatttgtacccagtagtctcttgttacataagctactggccttatggtatagacaggcagatcacgaggtcaggagaccgagaccatcctggctaacgcggtgaaaccccgtctctactaaaaatacaaaaaattagcccggcatggtggcgggtgcctgtagtcccagctatttgggaggctgaggcaggagaatggcgtgaacccgggaggcagaacttgcagtgagcccagatcgcgccactgcactccagcctgggcgacagagtgagactccatctcaaaaaaaaaaaattccaccaaaagaaaaaaaatgtacacaggaaattcacataattttttgtattcagtgatgacagtgttcttttcttctttttgttatgagtatattgtgaaaaataatgtctcttttgatgtcttccctcctgtcaacccgggtatggcagaaaccaaaaacagaacaagaaaaaacccaacctgttgtttgaaagagtctcctggggtgaaggacatgtacatacgtggtgattgttacatcaagcaagtgctaaaaagaaggagtcaggagtaatggcaaagacagccctgtgtctgggtagaagcaaaaagaaggaggacaatttcaggctacatgaatgccacatgagtttagtatcagttctaaagtacgaattaaccggatgtggtggcgtgcacctatagtcccagctactcaggaggctgaggcaggagaatcacttaaaccctagaggtggaggttgcagtgagccaagatcatgccactgcactccagcctgggctacagggctagactccatctcaaaaaaaagaaaaaaaaaaaaagtaccattggagaaacacatggaaacagactctgatcatatgactattttagtaaaaaccattaaattatggccaggtgcggtggttcacacctgtaataacagcactttgggaggctgaggcaggcgactcacctgaggtcaggagttcaaggccagcctggccagcatggcaaaaccccatttctacaaaaaatacaaaaattagctaggtgtgatggcaggcacctgtaaccccagctactcaggaggctgaggcataagaatcgcttgaacctgggagctggaggctgcagtgagctgagatcggccattgcactccagcctgggtgacaagagcaaaactccatcgccaaagaaaaaaaaagagctaaattaggctaccaagaaaagaaagccaagtatagcagctgaaaatcttcagtttaaagggaattacttgccatttggctgtcaagcctcaaagcagcagcaaggagagctggcacatctgaagtgcaaagaacttcagactgtgagaggaaggaagcaggccaaggtgaagccaggtgagaatccaccaatcccagggaaaacaactgaggaagatgttaaaacaccttattcttctttgtcctcactgtggttagtattttattccttgaaatcacatttagagtctaatttgcttcacgtttacactattgttttaataataaatgtacttcatagacaatattgagcttgtatgatttcaacttacaattcttcaattattaactctagagaaaaacaaaaactcagccacttacatatgtcagacacactatagcatccagaggaatttatacagaattgcaggcacaatgtctctggaggcaaaaatcagtctctttggtttgcaatttgccacactcagctctagtttagacatgaaatttttcactcaattcagctagtcaaatttaaagatttctatctttatcttttcttaggagtgaaaaatttcccttctctcaccctctctgactttgcttagaatatcttatatttaatatttttcctgtttaataaagttaatattataattaacaactatgatagaaatttatctattttacaagacttactccagaaatagcatagctaagtggtgatttggagatcatctgaaggttaccaaatctgcactaaataaagatataccacactatggcatcattgctgttctacaaatcttaggaatctcttacttttaatattgtgctctgtccttggcatttcatttttattatttatttattttttttgagatggagtttcactcttgtcaccccggctgaagtgcaatggcgcaatctcagctcactgcaacctttgcctcagaggttcaagcgattctcctgcctcagcctcctaagtagttgggattacaggcacccgccaccatgcctggctaatttttgtatttttagtagagacagggtttcaccatgttggcctatctggtgttgaactcctgacctcaggtgatccacccacttcagccttccaaagtgctgggattataggtgtgagccaccgcacccggctatccttggtatttttaaaaaattatctgtaacaggcaaggtaaacggattttttttttcttgaactgttattttaagttccgggatacatgtgcagaaagtgcaggtttgttacataggtaaacgtgtgccgtggtggtttgctgcacagatcaacccatcacctaggtattaagcccagcatccattagctattctccgtgatgctcttcctcacccacccctacccccaacaggcctcagtgtgtgttatctcccactatgtgtccatgtgttctcatcattcagctcccacttatcagtgagaacatgtggtatttgattttctgttcctgtgttagtttgctgaggataagccttccagcttcatccatgtccctgcaaatgacatgatctcattccattttatggctgcataggattccatggtgtatatgtaccacattttctttatccagtctatcatcgatgggcatttgggttgattctatgtcattgctattgtgaatagtgctgcagtgaacatatgcatgcatgtatcttcataatagaatgacttatattcctttgggtatatacccagtaatgggattgctgggtcaaatggtatttttgcttctagatctttgagaaattgccacactatcttccacaatggttgaattaatttacactcccaccaatggtgtaaaagcatccctttttcttcacagtcttgccagcatctgttgtttcttggctttttaataattgccattctgactggtgtgaaatggtatctcattgtggttttgatttacatttctgtaatgatcagtgatgttgagctttttctcgtatgtttattggccacatgaatgtcttcttttgagaagtgtctgttcatgtcctttgcccactttttaatggggttttttttttcttgtaaatttaagttccttatagactctagatactaaacctttgtcagataaataaattgcaattatttttctcattctgtaggttgtctattcaatatgatgatagcttcttttgctgtgcagaaactgtttaattagatcccatttgtcaacttttcctttcgttgcaattgctttcaatatttttgtcatgtaatctttccctgtgcctatgtcctgaatggtattccctaggttttcttctagggtttttgtagtttcgggttttacatctaagtctttaatccatcttgagttaatttttgtataaggtgtaaggaaggggtccagtttcaaatttctgcatatggctagccagttctcccagcaccatttattaaataggaaatcttttccccattgcttgtttttgtcatgtttgttgaagatcagatggttgtaggtgtgtggccttatttctgggttctctattctgttccattggtctatgtgtctgttcttgtacagtagtaccatgcagtttttggttactgtagtcttgtagtatagtttgaagttgggtagggtgatgcctctagctttgttctttttgcttaggattgtcttggctatatgggctcttttttggtttcatatgaattttaaaatagttttttctaattctgtgaagaatgtcaatggcagtttaatggaaatagcattgaatctataaattactttgagcagtatggccattttcacaatattgattcttcctatccatgagcatggaatttttttccatttgtttgtgtcctctctgatttccttaaacagcggtttgtagttctccttgaagaggtcttcacttctcttgttagctgtattcttaggtattttattctgtttgtagcaattgtgaatgggagttcattcatgatttggctctgtgcttgcctgttgtggtgtataaaaatgctagcaatttttgcacattgattttgtatcctgagactttgctaaagttgcttatcagtttaagaagcttttgggtcaagacaatggggttttctagatataggatcatgtcatctgcaaacaaagataatttgatttcctctcttcctatttgaatatcctttctttctttctcttggctgattgccctggacaaaacttccaatattgtgttgaataggagtggtaagagagggcatccttgtcttgtgctggtttccaaggggaatgcttccagtttttgcctatgctgcatgatattggctgtgagtttgtcataagtggctgttattatttaagggatgttccttcaatacctagtttattgagagttttttaatatgaagggatgttgaattttatcaaaggccttttgtgtgtctattgagataatcatgtggttttcgcctagttctttttgtattgaaccagcattgcatcctagggatgaagctgacttgatcgtggtagaaaagctttttgatgtgctgctggatttggtttgccagtattttattgaggatttcaacatcaatgtttatcagggatattggcctgaagttttattcttttgttgtgtttctgccacgttttggtatcaggatgatgctagcctcataaaatgagtgagagaggagcacctccttttcaattttttggaatagttttggtagatatggtaccagctcctctttgtacctttggtagatttcagctataaatctggtgaatagactttagaatagagacttcaaagtaaatatatgaagtggctggggtaaattcagtaagtacagactgtgtcacatcacaagccctgcccatcctgagggccattcgcctctcagctccagaaaattgttgtcatgttggaatgctcagtggaatctgaccttccaattgtctaaggaaagccaaagttctggattttatgcaaagtatctgtggttttaaatgctacctaaaaatttaaaaatggatacaacaagcaaactagattggcagcctggatgtctcattagtatacaatctcaatagttttccaagtgtttctacacactttattccaaatgatcctcacaccgactgtgagatgtaaacagggattcattgttccattttagagaagagaaatcagtgactcagaggagatgagcaactcatctaaagtcacagagacagcaagtgatggtaacagactaacttgctggtcctttgaacctgctacaccacatccttacaactaaacttctctgaaacaaagacaagggtccacaggcatcaaaaaggatttaggtactgggcacaggagggaaagcatgtaggatggatggagactcttgtgagtcataaggtgacagatagcaggaagatgtgtgctctttcctgaatgtatccctcaaatatgatagaaagctagccgtcggtgataaaattacaggaaatgaacaattctattatgctaggttccaaaaaatgcaagagaagggtttagtcacatgcatattctagaccttcaagaatcaagtttcagaatgtttcagggggaaaaagctatgataatatgtccagagattcttaaagcagtcatggctcaacaaagttgggagagtttaagtgccaaattctgatactaccatcacaaatagttgcagtatgcaagaaaatgaagaatcagttgaacagtaaatgtgactacataaagatttcagagcaggtgagtgcagtggcttacacctgtaatcccagcactttgggaggctaaagcgggcagatcacgaggtcaggagtacgagaccagactggccaacatagtgaaaccccatgtctactaaaaatgcaaaaattagccgagtgtggtggcacgtgcctgtagtcccagctacttgggaggctgaggcaggagaatcacttgaacctaggaggtggaggtttcagtgagccgagaccgtgccattgcactccagcctgagcaacagagcgagactccgtctcaaaaaaagaaaaaaaactcagagctttgaagtctatcataaaagaaaggcatgaaatcaaagtaattgcagcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatgttctcactcataggtgggaattgaacaatgagatcacatggacacaggaaggggaacatcacactctggggactgttgtggggtggggggaggggggagggatagcattgggagatatacctaatgctagatgacgagttagtgggtgcagcgcaccagcatggcacatgtacacgtacgtaactaacctgcacaatgtgcacatgtaccctaaaacttaaagtataataaaaaaaaaaaagaaatcaaagtaattgtccaaaagtcttacttattgaatgagcagggctttgtctaaaaagaaacaaagtgggaaaaataaaaatggcttcttggcaaaatgatgtgcaaaatagaacaagaaaagaggaaaattgttgtctgtagcagataatttaaatgtttgtagataagtaagacaaagcagaatgatttgaagcttactttacccccaatttctttttttgttgttgttgttttgagacagagtttcgctcttgttgcccaggctggagtgcaatggcatgatctcagctcactgcaaccacctccacaacctgggttcaagtgattcgcctgcctcagcctccagagtagctgggattacaggagcccaccaccatgcctggctaattttttctattttcagtagagatgcggtttcaccatattttatccaggctggtctcgaactcctgacctcaggtgatccacccacctcagcctcccaaagtgctgggattagaggcgtgagccaccatacttggccctttacctccaatttctatattcaaggagaataatcttcagacaatacccagatgattaatctatgtgatgaaaacatacaggtgcttaatacattggaaatggtgaattgatgtgcggtccaaggcatgggaggagctggtgagatcactgactctctgtagaagagttaacatttctagtttgagacaaattacagccctacatactgaaatgactacagacatgattactaagaaacaccaagaagaggctgacttgtcaactaacaagtatttattgagtggctgctgtatgccatgctgaaagaaataaaaactcaagagtgaggaaggcagatggagttcatgtcttcatagagttttcattccactaaactagatagtaaaaaaaaagtacataaacaaataagattatctcgggcacttagaagtaaaaaaatatatttatggtaatgtaatagaagatttgacggggcaatcactttggctaggttggttagggaaggtctttgagaaagtgacactcaaattgagacttgaacaatgaaaaggaagtagttttatgactctatgaaagtattccaaactgcagaaacagcaaatacaaaagtcctgaggcaggaatgagcttggaggatttcaggagctgaatgaaagctagcatggttagagcccagtgagtgatgggagactagaaggagacacagtcaaagtgctgggactagaccttaataggctccaatgaaaagattttattcttgttataatgggaagccaatgtagggttttaagcaggggagtgacatggtgtgatttacattttagaaagttcactatcttactgtgtggataataggtaataagggaacaagagagtagtcaaaaaaagccaaataggaaactgtttcagtagtcattatggattggtcgtgtccctctaaaatctatatgttgaagttgtaactcctagtatattataactttattaggaaatagggactttatggaggtaatcaagttaaaataacctcatcaggatgggcttgaatccaatatgactaatccacatccagtataatgccggcaggcacacaaggagaacactgtctgaagaggaaggcagacattagggtcctgcttctacaggccaaggaataccaaaaattgccaggaaaccaccgggatctaggcaacaggcattctctctcaacactcagaaggaagaaaccctgccagtaccttgatcctgaacttctagcctccggaactgtatggttcaaatcacccagcttgtgatactttgttatggcagccctaggaaataaatagtccagaagtgagatgatggtggcttggagtaggattatagcattaggatgggagagatgcttggcttccacttttttggaagaagattctacaggatttactgataaagtaaatgtgagaagaattaaggatgactcctaggtttggtatattagcgaaccgatggatgatgccttttactgagatgggggaagtttgtgaagcaacaattatttgctcagtgggagaagtgagaaatcaatagatttgtttaggtcacataaagtaagatgtttattacatgttcaaatgaacatcttatcttcacagttaaatgtattcatgtgaagttggtgggtggtggtgattgggtggaaatctgggctgggctggagatataaatttaaaagttatgaagaaatatttcatatatttgatattcaagtatattcatattaatattcacatactttatattcatattaatattcacataccttatattcatatttttcaaatatgaacaagtatttgttcaaatcaggacaggtatataaaccatgtgatgagatgagtgagtgtagacatacaagaaagccaagaatttggtccctaggaactaaagcattcagtagcctaaaaatgagctgaaaaaagagaaaaagagttagtctctgacatatgaagaaaacaaggagtttttgtgttattttagaagaaaatgaaagtatttcaagaaggatgtagtgataaaatactggagagggttccagtgggttgaaaactgaaaatacatcattggactgcaagatggaagtcattagagattttaacaagcgtcacttctgtaatgatcttgacaagaacgcaaccagagtgggctgaagagaatgtgggacatggagaggtgtagacagtgactgtaggaaactcttttaggaatttttctgtgaacagtggctggaatggagcaacagatgaagagggatatgaattcaaaagaatggggctcaagtttgtgatattaagacatggcatggttgctgaagggagtgatccaacaaaaaaagataaattaatgatgcaaaataaaaatgataactttaggagtaaagtctttgaaaagatgaaaggggatatgcttgttttaaaatgggagcaaagacatgtcctccaccatactcaagggaaagcagtgaatgtggccaaagaggcaggtgatttgttggaattgggggtgagacaaggtgaaagacatgatggcatctattttattcatgaagtataaggtgagatcagtaaaggatgacaaagatttggagacagagaataagctgtcaaatagttgtctattcacaatcagagtagaaaagtgactttactgtggaagtatattgaaagtgtctgattgtgttagatgctcatttggggtttatgatcatatattttatgtgacctcagttagcagacaggtgtatgatattctccaaagtgggtcaggtgttcaggtgcagatgcaacatacatgactagggagtgacaagactgaaagacacaggcaagtaaccacaacaatttaaaacgagagagctccaagtttctgaaagccccccaaaacaatgggattgcacgttaggccacctgctagctatatcctagacccagacattttccagtggagaggagagggtgacggaaaacatttccatagagggcagggcagtggggagtatgacgtaaggtcagagtcacctagggatttttaaatccacacttgctcactccccagtgatgctgagaaacagcaccccatgggaggtatggagctaaaatggaaaatttttcttttagtggacattactattgatgggaatgggccaaatccttagagtagatggaatagaaagacaaattgtgagtgactggcacagttcatacactcctagaagataaagaagtaggcagaaggacacagcatgagctcagtaataaaaagtcaaaccaaacttctcacttccttttctcagtgcattaaaagactgacagagcagggcaggtgggcaagcaagaacaaagattttgttcttgggaataggagagagagatgtttagaaataggtggaagattattgagtaatattaagggtccaactgatgttgaaagtcaggcatggcagtaatctgcattcttcagtaatgctctccctcagtcctgaagagcatagacataggattagaaaatgtgggctgagcgcagtggctcatgcctgtaatcccagtactttgggaggccgaggtgggtggatcacttgaggtcaggagttcgagaccagcctgaccaacatggtgaaatcccgtctctactaaaaatacaaaattagctgagcatggtggcaggcacctgtaatcccagctacttgggaggctgaggcaggagaatggcttgaactcgggaggcagaggttgcagtgagacgagatcatgccacttcactccagcttgggcaacaggagtgaaactccatcaaaaaaaaaaaaggaaaggaaaggaaagggaagggaagggaaaggaagggaaaggaaaggaaaaatgtgatcttgactttggaggcctgcccagtgtgttggaaaaatctagggaggaagaagtctaaggtcctagtgaaaagactgaagtgagaagtgatgaacccagggaacgaggtaagttgagggaaggaaaggaggcgagggctgggcgcagtggctcacgcctgtaatcccagcactttgggaggccgaggagggcggatcacaaggtcaggagatcgagaccatcctggctaacatggtgaaaccccgtctttactaaaaatacaaaaaattagccgggcatggtggtgggcacctgcagtcccagctactcgggaggctgaggcaggagaatggcatgaacccaggaggcggagcttgcagtgagccaagatcgcgcggctgcactctagcttgggcacagagcgagactctgtctcacaaaaaaaaaaaagaaagaaaaagaaaggaggcaagaaggagactctttggactgagatactagggcagaaagtgcagccaccaaccaaaaatcttgttggattgaagagctgctgtgaagggaatcaagacatgggtgacatggcaggagtatgggttgtggtcatatagtgggaggacagtttttcacgtgggtttcctggagaggaatcagatgtttctgaccattactagctgtgtgccagcctaggaagttcattcttaagtctttcagaagtggaagaaagcaggaaaattgcttgctaaattacccatgaaagtcaaaaccattcttccttagaacttttgaaagcgaattgtcactaggacatatggggcttgatctggtcaaccatctcatgattttaaattttcatttgggatttttatctacctcttcatagcagagcaaaacaaacttgtctttttcccataaatataattaaaaaagagacaggctgaggatacccaccaatgggtcactctaggccctatcaaagtatgggatcaggatatgaagtaaatcccattaattgctgtaattgatagctccaaaagggagtatggcatacaattagaagttcccaaaagtttgctactcccctggagatgttataaaatagaatcagggttattagcccacattcaagcaaaagcttgtttaaagtggggcattttctaacttcttctggatagactaggcctctcttcacagttttgttaaatttagtgtttcatgaaacttaccaaggcctttaatattatgtacgtgcctttaattataagcacatatttcttctctattgcaagatttctcctgaactttacagatctgtcagtgaaagaggaaacttggataccacatgtggaaataacaaaagtgggatatgaacctcaattaactagcacataaagagtgctgttccctgaaaaaaactgttggattcatttaggtaatcatcgcttgatgaatgtactcttgctagtgtaaccttcttattaccatggagttacaaattaggtctgcaaaagacatctggaaacatctggccccttctaaagcaataacattccagtgtgttttttgacatactatgcagactcttccaataattctggatcttacacattgaaagctctcaagcgaaggtgctagttagatttttttaatgctttatttcccccaaaatagcaatcaaataactggatatacacatttccattttataatcactatcacactgtaatctaattacttgtttaaaagtgtgtctcctcactagattagccccttagagaacaaaacatgtatccatctgtgtaacttccttatgaaactacaggtatgtgctggaactgtatcctctacaaacaagagtactaataggtgagtagctttctttaagaacatttattgcagtattgttaaaatggcagcaaactggaactaaaccaaatgtccatcaagtggggaataattttaaaacttataataaatctatagatagaatattatttggcttaaaaaaaatgagttagagctgcatcagttgacctggagagatgtccatgatatattgctccatgagaaaagcaactaacaaatggaattatagagtgttattccaaattgtaaaagtaaacaatgacggcttgtgaaaaagataggtgtttatgattgtgggagaatattcataatgcactaacaggggttaccttaaggatgatcaggaattaaggtaaatgagtgtgggagaatagtgctagcaaaatgcaaaaatactcatgccataatgctaagggaaaatgcagaatgcatgattttagcaatagtttttttaaaagaaaagtttacctttcggtgtcttactggttgatgccaggcatagttcttaaagctctacatagactgtttcacttcctgcccgcaccaactctgtgaggtagggattattatttctttaatttcacataacagaaaactgtggtccatagaagttactgagctggccagtggtcacacaataattggctaagctaagacaaaataataacaggcaaataggcaaaaaatgaaattgcatttttttcctagaaactaatcagatcaaatgaaaagtatccatttaattaagtaatagacctgtggattattttttgcctcgaatttttgctattatttaatattacttcatttaaataaagtaaaattactaaaaataaatacaataaaatggctagtatggtggttttcaaaacctgtcctcaagtcctttgatgtgggaggtctgtgtttcttccctttgaattaggtggggcctgtgactgatggctctgggcaaccacataggagaagcaacattttgtgcttttggatgctgagtcaaaaaaggtaatacaacttcttcctggcttcctttttgggaagcttgctttggaggatgccagccaccatgaagtgagtctcatacagagaggaactgaggccccagccaacaggcagcatctactgtcagacttcagatggtgccagcctctccctagctttggaatcttctagctgaggccccagaaatcacagagcagagacaaattacgccaactacactttgtctgaatcttcagtgagcataataaatgtctgagtttttgtttgttgttattgttttgtttatgtttggttttgtttgttttgttttgctacaaattacatagcaacagatagctggaagagattctgcagtgatgttcgtcagtttggggtaggttttcccttagttttattcttctgctctctttaggcatattgtggtggttaattttatgtatcaatttggctgggccacagcacccaaatatttggccaaacattattctatatgtttctgtgaaggtgtttttttttatgagattaatatttaaatcagcggactttgagtaaagccgatgacattccatgatgtggatgggccttacccattcagataaaaatcttttttttttttttatactttaagttttaaggtacatgtgcacattgtgcaggttagttacatatgtatacatgtgccatgctggtgcactgcacccactaactcgtcatctaacattaggtatatctcccaatgctatccctcccccctccccccaccccacaacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattctatggtgtgtatgtgctacattttcttaatccagtctatcattgttggacatttgggttggttccaagtccttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttgtgatttgcatttctctgatggccagtgatgatgagcattttttcatgtgttttttgtctgcataaatgtcttcttttgagaagtgtctgttcatgtccttcgcccactttttgatggggttgaatagaacaaggactgacctctccagcaagaaggaattctgccagcagattgaactgcaactcttgcccgatcttcctgcctgccacctacctcatcaggttttggattcaccaagcctccagaatcacataagccaattatgtcaaaacaaacctttgtttgtcatcattgttttgtctgtgttttggtttggtttggtttggatgggctcaagtgatcactcttcctcggagccaatccagttcaattaagttcatttcccattgctacccctctaattttctcaccttgttcagcacacagaagagaaatcttacttctgctatgacaaggctgcctagatttggaaacataaaatggcataacataacctctctctctctctctctctctctctctatatatatatatatatatatacacacacacacacactctctctgaatagcacacatattacacacattatacctttaactctgcttcccaaactactcaccagttgcgcctgcatccaaacctcattgtagtatccaaataaatcacttctgtttaagttattatatatgtgatatatttaagaggtctagaaaagagactaatagtagcatagagtcagtcttctaaacttctttctctctcttaggacaaaaattggaagcaatatgcagccatttccaacaaatgagcagcccacatattagatggcaacatcaaggatagaaaactttaggaagataaaggcctgggaagtagattagctgtggctttcgcctggatgtggcttcatggagttacatatgccactgagaattcccgagtgacaaagtgatcaaatccaggcaaaggaaaaaaggaaaggtgcagcttacccctcgaagcagtgggcaactgtcagaacccacttcttggcaatgaggacacagccacagatatgtccactgggttcactctgcagagaacactgccatggccaccttccagggcgactcgtccgacctccaaggatccttttgttcattcgggcagcagggcggcgcccacagtctaccaaggagcagaagacacagtttgtgagttgatgccaaaccttgctaaatgcttagctctttgctgtcacttacaagcgatcactcttcccctgagccaatccagttcaattaagttcatatcccattgccacacctctaattctctcaccttgtttagtacacagaagagaaattttacttctgctctcacaagactgcctggatttggaaacataaaatggtataacattaagttacatatttcttgttcaattcaaacactttaccagtgaaatacaagacagctccaactgttaccaccagaaatcacattctctgagcatttcctgtgttaccacaggaaagcacattcctcttggtgcaggaattctcaaggcaggagtgtggtcagatattaatcatgttgtaggcaggagtatatggaatatatatacttctttttttagtttatttaatgtcatcataatttaatttcacatttgtgggaaaagaaactattttaacaaaatttcccacatcattttggctggtggaaccaccacaatgcaaattcaaactacagttctcaaggggagatgggagtactttttagagtcagtggtgaggaggcagcatgtcagatttttatgcttatacaaagtggtgtgtgctcaaaacaagttgagaaatactccaagatgagtaaaatatgacttcagaaatttgaagaacagattaagaaatggaatatttagactggaaaggagtcttaccaagactctcaaggttaaatttctgctatatgagaagttgacaagaggaaaagtagcttaaatttgcttcatataactttagacgacatgatcagaactagtaggtgcaatttacaagaattgtgggttcaggaaaagaattttctaaaatctaaattcaactttgaatgcaagaacatggtccctgttaaaggatctttcaatgtgatggcacaagataattcagtttggggtagaaattttaatcactaagttctcttccaaccatgaaacatttacattacaacctcaatgtaaatgaaaaaggacaataaaaatccatattgggactttcaaaaatactatgatgtacttagaatcctagatctatcagattgaaaaaaaaaaatgcaaccctaaatatataatttccacattcctttctgaagatttactgtattttcatttcttgctaaatttatgtaggggcaagtgcaattatttgcatacaataaattatgtaatacaggaaaagctcatttgctttctaccctcccacagtctaaaatcctctcttccttactctctattacattattctaaatttatttgcagcacttaccaaagcctaaaattatttttactaatttataatctttattttcacccccatatagtgtatgttccctgagatgagggccttcatttcccctcattcacttctacatcccctcaaagcctaatactgaacttggcattaaagaaatacttaataattagttgttatttgttagattgaaaacacatagctcttaggaataggaaaagtcatcaaagactattcatccaacttcttagtggaaattgcagttatataagataacacttgtagttagtaaaccaggactagaaccaagtttaccaactcccaatctagaatgcattatttatttatttatttacttgacctgaaaggttttttctggaattacaggtttggggaaacaaatcacttggttaaaagatttaggtcattgttttagaggaagtacttcaattgacaaatattcagaaatttggctgcagagtttgttttatgaggaaaatgtcaagaactttttaagaggaaatggtccatttttagttttcctctttaaaattcttaagaagtagcaacatttatgagcttcagagtcagatatatttatttagagttcagacactatcacttagcatctgtgggctgtgagatttgagcaagttatttaaatattcaagctgtaaaatattggataatcatccatggttcacaaatctattatgaggtttaaacgagtcagtgtatataagattacctagctgtgtgcctataaagtaataagaacttagtaagtgtaaatttcctcaatttatcttcctcctacaccccacccatagacaagggaagcaaccctgtttaagatgcaatgattttttagggtaaacttaagtgtactttcaaggcaacttgattataatttcatttttgtgtctattcctctcttagacattccaagttttcttagttatcattacttcagttccctctgtttactagttctatgtagcatctgcaggaaatgcagacatgagggtttattttgaataagatattaaaagtaatccaagattagaacccaagttcctctctcctcgccatgatagtttctgtaatcgtgaataaaagagaaaaaaaatctatgtctagaaagaagaaataaaagcaaccaatgttgaaatgtaaaggcaatagtaaatctatggaaactctttactgatatgacaaatttggattatcttaagttaaaaaatggaagaaaggcccaatgataaactcttgctctgtaatctgactctacacagctcttatgaatgcattcttacccatttactagaagttcatgtaaagtggtcccattgaggctctcccagttggagtgtaatgtcagccaccgcggctctttctcctgttcctgtatcaatttggtcacagatggttctctgatacaaggcaaatactggataagtattcaaagtacaatgatctttgaacaggcattatcattatttagcactcattccctttcaaaaagaagcactaaatcatgtcaacatttcaagaggagaatttggactgttacaaattgttagagctgttttagtcattctccctgctgacctgtgtttgaactgcatgaggtgttaggattataatgtgtatgatacaaaagttccaacaggtaaaacataagaataactttaggcagagatcaaaagtaaaataaaatgtatctagctaggtttttttcctcctcttttcttgtccattgtaattctgcaatatagcaatataaaataaaataaacaacacataaagagaatcagtggccatttagcatttatttagacagcataaaagttgtaagaattgtaatatttctatgtttgtaggttgttgttgttgttgttgttgttttttttttgatgaagtcttgctctgttgcccaggctggggtacagtggtacaatctcggctcactgcaacgtctgcctcagggttcaagtgcttctcctgcctcagcctcccaagtagctgggatcacaggtacatgcaatcacgcccagctaatttttatatttttagtagagatgaggtttcaccatgttgtccagggtggtcttaaactcctgacctcaagtggtctgcccacctcagcatcccaaactgctaggattacaggcatgaaccatggcacctggcctcatctgattattatttttaaactattgtaatcacataatagaaaatggacaaaaacttcccctaactcatacttttaaaaaggcaaggaagaaccctctaaagggaatacttgatgatagaataagagccaaagattaaaaacacaagagtatttcataatgaatgaattataaacatttgattttaaaacaaatgtcatacatcctagccacaatgaagaagagtggcttaagatataaatttatttagaaatttgaattgactgttagattaccgaagatatcaaaaaaacctcttacaaaaataagaatttttctttttcttggccaaaatgaatccggctctccatcaattccagaagttctgaatgcagaggcaaagtgagatggaaagtataaaagtcagaggccacacatactggtcatggtgtttctcctgataacctgcatcctgagaattcccttctgcgatagaactacctatggacctcctaaatccaggtaaagccaaaagaagataaactttagattttgttatttaatcaggtcattcttaaatcaggtattcatagggcaacaagatacttgcatggggagtgcaattaggagagagtgtgcactgatgctggataggaaaatcattgcaaggaacaccagcctttcaactcaaaaggcccccagctgccctgaggaagggctccacagacatccacaggatgtttttgcatttcattcattagcttccaagaggaaaggcaatctagatggaatttctcagttataagtggaaaatttaagaaattaatcatcaaggataggggagtatcattatgaaaattaggtttccatgaaattcttgaacactggcatgtttctcatgcacaaacataaactttcagcaccagaaatgtcatccaatggcccatttaaaaaagtcagtgaatttgtttggttgtatttctgccatcgtacagaatctgagcatctccataacttcaatttccctttcttttttttccagctttattgaggcattcttaacaaataaaaattgtacatatttaaggggtgtaatgtaatgtttgatatatgtataccttgtgaaatggctaccacaatcaagctaagaagcatatctatcaccacatagttacgtgtgtgtgtgtgtgtgtgtgtgtgtgtgtgtgtgttaagaacactaaggccaagaatcttagcaaatttcaagtatacaatttagcatcgttaactatagtcaccatgttgtacattagatctccggaacttattcattccacattaccaaatctttgtaccctttgaccatctccccattttctccatcccctagtttttggcaactaacattctactctctgcatttacaagttgacttttttagattccacatataaatgagatcatgcagtgtttgtctttctgtgcttggcgtatttcacttaatatgtcctccaagtttatccatgttgtctcaaatggcagaatttccttctaagaatactgagtagtgttctattgtgtaaagaaaatgtagtgtgtgtatgtgtattctttgcataaaatttctattgtataaagaaatatatattctattgtgtaaagaaaatgtggcatcacattttctttatccattcacttatcagcaaacactgaagttgttttcatatcttgggtattatgaagagtgctgcaattaacatgagagtgcagatgtctttttgagataattatttcctttagatatatacccagaagtgggattgatggatcatatggtaggtagttctattttaaattttttgaggaatctccatactgtttttcataagtactgtaccaattaacatttctaccaagaatatatagggtttccccttctccacttctccccaacattttttatgttttctctttttgatgataaccattttaacagatatgaggtgacatttcattgtgattttaatttgcatttccctgatgattagtaatgctgagcaccttttcttatatttgttggccattctatgtcttccttttagaaatgtctgttcaggtccttagtccacttttcaatcaggttatttggctttttgctgttgaattattttagttccttatgtattttggatactaacctcattggatatatggtttttttaaataactttgaaaattataaaagtaatacttgtacacagaaaaatatatcgacaattataaaatgataaagttgttttcttctcctatcatatcaacaattataaaatgaaaaagttgtcttcttcctatcttagatgcatagaaacaaccactgtaaatagtgtttgagtatctttgtcaagctctttctacaattcatgtatacatttccctcctttgctacacacgttgttctgtgtggtcttgatactttcacttagtgacttatcttagaagtctttccaccataacagctaacaggtgttaactgttttctatatgacaagcactaaaagactaacttgttttatttaatcatctcaacaactctgtgacgtagactttataattatttcccattttggagatgaaaaaattgaggtagagaaaacaagtaacatgcccaaggcacaaaacaagcagacggcaaagctggtaatttaatccctatggtctcatgtcagagtacagttcttaaagtgtgaaccctacacagttctcccccattgacagcacaccatgttcttttgatagctgcatagtgtttgttacatggatgttcatacatttacttaactaatctctgcacacataggtttgggggtatgataaaatagcagcagttaatatcgtaaacattcaccttcgcctacatgcaaaagtatgattttggaataaattcctagaaataaaatcattgaatcaaaatttgaatttttgattggtattatgaacttccatttcaaagaataatagtaatatacatgcacatcaagaatatgtgtgcctgtacttctccatttttaaaactatgtaaatcatcttacgtaaaaggtggctggaacttaagagctgctcaaattttgtttgatgattgggattgcttttgacttaaataattgaaaccgttttgtattatatgaaaagacaaaaaagtcctgttgtgtagaaagcaaaagagaaaatttaagcatcaaagtcactgtatcctaactgagtctgtgcaggtaatacagactcaaaatgcttccatagcatctatggattcatacacggagaaggaaattttagcaatgatctaatccagcagctagggcaagagtaccagtggaggcccaattgccatttgtctacatatttagaagttataaatcaagttatcaagctgttaaagaaaatttctctcctcctctcttgacaaacacatctgttaggttcaaatacagaactcttggactcctgagaacagtgggtttcaaactttagcattcatcagaatcacctggaggacctgttacaacacagatttgttggcctcatccccagattttctgattcagttaagtctcagatgggacccaaaatctgtctctctaccaagatcacaggtgatgatgatgatgctggtctgagaccgcactttgaaagcatcactctagaaaagggatgaggctccatgtgagcagaactccttggctaacagagtccttaccccatggggtgagctagaggaggagggccggagggtgcctataaatcagggtttctcaccctaaatgctattgacaagttataccagttaattaattgctatgtagagtgattcctgtgcactgcaggatgttttgtaacatccctggcttctacccactagcaagtaagaccccatcaaccctggatttacaatttaaaaaataatgtctacagacattccaaatgtcccctaggacaggggtccccagccccagggcccctgttaggaaccaggccacacagcaggaggtgagtgcggggcaagccagcaaagcttcatctgtgtttacagctgctcaccatcacaggcattactgcctgagctccgcctcctgtccaattagtggccttagattctcccaggagtgtgaatcctattgtgaactgcgcatgcaagggatctgggttgcgtgcttcttatgggaatcaaatgcctgatgatctgtcactgtctcccatcaccctcagatgggaccatctagttgcaggaaaacaagctcaggtttcccactgattcaacattatggtgagtagtataatgatttcattatatattataatgtaataataatagaaataaagtgcacaataaatgtaacgtgcttgaatcatgccaaaaccattccccccatcccatcccagtctgtggaaaaattgtcttccacaaaaccagtccctggtgccaaaaaggttggggattgctaccctaggggcaaagtcacccctggttgagaaccactgctctaaatcatggagcccagggcaaggcccctctgctctgggcctgaaggcagtgctatacagagaagcaaaaggatttgccttatatttgcttcttgaggaattgtgtagtcataagacacacatacaaatatatcacttttctgatgctgaaatgagagaacagagctcattaggagttctggaacatcctgacattatgagagggattaaatatttcaaggcttaggagaacagccagatccctagacaatttggcctactctcccatcctcaagtcacttcgtttagtaataaatatcccatgcttgaattatgattatgttggggctgcttacttaaaaaacgaaggtcatcacaaattcccccaaaaccagggcttttttcttacctctaacaacaagacagaagtgcaggaattacctagacatgtaacacacttcagttgaaggataaggtttgtcctcttccatctattgatgggggaaaataatctaagcatccagcctcagtccttgacagttcatcttgacatataaatgcctttcacagtggataagataaattttttgcaattctaaatatcctgttccaaacttgaaacatttatactaaacattttgtatctgatttcaaaaatctcttcttgaatcttgtcatattctccctgtttgggtcccacagatttgacatactaataactgaaagttattgtgtcaagtagaaattttaacaggcaggtactaataggtttcaaacaaaacatgaatgaactctgctacagaaacatttctcaggctggatagctcagttcaatgggagtttatacagcaaaactttcatcaatagaaatgcttaaagcagagcataagttctgagcttatttttctagttaactcagtattttaaaaacactttttattgcaatcctaactgacaatagatgatagatagatagatagatagatagatagatagatagatagagatagatagttagatagattttttttttttgagatggagtctcactctgtcgcccaggctggagtgcagtggcgtgatctcagcttactgcaacctccaccttccaggttcaagcaattcttctgcctcagcctcctgggtagctggggactacaggctcatgcgaccacgcccggctaatttttgtactttttggtggaggtggggtttcattatgttgcccaggctggtctcgaactcctgacctcaagtgatccacatgcctcagcctcccagagtgctaggattataggcgtgagccactgcgcccagcctataattttattctttgactatgtgtttgtctatctcagagatggagtgtagtaactgtattaggcaaggatctataggtacaaatgacaaaactatctcaaagcaaaggggggaggttaatggatcataaaattaacttgcagagtatttatatttcataaaataaactaataaacaaaactaaatatttaatccatttccaatataaaaattacaaaattgtaatgtgaactaaaatttaaatttataaaatatgactgttaaatatacattatcattctaatataaattagaaaacaaaattaataaaataaagcaccatttaaaataaacatcttattaaaagtgtaaaaataatcaatcataaacattttgaatgaaaatatcatttgaacatatataaaattcagtcttataaaataaacatgttgtaagaatatttttgagcagaagtgtctacctcttttggaatctatgccagtccagatatttccttctggctattttattttcaaaaatctcatctccttttttcgagaacttgaccttttgggacaacacttttttttgagagacagaaatgcaacattttattgacaatttaattttagtttcaaagaaaatatttcttgtttatcttcacatcttttgtttcatcatgtaaagctagagattatcagtttcaatttcaacatgactttttaaattccagttcttcagaaagactgtgaaccagagtagaatgtatttttctaacacaagtcttgctttgttggctgctcttctcttcttcttgagtataacaggaatataaaaatgctttctaaaaatacgtgcatcacttttcacttcaaagttttaagtcagtatataactatatggatccattacaagataaattaattcaaaattcaaaaaaaattaaacaaatattgaattaactaaaaaatcggcattttaaaaatgcctaaaatagtgctggaatatatgagtatcaaaaagtggaaatgtaattgattactaaagagatgtggatggtcttcaggatgattgatgccagggaaccagtaccctcaaggctcttcagctcgtctccacttccttctgtgttgtggggaggagggcaaaggggatggcagcttgattggcttaaagtaacttttctgcaagccaaaggactggttgcctacagctctaaactcacaggcattcgtctttataaccaaaaaagaaagaagtcatctctcccaggtccaatcaaaataaatcttgggccgggtgtggctcacgcctgtaatcccagcactttgggaggccaaagcaggtggatcacgtgaggtcgggagttcaagaccagcctgatctacatggtgaaaccccatctctactaaaaatacaaaaattagccaggcatggtggtgagtgcctgtaatcccagctactcaggagtctgaggcaggagaatcacttaaacctgggaggtggaggttgcagtgagccaagatcacaccattgcactccagcctgggtgacaaaagcgaaactctgtcttaaataaataaacaaataaaaaccttgttgaagatacaaataaaaatcttgttgaagaaacaagtatcccaaaaccaattactttggcctggcagtaagacactttgattggtccatcttgggataggtacctacccctcaaccaatcccagacccaaaagagaaagtcatgtacaaagaaggttgctcccatttggagcccaaggataaaatgggaagtgaagtaaatatcgagaaggaagggatgtaggtcccaaaggaagggaggaatgcagagaagcaacacaatatgtgcccgctgcatgtgatcttaattgaaatgtgttagttcattgttcttgagagtcaagattctacatgttcttcagtttgtatgttagttttaagaagacataggaaatgtaaaagattaggttgaaattagatttgacatgtttattaatgatacaatgggttaatcagtgagtgttcaagctgatataaagtgagttggagctcagaagaaacattatagtgacactttaaacaagtgacagagccagatagacaagggttaaaactgatgcttagaggttaatgaggtgggacagaaatggagacaacagattggtgttgtatcagatggagtccctctctgaggagctattattttagttagaggaacaaattacaaacatgtaaaaaactattttggatactgataagttgttggaataagacaaaataaccaaatgtgatagagttacatgctgagactgaaagctgcctcaagtaggattgtcaaagaaagcctaagtcacagatgtatgagctgagacatgaatgatgaagccctagagttctgtattctatgcaaaaataacggtgaaggaaagtttgaaatgttttatgcttgaaatgttttaacatcaatattaaggtcaatgtgtctaaagtttagtgggcaagtggagaatactaggatatgtattgggtcagagaggaaggcaggggccaaattatgcagtgtctgacaggtcagagtaagaaatcagattttcagtccaaactgtaaaatagtaagaaaagaagaccaaaggcttttgcatgttggtaatattattgctgtcagtcctgtctttcaggtaaaagccagattgcagtaggttttgaagacaacatgaaaaagacaccttatcagaagttaagtcattactaagggtctcctggcatatctagcttcaaaagcagactgcttccttacaagggcttctaacagaaataatacaagccctctttggtcaactcctgatggattattcaagttataaatcatgttcttatttacccaggatccattcatatcatgtccaagacaatgctgcaaccatggtgatgactgggagtaaattttaggaggaagttaaagtgtaaacccttataccagggattattagggactagtaggtaatataatagatgttgtctttgtggttttgcccagatacagaaatattctttgaaaacaatgtttgaccaacttctattgaccaacactaaaagattagggcataaaatcaaattgcaactaactccataaaagcatttttgccaaaatcatatgacccagacacactgtttcccgattatctaactttagataaagcttgtggagcccagagatataaagagtcacctttcccttagactaactcactcaaataccagatgtttcaactgagcatttggcaaatattagaaggcagtctaaactctgatttgtatcatcaattaaataaatgtccataggttttttgatactgaacatgcaagtagcaaagtcaatatgctgttgacatgatttggctgtatccccacccaaatctcatcttgaattgtaactcccacaattcccacatgtcatgggaggaaactggtaggaggtgattgaattatgggggtgggtcttcctgtgctgttctcatgatagtgaatgagttttaggagatctgacagttttaaaaatgggagtttccctgcacaagctctctcttttctgtgtgctgccatccacgtgagatgtgacttgctccttctcaccttctgccatgattgtgaggcctccacagccatatggaactgtaagtccattaaacctctttttttcttcccagactcaggaatgtctttatcagcagtgtgaaaatggactaatacagtaaattggtaccagcagagtggggtgctgctgtagatacccaaaagtgtggaagcaactttggaagtgggtaacaggcagaatttggaaaagtttggagggctgagaagaagacaggaaaatgtaggaaagtttggaactccctagaaactagttgaattgctttgatcaaaatgctgatagcgatatggacaataaagtccatgctgaggtggtctcagatggaaatgaggaacttgttgggaaccggagcaaaggtgactcttgttatgttttaccaaagagagtggtggtattttgcccctgccctagagatttgtggaactttgaacttgacagatgatttaggatatctggtagaagacatttctaagcagcaaagcattcaagaggtgacttgggtgctgttaaaggcattcattttcataagggaagtagagcataaaagttaggaaaatttgcagcgtgacaatgcaatagaaaagaaaataccattttctgaggagaaattcaagctggctgcagaagtaacgaggagcagaatgttaatccccaagacaatggggaaatgtctccaggacatgtcagaggtcttcatggcagcccctcccatcacaggcccagaggcctaggaggaaaaagtggtttcatgggctgggaccagggtccttgtgctgtgtgcagcctagggacttggtgccctgtgtcccagccatgacagctatgactaaaaggggccaaggtacagctcaggatgttgcttcagagggtggaagccccaagcattggcagcttccacatggtgttgagcctgtgagtgcacagaagtcaggaattgggatttgggaacctctgcctagatttcagaagatgtgtggaaatgcctggatgcctaggcagaagtttgctgcaggggtggggccctcatggagaacctctgctaggcagtgtggaagggaaatgtggagtcagagacccccacaaagaatccctactagggcattgcctagtggagctgtgagaagagggccaccatcctcaagaccccagaatggtagatccactgatagcttgcaccatatgcctggaaaagccgcagacactctatgccagctcatgaaagcagctaggagggaggctgtaccctgcaaagccacaggggcagagctgcccaagacccatgggaacccactttttgcatcagtgtgacccagatgcaagacatggagtcaaaggagatcattttggagttttaagatttgactgccctgctggatttcagacttgcatggggcctgtagcccctttgttttggccaatttctcccatttggaatggctgtatttacccaatgcctgtacccccattgtatctaggaaactaatttgcttttgattttacaggcttataagatggaagggacttgccttgtcttagatgagacgttggactgtggactcttgaggtaatgctgaaatgagttaagactttgggggactactgggaaggaatgattggttttgaaatgtgaggacatgagatttgggaggggccaggggcagaatgatatggtttggctgtgtctccacccaaatctcatcttgaattgtaacttccataattcccacatatcatgggaggaaaccaatgggaggtgattcaattatgggggcaagtctttcctgtactgtcttcatgatagtgaataagtttcacaagatcatatggttttaaaaatgggagtttccccacacaagctctctcttttttgtgtgccaccatacacgtgagatgtgacttgctcctccttgccttccaccatgattgtggggcctccccagctctgtggaactgtaagtccattaaacctctttttcttcccagtctcgggtatgtctttattagcagcataaaaatggactaatacagctgccatgagaatttaggggcttgatttatgcattcttctaatcagagagccatcatacttccaatctgggctgaactcttgagatagcaacagatgaaagcaaaaagttttcaaattcaacaaagaactctaaatcttctcatctagacaagcactgagttgagagcctagcatttgagcagcaacacatgaaaggcataatttgggtctaaaacatcctaagtgcaggtgttttaaatcaactgcctctatcatgaaagcatttcagtagaatccctgcaacccatgaaatttgggagacctgcattcttgataaattccctccaaaatataccccctgaagtagaagaatgatccacttggaattagggtatgctggttccggaccctacatacacactacaatgccgttctctataaatgtttactgaatgaacggatgaatgaatgagtgatacaacaaatttatactatcaagataagattaaagttttatgtttttcttgtataattttaatagaaatgccatgttctatgcaataagtctacaccattctctgatggcaaaatatctggacttttttctaactttgtgttcttggctgtttacctacatgtcttccccactccattataaactctgatgatgttattcacttttgcatcctcgacccaatgcctagtccagtacaaggcccataagcagatactcaaaaataaaaagggaaggggaatgctgaatggaattagttgggagttgctttttaaacttcaagtttttgatgcagaatatgtctgaatgtacaaaggcaggctggcataaactccactccagaagctaagaaggaacaccattcccacttccctccttgtgcagcataggccaatcatggccagacaaacccttctagcaagggctttgatctggaggaaatgactcaaaggtgcagggtgacttagagtttatttgaggcatcggtggcagaatcatgaatttgcagcacagcagctggtctcgagagacagtggtcacatggcagctgcctgagcctgttccctcagcaggaagatagcctcatcttgaccattaccatcattcccggcatagcctggctctccagatttctgtcaattcatgagccactcaagtcaactaaagagtaaacttcaaggcaactaaaaagttcaaaaactactagtactcatttctttggaggacttatcaccacttacccatttttcccattaaatcagtcaaataatggatatgggtttccaaccacacctctatctcagattttcctagtccttctgtgaaataaaataatctaaaataaaaagtatctgcatgtctatttgaattttatatatctaaagatatctaaaatactgaagtttcattttccagctatgttgagaaaatggagcaaatggagtacataattttttaaaaatccactgtgcacacaatagccaaaggtgggaataatccaaatgtctgaatggataaacaaaatgtatatccatttaatggcatattattcagtcacaagcaggaaagaagtactggtacatgctacaagacagatgattgaaaatgtgctaagtaaaagaaaccagatgaaaaggcctcatgttgtatatttccatttatattgaaatatccagaataggccaatttatagaggcagaaagcagattagttgttacctggtccagtgggtacgagaaaatggagagtaactgcctagtgagtacacagtttccttttgggataataaaagtgttctaaaacaaagagtggtgatggttgcacaacattgtgaataaagtaaatgccactgaattatacactttaaagtggttaaatggtgaattttatggatgtgtattttaacacaataaaaatcccaatatgcaaatatttagaagaaacataaagaagcatatttaaaaacaggaacctttctatttacaatagaacagctatgttcagggtggcttgtcaaaaggactttctggttgtaaaatctttgcagtttcaaccttataccaataaggttttatcgagaagaaaaataaaaataaccatattcaaaagatttttcatttatctctgaacacaatcataacctatttcatttagacacaataaggaagttgtgagaatgaagtctaatttaatagatcttggcaaatataatttttccactctcacaaagtttaaaattcctttattatagatgagcattagttattcaattcctaaagatgttggtcttcacatgggagaaatggactcaagatggtgggagctgcatattagtaattctttaaactaggataacaaaaatgtgctgctagttgctatcccataactgcatgactcattattgtaaaattgtttcaagtttgttcaatggatcttaggaaatggcatttactcaattttttatttagtctagaattttagaactcctttgtcttcaatttctctaatttctacatttcccccaaatctcaaatacatcaatggtaaaagaaatacttacacattctaagaccctgaaaattattgctttccacccccaatggaattgaaaaagaaaaacctcacaaaatagcaagtatctaactttcaaaggatccatttcagtatatctgtatcaaagccagagtgaatcttttcattctactaagaagcaaatatactgaactatttcttgatttacatttactgccttacttagagtaaacagaaatgccagcaacttcagcttatttaaaaatgtgtgttgcttaagaagaaattttcaataacctcttggggggaaattacaagatattttcatccagattcctcaaaggaaatgattgtaatgcttttataaataatgaaagcatttcattgcagaagtacttaaaatacaattacttcatttacttttagaggcttcatcaaagtacatttccagcacacactcttcagggcaggtgcctataattaaatatggtcctctcacctgattcatttcccgggttttgaaggactctttgtttgagagcactaactctctgtgcatcctaaggaagatattactgccaagttccacaaagccttctgagaaattcatcagtgctacaaactactgaccttaccctaaacccatctgcttgcaggccagctgactcaatatctcctgccagccatctgcacacacatggtgttctgtggcagctctgtgaaccatcagaaaggaagaggagttcacatttatagagagggtcactagggaaagaaaagacaagggaaaccctaattaaaaacatttcttcccatgaaagcacataactttacatgcctctgcttcattggcatacattcattttcatttattttagttaatcatttgatgtgtacctaccctgtgcaaatcactgccttcagtgtgctagagggctaaaaaaaaaatgaattagaaatgttctctaccctcaaagaaccgtagactctaatgaaagagacaggcagttcttaacttttcttaatgagttagaagacagccagagccaggcctcatcccatgagttaaccaggatttgcataattacaagaagcgagttgtaaatctatttctatcatttccttcaagaaagtatacgagaacgcaagtgcgtgagagggatgcaaatttaggattaatttggtatatgtgttaattcctattatataaaggagaatcctctgtacttaaccagcctcagagcacttaggaaacgctgcacaattgatcacaacacacatgagaatcatgatttggctggatgatgcaaaggactgagaaagagctgagtgaatggaaggagtgatgagtgtgggatgaggaaattaatcaaactcaagatcacaaactgcaacactggaggtgctggtaggagatgtctttaattcctgtctgtgtaaggagctagacagttagaagtcttggacctgaagagtgtagggaaggcagaggggccacttgactattctattctagcaggtagaggtgacaaaagaatggcagactatcattaaatttattgaagttgggttttaatgaagagtttttaaatcctctcccagcaattatatgattacaacattttgaacccaaacgtttttccatacaatatagatatttcaaatagagaagtagcttcgtggggaaattttctgtgagttggaaataacacacatagatcagcactatcagcttttataacagtaaaacaaaatagatgaacttggtcagtaaaatccaggaagtaatttaggatccattcagcttcagtggctgacaggcatgagagagtacaacagatggcagaaacaagtagctcaccacagtcccattcatctgaactgtctgagcagtcggcttcaccatcacaccacaggtcacgtgacacacacgcatggtttgcacattccagctcatcatcttggcaaaatgctggcatggggaacaaaaagtgagaaggaaaacattttagaaataaatgtgattatcactaacatgcatatcttcatgtgccagcaggagcatggaaagaagaaaatatgtgatcactgaggcttccaaacgggcataaaaacagaataacataatttgtaaaatatcatttaatagacatcaatacatacaaagagcatttaaacagaattactatgttcaagtgactcaatgttctggttctaacaatcagactgaataaacagtactcacagccgcagaaataccaaagatcagagaacggggttaaaatctgcatgagcagagcatgagggatgaacagactgaagccgccttagatagaaaacaatctctgtccacagagatgcataataagtttttttttccatctctattattaaatgactctctgagtcatacatagttctcttttgggttttaaaaattatagtaaatctccttgattgcctacttaacaaccatttcctttctccctcctttctttaagggagcccgattttgttcaggcccctacaccagccatccccacttccaaaggaagatcctgattagtttaagctgggcatggcatttttctgtctacagtttttttgtttgtttgtttctgaatacaattagtagtccaggagtaaacatgtgctccgatatcagggccttgacctacggttgtgtgattgtgcttcacaggacagctcctgcccaaactctgctgctgtgccatgtgccctagcctgggacaggaacaacctggagaaaacagcaccttttttttgattggttctccctgcgtggtgcttctttttgcagttcagctgtttgtaggaagtgtcttttctaactacacaaagactcctgacggctagctgtgactccgcccaaagttgacctgagcgaatcccttaatgatatcttggagatatgaacacagttcttcctccttccagctggacatgatcaaggaagcatggtgccccagatgcccttggtaatgtcatattttcaccattgtgggagccagcctgagttgaagctgaactgaaaaaatcacagacaaagtgctaaactgctgcatacagcctcaagagtccacctacttgactctatatgataatataaaacatgtgatatgtatatgataataaaagataaatgtcttcattatttgtcattttgatttgggcttttctgttatttgtaggtaaaacatcttaagagacataattattttctggctctaaaagcaatggccattcacttagaaaatgtagaaaagatagaaaagcacaaaaatttaataattataccacccaaagactataactgtaaacttttaaatatgactttctgatctttttctatgtgtagatatatgtactttcaaaactcaggacaatagtgcacataatactgaatattctgttttactcaactaatgacatataatgaatccaagagaaatttttcttctctaatttaattttaatatttgtatattattttcttttatgattgtagtttatgttccctattattggatatttggaggtattttgattttctcatattataaataatgccagaagaatattatagtgtatatattttacacatatttagttggcttcttagaatatgtctttacaagtggagtttgatcaaaagatgtgaaaatactaaaagatttgtatgcatatttacacacttttagcttgtattcaaaatgagacttaactggtgtttaaaataaaaatgctctgttgacaaattcgcataagcacttacagcagtttttctcgtccatgtaatcagggcagtctgggaacccatcgcagatcactgtgtgcttcaaacattgtttattggatggacattcccaaagatctctctctttacaacctagagacagaagaaaaggttatttgcaatagacgtggaattgaaaataatgataaattcaatcaatgtagaaaaattacgctataaaggcatgatgttggcagggcgcagtggctcatgcctgtaatcccagcactttgggaggctgaggtgggcggatcacaaggaatcacttgaacccgggaggcggaggttgcagtgagccaagatcacaccactgcactatagtctgggcaacagagcgagactttgtctcaaaaaaaaaaaaaaggcataatgtcttttttcttaaaaagttttgacctctgcataccatgaataatataattttgaaagtagaaataaccaataatattcatattgtgatataaattgtacagctctcctaacagaagatcaaaggtgacatatggggccaggcacagtgactcacgcctgtaatcccagcactttgggaggctgaggtgggcagatcacttgagctcaggagttggagaccagcctggccaagatggtgaaaccccatctctactaaaaaatacaaaaaacagcaaggtagtgcgtgcctgtaatcccagctacttgggaggctaaggcaggagaatcatttgaactcaggaggtggaggttgcagtaagccgagattgcacaactgcactccagcctgggtgacagaacaagactctgccttttaaaaccatataattaataactgaatcaggattagaaccctagtcacttttctcatgtattttctattcttttcttttttgagaccaagtctcactctgtcgcccaggctggaatgaagtggcacgttcttggctcaccgcaacctccacctgtctcaaaaaaaaaaaaaaaaaaaaaagtgacataggggacatggagaaaaaaatttaaaagcatacattaacattcatctttaactgttcccttttctttctgagtgaaattgctgtcaatgcataagacttatctataaaataatgttatgcttttaagcaaatatgccaaagtctagtgatctaaatgcatatcaccttaaaatgtaatttcattctacaaatcaggaggccatctgtttttttagcaaaagaggctccttctatgccaaacaaaactagtttaagagccaggtgcaaaagctattactttatggtagtcagagatctaaagttggaaacttcatcaattaataagagaaatgaatataatttgtacaacattaatgtaataacttgaactgtaatttgcctatgaaatagcaagcacttgtgatgtatttaataaatgccattgatgattcatgtgcagtgcatttcatatgcctgctaaagtttgacaagagtctaatatgtttatgtcattccggtcagatccctggccccggccaggccgtgaagtacatgaaggaagagactacatggcaaaaaaaatttgagtaccttccacccccttggctagaacaatggctagcatgtagcaggccctcaacatgtgtgtgttttaagtagaacttcatttcatgtaaggaacaaaatgtctctggctctcaggaaaatataatttattttaaggtcagtgaaatgcaaagcagtgatcaaataagaagtttcttaaacaatgttattgttcatctaacctactacaaataagtcgaataaattatgtagatgattgactcaggtttcttggaatccattatgagaaaaaaaattggttttcaaacttttcattaaaaacaattataaaaataagtgacccaaaatgcttactataagctaaaattagatttagtgtgtttcatcatccaaagatataggaaataaatagtgagagtctttcactggctgataatccgggggggtcttaggcccagggacatccattccaagaactcacagggacattatttagagttttcagctagtagaggatccagacagcatctgaaaagttctgacaataagagtctcttgagatttgagaaagagcctgaagcctgtcctctgtgacccagctcccgccaaatggtacagtctgctcattctaccagagagcaaaagacatcaagaaagaggactcaacactccatgcatggtgctgacccttctccagggctgctcctctgctcacaaaacataccacttgctaatagagaatgaaataaaatagcatgagtttttcctgacgattcccaaggcccattcttcttaagactacaaggaagaacttcgacatttggaatgagatgatgaaataccacagaaatagatcatctgggacagaaggccgcctaaagtgcatcctcacaaataataataataataatgatgataatgagataacatgtattatccactatgtatccacattctagatattagctttaattcttaaaataacactataatgtcagtattatgctcaccattttataagtgaggaaactaacatttagagaaattgaatccctccacatcacagctctacggagaaagatctggatgggatccaggtacaagtcatcagttgcagtcctttgtaagatgcgaacatgaagtatgcgtaaggggtaggagcagtggaagcacagctttagagtcagacaactggatttgaatcctagttccaaatctcactagctgtgtgagcttgggtaagttacttaacttctccaaactttggtttccatacatcttaaatacaaataataatgcctgcttcatagggttgctataaacattaaaggaatactccataagcattcacttttcacctctccatgtcttctcttttctcataaaagtttgcatagcataatacctcctttgtggagttacagtgagcacaaaagaagtaggataaaaagagagagatattagttacatgggagatagtattattttaagaagaaaccactttctttgtaaagtgacattttggtgcaattatgttttaaatgtatattctaaaaggaaaaggatatgattccatcaaaaattaaaaacaggcatggatgggatgggctgtttaatgcacctgtaggttatgaaaccaaataattgttgatgtcagaataataacctctccagcacagagacaatagcaacaaccaataattgaggatacagtgttccaaaaaagtcaccaactcaccccagtttgccagggatttaattgatttgagcacaaagtgtcccttgttccaaaagatccccatcagtcccaggcagatctggttgactggtcacactaagtgtgctaagcattcatctgggttttttgcttactctatctctcattttcacaaaaactctgtgaaacaggctgccctgacagaggcagtacccccccacccccaaatggaataccttgtttctctataaaaacagttgtcattacaaataaagtcagcaaatcacctcaaagcagatgctttttgttctgtaagaatctcttagctatgcagctatagagtaagtaggtccactcatcctcttgagttgagctgcatgaaatttttaaattctcaccctttggagtggagccgctcacaaggaggaaggagacaaggtaatactgcattattgagctgacaaaggctggaacagtctggatccagccatcctggaccagtgtctgccccaggaagtggctgtggatgtgacctataaggagctgtagcagccagagtacaggcctaacaggtgtgaagagccttctacagcatgcaggatcctggacaacaaagccccttccctcaaagcatggctgcaaagggctctgcctctgcacctgctatagcagctggaacagaggacctgcttcccactgtggtctaggcctgattatcagggcagccataccagcacaggccatccagccaccatccagctggaaagtcgcagcagcctacccaattcctgagtcacttcccactcttagcagtgccattgttatggcatgctcttcacatatgggtggcccagtctcccgtgaaagaggcaggatgaaggaatggatgggactttaaactgcatggctctaatcctaaaaagagagaacatccaacccaaaaccaacactatctccaggaaaagacaccatccatctacctgagtttactatgtgagccagagacctcccccagcccatgctttagcctgacagaccagcccactctcttttgccataaacagctgtcagaaacaagactatgctagacaggactccttccctcaagggagatggctggggcagcctttgaaaggaatcgcctcctgattttccaccaccacagcaggtgagttcccagttattagcttctgaggatgaacagggcatgttataagcattccaagctgtgagagataatgtgggtgttctctgcatcttacccagagaagtaaactgactggccaaacgtcacacagcctctaaggctaagtaaggatgtaaattcaagtctaagtctacgcaggacactctgccattccagcctgccttcccaagacaccacagaagacgatgaaacagttaaccaagtatttaaagggaaggagaaaatttcccccttaacatggaaaattaaaccctactgagtgatgagaaatcaatcctgaaaattcctcctgaaagcacatttgtggatatgccaaagctatggacataatgactctcactcttctgctagctacagagcaaagagtggtctcctccccagacaaagagacacaaaagcatagagactggtagtatttggagtgttaagaaagccagttaagcccttctgtgagataactcatagaaatgctatccaagaatccaaaaagaaaacatgccttttggaaactctttgaaatcaagctgtaaaacccgtaaatatcagagtcagatcttctaatacaacctaaggggattctgacttgaagaaatggctcaggttatatttaaaggttttattttatttaagatcaagaggagaccaaagataggtgaagaactgatttttggtcatctgaagataaacagaaagtcacttaatgacactcagacatttgcattgctgtcaatcttttctccatatgatgtataccattttacttagaatagtgatcaattagtaattttgattctgtgttcatgtaataaaggattttattttgacagtcgatataaagcacctgttgtagctatattttcatgtgactgctccactgggagttgctgcttgcttgcatcacagcccaggtaccacctgctcttgtagctgacccaaatcgtggaggtaaagcctagcaagagataacctcagcctcacacactcaaatctatagagtgatagaacagctgaaacatacaatccctttgttgttttccttagctctcctttctttgatgtcattcttgatcatttattttcccatgtctttccctcatgctccactgcatggctatcaatgcttggaaaatgttacgttgaaaataaactcatttatcaagttgctagttttacaggcagctccatctatatcatgtatgctcaattacttaagcatacagtaattgacatcttaagcatccttaagacaatgcagtacttctgtactgacacagtgcagattctgctcagcattcccctgtctcttagacttccttcccatatcggatttgcacaattcatcccaacacttgctgaaaacttttctagtactgacattttcaactcttgtttacattggcaattacacaatcaaagcagcctcaacagcaaaaatctaccacaagagctggagacatttaagaacagtattactgattgctaaattctaatgcatatattttaaaagtgtatttataagttaagtgctttggttatcatgtttctccattacaaaagtgccaaagaaacaagaagtaatttctcacacaatatttatttcataactgagttaaataagtattgttttgagtggaaactcaataaccttgttagaaattctgagggagctgcagattcatgacaatgaatagttaattgtccaattattcagtaaagctcaaacacttaataacacaacggacagaataagtcagaaaggcaagaagcttggggtgaaacccagctttgctggagctggtgcttgcattaccagatggtgtgcctatgcacatacgaaaacagaaagacaaacagcaaggaggcaaatggaaacagatgacttcctattagtcctctgttgagccttcatcaacctgacttccttatttgatttgaagtggtgtgtcctcccaaatcactgaacaagcccattcaaatgcatgcagaagtatcaaaggggaacgaagtatgtaaagttttctattgttagtcactttggaaaacttctcataaattagtactgctggagcaattaattgaactccaaatgtattatttcttacccacttttaactttccttaactagagctctcaatagtgctgtcaattatttttaatttttgatagagattagacaatatattctattattttgatgtgcctttaattgtgtgattaaaatactggtgaaaaccaattacttaactagaaacctgatattttagggtcgtttaaaccctataccaatatgatagtactttaagtttattttttgcagaatatgttctagaactcagaacttttagtcttggtaaagttgttttgttttgtttttaactaagcttttgtatttctcaaatatttagtcccctacaacaaatttaggtctagccaccccaacaaagtatcatgcaacctctttgaaccatctaagataatctattttaaattgcatctcaaataccatgacccatcaaagtcatagttcagtgaacaaatctaatacattctcaataaatcacttatataaggtatattcaatgaattttgatttatttctttacaaaacaaaaaaccacaaacaagcaaacaacagtagcttctaaaaacactgtacattcctccataacaaaattaccccagacattgtaccatcattctgacagctgaagttttccagaagatgcattagtccatatttataggagctgacaggatttcagttgattgcttgtgacatttttgtctagatcagaagggcaatgtttaccacctaaaattcacttaatggagcaacgcaatatttcatacttcaaaggccaaaagaatgaaattatttcaaaagatgtactgccttacgtgcttgtcatgaaagtgtcaattcttcttaaacaggaaaggctaaataatcataaccaaacaattctgtggatagatcttcaatcattttgctttcctcaaaaacactgtttattaaagaccattgtctgacttctattccctaatacattgtggttacaagtacaaagatttgcagggaaatataatgacaactaagtccactcaaattaccattggcatttatggcttttccactggcgattttggaactcaatggcagaaatgtcaagaagagttttatcctttgccgaaagagaaaaaatatgagaggacatgaaaatgaatcccaattagactgggaatgatggagtctgaactctgaatgttggagtatgaactctgccttcatgcatctagatgtctatttagcaacatgggaagcatacgcaaagacactattattctggctttaaaactgataacaatggctttataatttaataataaaaataattctttacatttgtgaggtgcttctccttttaataagtgtttgcaaatatagtagtgcccctccacccttatctgaagtttcagtttccacagtttcagttatccctggttaagcatggtccaaaaatgttggcacaatacaataagatattttgagacagagagagagaaaccgcattctcattacttttctttcagtacattgttataattgatccattttattattgttgttaatctctcattgtgcctaatttataaattaaactctatcataggtacatatgtgtaggaaaaagcatagtactgcatatatggggttccatacaatctatggtttcaggtatccactgggggtcctggaacatatccctacggataagggggaggggtactgtatgtatcagggttatatagaagtgcaatttagaggaaatcaagagtcaggaaaaacacttaaaatatatgccatactgttcaataatttaagaagtaaagacattagcattgaatcctagtcctactatcagtgaatagtttccatttttaacacagtttcttattttattctagttatcactgtacattcaagaaaagtaccattgcacatacataccacagttttcctcatcactgtcatcgtcacagtcggcctggccatcacatcttctggaagccagaacacactgtcctgagcggcacttgaaatgactaggtgagcattctattaaaaacaatattactgttaaagggctgaaaacccagaaacatcagctaatttatgtatttacatgtaggatgttgtcaaggagcttttactgaagataagggtggtctcttgcaaaacgaaatagccattttgctttggcattcttctgcctgccaatcagcatctttctccttcattcttggcctcatccctctagatacgcggtttaacatctatgtattccaatgattaattttctttccaaatgggacaacccaacaattgccagagcctgatatgccttgtgcagtcagtgctcctgactacctagcggctctcaatgtgtcaaaatcattttcacatccccatctttccacctagtccacaattccatttctgtacttaatgatcctatgttgccatggtccccaaatgttttttacttgaaggaaccaaggtttgatgttcacctttgccttcaggatcactagtataaaagcatccatacataatgggctctgtgagtaaagtacagtttaaaaaacacctggagtactaattaaactcatctctgagttcattatttttaattttaaaatgattttttggggggaagatggagcaagatggccaaatagaagcctccactaattgtcctttctgcaggaacaccaacctgaacagcatccacacaaaaaagcaccttcataagaactaaaaatcatataagcaatcatagtacctggttttaaattcagatcactgaaaaaggcactgacaagggtaggaaagacagtcttgaatcaccaacaccacccctcccccattccccagcaagagctgcatagcacagagaatctgtgcacttgtggagtgattgtgggactttgcattggaactcagtgctgtcctatcacagcagaaagcaacaccaggcagagctcagccagtgcccatgcatggagggagcatttagatgaaccccagccaaaggggaatcacccatcccagtggtcagaatttaagttctggcaagccttaccaccacaggctaaagtgttttggggtccttaataaacttgaaaggcagtctagctcacaaggactgcaattcttgggcaagtcctgatgctgtgctgggcttggagacagtggacttgggggcatgcaacctagtgcatgccgcagagtggccaagagagtgcttgtgccaccccttccccaaccccaggcaggcacagctcacagctcagaaagagactcctttcttctgcttgaggacaggagaggggagagtaaagaggattttgtcttgcaacttggatatcagcttagccacagtagaatagggcaccagacagagtcctgtcctaaggcccccattccaggccctagcttccagacatttctagacatatcttcaaccaaaagggaacccactgccttgaagaaaagggcccagccctggcagcattagttaccagctgactaaagagcccttgggccctgaataatcagtagcagtactcaggcagtacttctcatgagccttcggtgagactctgagatgggctggcttcaggtgtaactcagcacattcccagctgtgatggctacagggagaaactcctgcttgagaacaggagagggaagagtaaaagggattttgtcttgcagcttaggtaccaggcttggccacagcggggtagaacatcaagtgaattcttggggtctctaattctaagccctggctcttggatgacatttctggatgtgccctgagtcagaggggagccccctgtcctgaagtgagagtcccaggcctggcagcattcaccacagactgactgaagaacccttgggccttgagtgaacacttgtggtttggtagtacttgtcatagacctggggtggtagtgatcatgaggaaaaaccactagcactcttccattacctctctgtggaaagaggaagagtgagaagaactttgacttgtggcttgggcgccaatactgcagaaattcaaaggatcatcagagtctactatgagcaactatataccaataaattggaaagcctatgagagatgaatatattcttagaaatatacaacctactaagattgaaccataaagaaatccaaaatctgaacagaacaataacaagtaatgctatttaagtaatacttaaaagtctttcagcagaaaaaaaaaaaaaaaagcctggtgcccagtggtttcactgctgaactttgccaaatatttaaagaagaactagtaccaattctgctcaaactactccaaacaatagaggaggaaggaatacatccaaattcattctacaaagccagtattaccctgaaaccaaagctagacaaagacacatcaaaaaaaagaaaactacacaccaatttccttgatgaacattgacataaaagtcctcaagaaaataccagcaaactgaattcaacaacacattaaaaggtcattcatcatgaccatttaggattttttttttttttttttttgagatggagtttctcccttgtcgcccaggctggagtgcaatggcatgatcttggctcactgcagcctccacttcccaggttcgagtgattctcatgcctcagccttccaagtagctgggattacaggcgcctgccaccatgcccagctaatttttatatttttagtagagacaggttttcaccatgttggcaaggctggtcttgaactcccaacctcaggtgatccacccacctcagcctcccaaagtcctggcaagacaggcatgagccaccgctcccggtgaccatttaggatttacaggagtgatgtaacatatgcaaatcaatcaatgtgatacatcataacaacagaatgaaggacaaaaatcatatgatcatttcagttgatgcatttgataaaattcaacatcccttcctgaaaaaaaatccctcaaaaaactgggtaagaaggaacatagctcagcaaaataaaagccatatttcacagacccacagttagtatcaaactaaatggggaaaaactgaaagccttatctccaagatctggaacatgacaaggatacccactctcaccactgttattcaacatagtgatagaagtcctagctgaagcagtcataaaagagaaagaaataaaggccatccaaattggaaatgaagaagtcaaattattcttgattgcaaatgatatgatcttatgtttggaaaaacttaaaaactccgccaaaaagctacagaactgataaacaaattcagtaaagttgcaagatacaaaatcaacatacaaaaattagtagcatttctatatgccaacaacaaaaaatgtgaaagagaaaccaagaaagtaacctcatttacaaaagccacaaataaaataaaatacctggaaattaacttaatcaaagaaatgaaaggtctctgtgatgaaaaccataaaacactgatgaaacaaattaaagaggatataaagaatggaaagataatccatgttcatggattggaagaatcaatattgttaaactttccatattatgtgtattaggccattcttgcactgctataaagaaatacctgataccagccaggcgtggtggctcatgcctgtaatcccagcactttgggaggccaaggtgggtggatcatgaggtcaggagatcaagaccatcctggctaacacagtaaaaccccatctctactaaaaatacaaaaaaaattagccaggcatgatggcgagcacctatagtcccagctactcgggaggctgaggcaggagaatggcgagaacccatgaggtggagcttgcagtgagcggagatcacgccactgcactccagcctgggcgacagagcgaaactccgtctccaaaaaaaaaaaaaaaaaagaaaaagaaatacctgatagtgcataatttataaagaggtttatttggctcatggttctgcaggctttaaaggaggcctagagtctgcttggtttctagggaggcctcacgaagcttacaatcatggcagaaggtgaagggggagcaggcacgtcacatggcaaaagcaggaacaagagagagagagagttggaaggaggcaccatgaccagatctcctgtgaactcagagtgagagatggttcaagccatttatgaaggatctgcccccataatccaaacacctcccaccagaccccacctccaacactaggattacatctcaacatgagatttgggtggggaaaaatatccaaactacctcattctgctctgccccttcccaaatctcatgtctttctcacatttcaaaatacaatatctcttctcagttgctcccccaaagtcttcactaattccagcattaactcaaaagtcccaagtcccaaattcaaagccttatcccaaatccaaataagttccttctacctatgagcctgtaaaatcaaaagaaggtatttacttccaagatacaatggctgtacaggcattgggtaaacattcttatttcaaaagggagaaattggctaaaagaaagaggctacaggccccatgcaagcccaaaacccagcagggcagtcattaaatcttaaagctccaaaataatctccttggactccatatcctgcatacagggcacactggtacaggggtgggctcctaaggccttgggcagctctgcccctgtggctttccagggttcagtccccatggctactttcacaggttgttgagtgccaacagcttttccaggcaaagggtgcaagctgccagtggatctaccattctggagtctggagggcagaagcctacttcccacagctccatgaaacagtgacccattggggactctgtgtgggggctccagccccacgtttcccctctgcactgctctgacagatgttctctgagccatggctaaaggtagagcagcctggatgcagggagcagtgtcctaaggctgcaaagggcagtggggacctgggcctggcccataaaaccattcagtcctcctaggccttagggtctgtgatgggaggggctgcctgggagatctctgaaatgccttcaaggcatttttcccattgtcttagctctttgctcccttttggttatacaaatttctccagcaattcagcctgcttgaattcctctactgaaaaagctttttgtttctttaccacataggtaggctgcaaattttccacacttttatgctctgcttcccttttaactataagttccaacttcaagttatttctttgctcctgtatctgagcacaggctgttagacgcagccaggctatctcttgaacactttgttgcttagaaatttctttcatcagataccctaaattttcactctgaagttccaacttcaacagatccttagggcataaacagaatgcagccaaactcttttctaacacaagatatgggtgaacctttcccccggttcccaattagttccacatttccatctgagatctcatcagcctggccttcactatccatatcactatcggaattttgggtcacaatcacttaaccaatttttaagaagttccaaactttccctcatcttcctgtcttcttctgagctctccaaactcttccaacccctgcctgttacccggttccaaagttgcttccacattttcaggtatctttatagcaatgctgaacatctagtaccaattttctgtgtcaggctgttcttgtgttgctataaagaaatatctgagactgggtaatttataaagaaaagaggtttaattgactcatggttctgcagcctttacaggaaccatggtgaagacatctgctcagcttctatgaaggccccaagaagcttacagtcacagtgaaaagcaaaagggaagtaggcacatcacatggtaaaggagcaagagagagagtaggggaagagatgctacagcacttttaaatgaccagatgtcatgtgaacgcagagcaagagctcacttgtcatcaaggagatgacccaaaccaatcacaagggatctgcccccatgatccaaacacctcccatcaggccccaactccaacactggggattacatctcaacatgagatctgagcagggacaaatatccaaactatatcactatgtaaagcaatctatagattaaatataatcccaatgacattcttcacagaaatgggaaaaaagtcctaaaattcatatggaatcacaaaagactcagaacagccaaagctatcccgagcaaaaagaactagaggaatcacattacctgacttcaaattacactacagagctataatagcaaaaacagaatggtaccagcataaaaacagacacataggctaagggaacagaaaactgagaaaagaactcatacatctacagtgaactcattttcagcaaaggtttcaagaacacacactggggaaaggacagtctcttcagtgaatggtgctgagaaaactggatattcatatgcagaagaatgaaattagacccctatctctcaccacatacaaaaatcaaatcaaaatgaataaagacttaaacctatgacttcaaactatgaaactactagaagaaaacattggggaaactttccagtacactggactgcacaaagatttcttatgtaatatcacaggaacacagacaaccaaagcaaaaatggacaaatgcgattacataaagttaaaaagcttctgcaaagcaaaggaaagtgaagagacaactcacagaatgggagaaaatatttgcaaaatatccatatgataagggattaataaccagaatatataaaatgctcaaacaactctatacaaaaataactaataatctgatttaaaaatggacaaaagagctgaataaacatatctcaaaagaagacatacgaatgacaaacaggtatatgaaaaggtgctcaacatcactgactatcagataaatgcaaatcaaaactacaatgaggtatcatctcacccaaattaaaatgtcttatatccaaaagacagacaataacaaatgctagcaaggatgtggagaaaaggggatcctcacccactattggtgagaatgcaaattggtacaaccactagggagaacaatttagaggcttctcaaaaaactaaaagtagacctaatacatgacccagcaatcccactgctaggtatatacctaaaagaaaggaaaccagtatatagaagagatatctgcactcccatgcttgttgcagcactattcacaatagccaagatttggaagcaacctaagtgtccatcaaaagatgaatggttaaagaaaatgtggtacatatatgcaatggattattattcagccttaaaaaagaatgagatcctgtcgtttgcaacaacaaggataaaagaagacgtcattatgttacctgaaataagccaggcacagaaatacaaacttcttatgttctcacttatttgtgggagctgaaaattaacacaattgaagtcatggtgatagaaagtagaccaatggttgccagtgtctgcgaagggtagtggtgggggaaagcagggttggttaattggtacagaaatatagttagatagaatgaataagatctagtatttgatagcacaacagagtgactacagtcaacaataatttattgtacatttaaagataactaaaggagtataactggattgtttgtaacataaagaaaggataaatgcttggggtgatggatatctcatctacttgatgtgattattatgcactgtatgcctgtatcaaaatattttaggtaccccatacatatatacacctatgtacccacaaaaataaaagaatagaaatagaaaatgacttctttatttttaaaatgaatgcaatatctaacagatgagtgccaaattcttcaatgcaatcaagttcacaaattcactcacctaagcagcctgattggaaactaaatagaaaacaaacaaacaagaagccataaatagaagaaattcaaaaggtagctaacatgttcatccatgttagataccctgctgtaattaattttaaaattaaccttccacatattcatcaggcatcaggcaggtttgattgtctgaattttcctctggaaattgactgcaatctgtgtcttcaggccactgtaggcccacaatcccaagaacagactcacagcgttctttagagtgttcacacaatgccctagatgaacaagaaagacaaaacattagaagcagaaatagctccatctgagacagatgtcataaatttatgtcaagttttaattctgtgtatgtggcatgtattgtgggtgtgtggatataaaagatgcacatatatatgataggtatttgggaaaccaaaatgagtaatatctctgcaaagagtatacattccagcaccacactttcaccaaaagaaactttattgcagaaataggtctaaagatgtttccaggacacagattcccttctctacactgcctttctcattctgtcttctgtctttgaaggagacatattctccaaccttttgttccaaacagggaagtctccaacatcactttggatagtttgccaccaaagtcattgaatctatacaacaccctcatcctcagagatctccccctctgcagaccagccttgtgagccatctcatgtgccaccttagcttgcctaaggcatgcctcccttacttcagcttccatcaatattggtgaaaagcttaggactccttccaaacccacttacgttgagctcgagttggttaaaatgtttggtttttgttttaaagaaatgatatattattgtatcaggtgctttcgtgcgtattatgtcttttgtctccagaatatttttaagttaaagtatcagcgtgcctcacagaagatttctttacttctttttttacttcttatggaaaaaaatatgatttttgtctcaatatattactaagaaattagttacacagttaaaaaaaaaactaaccaaagtaagttcctaggccaatatactcttaatggactcaaataaactcttacttatcaaaagtttcaaattttatacactaattcaactaagttctcatttttaagataaaatgggagacagatcttccagaaaggccagctccagtcttgcccaaaactggtagagaaagtgtaacaatcaaatgaggaaatttcggagaaagttctgtctaggtttaagtctggacaaagctcagcataactcaacactggcttagcccaggaatttgtggtaaagataaagccatggtatttctatattaggtcaggaaagatggaaagttcaatagttgataactgtctgttgaactaactagttttgttgcagatttataaaaaatgtatataactcaattgcaactgctattttaaattagtcatatgatacttatttgtacaaaagactatatagtgcctgactctaccacttccaatttttttctgtaaaatggaaattacaacaatatgcagcaccacaagtccagggggcgctgttcttatcatagtccttgtagtgttcagccataggtagcacctctgatgatacacacttcaaaaggttattttgagtacgctacagcataacaatcctcaagtatttagcccattgtaaggactcgatgttagatttttcagtctcatagctaaaaaattcaatgttaaaattaataaacacacctagcaaaagcaactatgtattgctttatgaacttattagcatattattcaaaaatttcttataaacaaatatcaaaatataaaattcgtagtgatagacactgaaaatgaaagatgtatgggtaaacctgaaaaaaagaaataaatttatctaaaagaaatttaccaaaattttgattgaacaacacttcaggatcatccttggtcttatgcattttaatatggaacttaagccctgaaattataaattacatctggatataaattcacatttatatttatagcagaaaatgctgcttcagggaaatttttatctacatatgaaaagaaagtcaaatgccagaaattgttaagtactattaaaagaaattattcactatcactgaccttgctttgcaaaagtgaagtaagatttaaaacagctttttaacataaaattggtagatgttttattagagatacttttaaaagtacttagcagaaattttcagatatttttctacacaagctaacatttagttttattctctctattggtataatttgttcagttccccaagtcattttgaaattttattatttcctgtcctgtctctatagatgcccttactttgttatccatttggtattcagcatataatttattgttttctcttctgtccactatagtaatagtactgctttttaaaaaaaactctgcgtgacttctgatcccaacatatggtttctgcagttgctactcgcatttaggccagcacatttgtatacctaccccttgagggaaaacagcactgaagagagtagcaactcacttctgagagtcatcctgtatatgcaaaccctctgactacaatgcctaacacatggcgcagcaaagggacagactgccaagaagctattgtgttcctgtgctatcatcatagctattgtccattcagggttcattacaatgaatcagaagcactttacattcatttgatctcaaaacaatacaacccaacaaccattactatccttattctacatgtaaaggaaccgaggctgagagagactcaggattttgtctaagggctacctagaaactagagaagggtcaagattttaacccaaacatggactctggaacaatactcttgacactagaatatcactcatattcaaagtccaagctacgctcttgaaatagcgcatcttatttcattcaaacaggcagagaaatgtcagcaatgtccatcgctgtccaatctgtgagtctggcactatgtattcttatgtcatatctctaacaagtgctgtcagagtgcagcattgtaaacacatcagtgttgccagaaaaagaggcagatatatcccttttatactatcatacttttttaaaaaaatggctttttaatacaacagaatgaaatacctgtgaatttatttgattaaaacacataaactatcatcaaaggacgttcacagctcccttgtttggtacttcgttaatgaattctgactcaaatattcattttacaacttctacttctttgtctcacttgttaaatataaagtatttgataaatgcagagctccttagggaaatttacgttgtccaaactcaactaagtcttcaccccttggttctctctgaggcaaaataagggactggggtagatcccatcatattacctgcaaggagggatatgctcgcctgtattcacatcacattttggtaccaaaatggtgcaagaaaagaacatgaggtatttataacagttggtttgaacaagtgcagggaaaagagaagactcccagctgatggatgcttccttttgagtcctgtggccaaaataatttggataacttgtactgttgtagggcaaattcatgcagagttccaatgtaattggttcacattgacctaacaaagaaacatacacacaaatatttttaaatttcacatataaaaacaacttctttaagttttacaaacttgaagtctattttattctttctttagagtagctaagactagaatgccagtagtatataacattttttatggatattgaaaataagtaagttgattagtgaagtgccctggcaactaagattcatttctgtatatgtagttgctagcactgtgacaacatcttgctttagaaagtccttcctcattttttcccttggctcaacttatctaaagatgactctctttcatcattccttttattgactccaattcatcttcttcttctgatttacttattactactaaaataggatagccccatcatcttcactgtcactaaactaattaatgaatttgatcaaataggcaagtagataacttctgtctatatgttttattgttgattaatgtgtttaaatataaggctacaagatttcagggcaagaggaggctcagatctgttgaatacttctcactaataagacaaaatccaaaccccttagcttgaagtctgaggctattttatacttcaaccctaggctaacttttcagcttcattgcctgtgattatccaatcaacagtatctctgctgtaataaattctattcccttatgacaccagatattttaagaattgtatgactttatgcaccctgtttgctcctctcttacctcctcttttataacatgctcataattatctccccaaaggtggtcatggttctagctgccagggccatacggcacctgctgcctggattaaccctttcccatcttccccaacaagctaactcctctgtggtctggaagactcagcacaaatacctcttccaggaaaccttcctggccaaccactcttcccattactacttccagaatgagtcttttgtgagtgcaatagcgtcttaggcacatacccaccatatgttcattgcattctgccatattctttatttacttacttgcctcccctacacaatcctgagatttttgtgaaatgagactttatctcttgatcttgaagtctacacctagcacagtgccagaatgaagggaggaaaatgtatcagggactatcctaggcaatgtaaatgtaagagtaatgagaaatattgtctctgccactgaggaactccacaatctcgataggaaaaaggatgcacgcgctggtagctgtagtagaatgtgaacagggtaggatagagtttgcatgaactgaacatttgtgtatctccattcatacgctgaaactctaacctgcaatgtgatagtatttggaggtggggcctttgggaggtgatgaggtttcaatgaggtctagatgagggtggcatttatatgggattaaagtccttataagaaggagaagagactaaagctctcgctctctcagccatgtgaggaaacgcaagagggcaactgtctgcaaaccaggaagcagcctgttaccagagaccaagtctgccagcatcctgatcctgcacttccagccttcagaactgtgagaaataaatgtttgtcatttaagccacccaatccatggcattttattgtagcagcttgaacatactaagacagacatattgaacaaaatgctagagtccaaagggaaaaggtagtgcaagagtgaactgggaagccctctgatatggtctggctgtgtcccacccaaatctcatcttgaattgtagctcccataatccccacttgttgtgggagggagccagtgggagatcactgataatggggcagttttccccatactgttctcatggtagtgaataagtctcacaaaatctgatgattttataaggggtttcacctttcacttggctctcattcttctcttgtctgccaccatgtgagacgtgccttttaccttccaccatgattgtgaggcctccccagtcatgtggaactgtaagtccattaaacctctttcttttgtaaattgcccagtctcaggtatgtctttatcagcagcgtgaaaacagactaacactccttccaatgataaatgtggtttgggcagctttgggggaatacagcagagaggctcccagctccctctctctgtttgcagtagatatgccacattccctgtgtggagaggcaggcaagcaagtgtcctggtaaaattcgcccaggcagaccaaagactccatgccttattgagagtgattattcaaattaaatttaattatttgactaagaagtggtatccatgcaaatagatttgcaataaggactgggctgaaatattaaaacatctccaggactacttcttaattgaaagaatccgaggatatcacagatattatatttataaggaggctgatgttggcctgattaaaaaaaaatgatgcatgaagtgcaatatgactctcagtttgctgaagaagacacaacactgaaaggctggcataatcttgaggatgagtcagagtggagagaagactagacggaagaggtttggggttggtcggttcagtttatcctttcctgtgatttgtgaaggaggggttggacattatggactaaatgtttgtgttcccccaaaattcatatgttgaaatcctaacctccaatgtggtggtattaggaggtggaggctttgggaggtgattgagttataagggtacagcccccaagaatgggattagtgcccttataaaagggaccacacagatctctctcgctctcttttcacagtgtgagaatacagtgaaaagtcagccatctgcagcccagagagggtcctcaccagaacctgaccatgatggcaacctcatctcagatttccagcttccagaactgtgagaaataaatgtatgttgtttataagcaataatgatttgttatagcagtctgaactaagacaagaagtaacatttaaatattttgttacaagatttaaaaatgcatgtttttcataacaataaaaacactacaaagatgcagaaagaaaaagttcaacatctctccactcccctttctgttaccttccctgcaagccaacagaaggctttgaatgcttccatgcctttccccgctcacatttatccatacatgcctttgcacacttagacagggatttctgtttgcttttgccaaagcagaagcataccattcctatcacccttcaatttgcttttgttgcttatttgtcatgaccatcttacaagtcagcacatgcagctctaactctatgcttttttcctgatatctttaatatacttaaaattttacacaattggttcacttacagatatttctgatgcagtcctttctttccttgtgcataccctccgtttctttctttctaccaccccatcaaggttcaactttttattgatgtatttcactgaagatgattaacagaacatatcgcatgaataatttttctcttttttacatgtggagaatgtatcacttttgatttgggttaagacataacttttaagtgtttaggagccaaggaaaaggaaaggattaagtaatgatcatatattattctgtagatctttattgaattcggtaaggtttattggatcttgagttttattcctttaaaggcattcttcacagaatgctaagcaagataaactctcaaaatacctgtcaaccccaaattctatgatttatgatatcaataagcttttttatcttaagcattaggctcatgtgtgatcctgatttaaaaatcgccactagagggagatcgcatcacaaacgtgaggatattttagggctgcagaactgtgcttccgatataagtttgatgtagtacccagtacagtgtcccgaacacagatgaggtttaataaagatctgtcaaagaaaaaaatcctgatggaatctcaatggtattccacctttcaaagtctgtaacaagattcgttcaattcaacctaaagatgggatcgttaactcaatggtgttatatcgttatgatgtgatactctgaagttactagaaatcatgtattaagcgatggtcatttacatgaaaaatgtgacttttctacatctagctgcgtatataataatattcaaaaattcatctttgcctcaaactctaaatccctctttaacattattatttttaatagtttgatattattttaaggtgaacatccttataactacctcccaggtcaagaaactgaactcaggcagacaccgcagaaaccttccatatatcttgtcttatctcaactgtctcacttccttgctcttctatatatatatatatatgcttttttttttttttgtgacagagtctcgctctgtcacccaggctggagtgcagtggcacgatctgggctcactgcaagctctgcctcctgggttcgcaccattctcctgcctcagcttcccgagtagctgggactacaggtgcccaccaccacgtccagctaatttttttgtatttttagtagagatggggtttcaccatgttagccaggatggtctcaatttcctgaccttgtgatctgcccgcctcggcctcccaaagtgctgggattacaggcgtgagccaccgcacccggcttctttataattttattacctaagtgtgtaccacccctggatattgtaatttaggcttgcccattttttgaaacttgtcctgtcttttaagtctctcgtagtctttgggttcctcctccattcttttgtttttctttataatttaactatagaagaacccagacatttgacttgtagggtataccagcttttgaatcttgcttatcgcacactcctggtgaagttaaacacgttccccattctttctatttctgaacctcggcagctgaatcaacaagagtgggctgggcttcattccattcacaagactagaagtggctaagctgttctttcaccagaagccacatcattctgatttccctctttttgtgatgttagcagctgtagatgctccatgtcttcattcattaattcaacgtgttaccaaatggtaatattgtattcaatctttttttcacttattagaaaatgcacatggaaatgcttttgtaaatacatcattcctctcttctactatttgctcctaaggacagaagtctgtaaccattatagtgattggcttctctaccacatgactacaccgtttactcctaccaactgaagcttgcaaagagagagtaggaaattgctagacccttagggaattattcaaaaagcaaacctgttcatttcttccttggtgttgaataagaggggaaaatgcacgagtaagcgtaaaactaaaggttgacgaacactgtgggaggcttgagagagggcctgggacatgacagccatgcctggatttcacagccatggtcagcatgggcacagggaggcaggagagacatgcccaggagtcgcttttgcaggttctccccattgtctggattgcataccacaagggagaagtgatggattagtccctccacaccggaatgaggagaatagcattcctgctcctaccctcaaaggcaaggacacatctgtattttgcctcccaacatggcacagaaatgttaaagatgctgggttgtgactggacatggcaacacaggctgctaaaagctatttcttgaaaaaactatgtatcataagaaatgtggtttttaggctttttaaaaaagctgtaggcacttctgtgaatttaaaataagcttctccactgaaaaatgcacatgggaatacacaaaccttttcatattctatttcaaagttctcacatacccctgcagcccagtcataaataggcactagagcaatacattctcaaccttggctatacattgaagtcatctgtagaattaaaaaatactgatgactgggtcccacccaatatatctttagcgaccattagaaaatcacataatattttatgggatggcaagaatcagagtcttcaaggacaagaatcccggcaactccagtgagaggctgtctccaccagacagaatatctactacattctccaaactcaaattttcctttggcatcaagcagactaagaaattactgttcatttgtgcctcagaagctaagtaatactagtctcttgatagtggtaaacatcttcaagtaatgaaccatattttcaaatgtatgaaggattttctgagatgccacttgtttgtccttacagagacctaagtatgcatatatcatcttgaagttctttgaaagatcaggaataacatcttgactttcaactgcaagttaggcacatacgccttattttttatttatttatttttttattgagacggaatctcgatctctcacccaggctggagtgcagtggcacggtctcagctcactgcaacctccacctcctggattcatgccattctcctgcctcagcctcttgagtagctgggactacaggcgcccgccaccatgcccggctaatttttttttttgtatttttagtacagactgggtatcaccatgttagccaggatggtctcaatctcctgacctcatgatccacccgcctcggcctcccaaagtgctgggattacaggcgtgagccaccgcgcccggcctatgtgccatttttaataacacaggagtaatgagggcaagtggctagcctagtggcttttactcagaagagagcaggtgcaaacgtttgctgaatatatgtggagagaagttggcaagaatatacatgatgaatgaggaagctggtgacacagtgagacactaggtaaactgagtgtatttaaagagcttaaagagaacaacagtgtagaatatatcagtgggaagatgacaatatgttctcccacactgaaaagtgacttctaagaagctagaagcctgtctcctttctccaccactagaaagcccagcgcccatcccgatgcttggaacatcatgtacacactacaaatattggtcagctctatgagccaagagttatccagttgcctttcctacaatttattcttttgacaggagacaacatattttaaatatttaaaattcgaaatatttcaaatatagagaaaataggataacatacacccagtcacttcctacccaaatttgacacaggctaacattgccttttctacatttttgagtctaatagtaagtgtcattccatgtcaaacaacccccaaaactttaatagtaaacacatgtctttgagatgacactgtcactatttaagttgaaggtgaagtaaggaaatcgctctgaaaaatttccacggcagattgagagacgagtaaaatgaaacaatggaaacagtggcccaaatatgttatacgtgtgtgtgtgtgtgtatatatatacacacatatatacacatatatatgcatatctatagatatgttctatttaaatcagtttctatttaaatcagtttagaggaagtaaaatggcagtttgagtgtgttgactttgtggcttgactaatatctactgttctctcatatgggaaatggaggaggggtgggcatgtgcttccaggcaaagagttattaaatgccacagtcaatcctgtcagtctgggttaattagctgcctgcctacacccccttcccagcctccttttttcacccccttgagactctgtaacagttatagaggtactcactataagctctacagtgacccagaaaaattaggaccgcgaaactgcagcaaatgcaaggccgaagactttcagcatcccagcttccaagggccttagactgagaggacatgtgttaagaagtaataccctggctgggtgcagtggctcgcgcctgtaaggccagtggattacttgaggtcaggagtttgagacctgcctgaccaacatggtgaaacgccatctttaccaaaaaataaataaataaataaataaataaataaataaataaataaataaattagctgggtgtggtggtgtgtgcctataatcccagctacttgggaggctgaggcaggagaatcgcttgaacctgggaggcggaggttgcagtgagccgatatcgtgccactgcactccagcctgggtgacagagccagactctgtctcagaaaaaaaaaaaaaaggaatatcctcttgccaactgaaaactgactgacctgcttttaaatttctaatcccaacctgaaaatgcagcaaaaagttcattagaaaaagtgaaagaagcgagtataacatgaaaacagagcccaggagtcagaaatcattactagaaatcagtcgctggggattttctgattccattttccatgagagtccatagggtgctctttcacttccgcccattctgtcttccccaaataactcctcctcctgaaagtcattttagagccacctgcttacaccgtttggagctgttacactgtcaccgaaacaaattagcctaatggttccgaaaccattacaggtcatcagagttcctggaaaggcgagaataaatttcattaaaagaaccgactgcctataatcccagcactttgggaggcccaggcagatggatcactgagggtgtttagcgcctgtaatcctagctactgtggaggctgaggcagaagaatcacttgaatttggaaggcagaggttgcagtgagccaagatggggccactgcactccagcctcggtgacagagtgagagtgtgtctcaaaaaaaacagaacagattgccaaagttgtatgtggctatttctatgaacttcatatttgcttcttggttaaagtttccatttttgaagctatgctttaaaaaggaagaaagatagcatctgcctacagatggagccaagaaaataatacagagaactaatgctgagttgaaagtaatggtaatgatattaagcaatgtggacttataggcgttcgcaatgacacatttgtttctgattgaagttaattaagaccatttggtttctttactgctaccacatgcgaccttttaaaaagaaaaagaaaataggtaggcttttttggagggattccagacttcagtatttgaatgtcaatgcagaagaaaaatgctgaatgcatgccctgacatggctattgcatttgtcagctgttgtacttactacagttattcagactgttgttcgggtcacagagagagctaccaccacatgaatcaaggcagggattgtagaggcatctttggtctccttcttgacatgaagtctgaactacagagggaggaaaaggcacattggctttcatcatctacaaattccttacctaaggatctaaaagatcaggaatgtctgatggagctgaggaataacacaactttaatttccttccaatttctccaaaagtattgaacgtacgttgaataggtgctttctggattcattttcctggtaattaaatacaatccaggtattccaaaataggaatgaagaaataagagacaaactacactaaaaacaggtggttgttgcatttaatgggaaaaaaatagtgttttctttttacatgggtgccaacacttgattacaaaataaaattcaagagatttgagggacagagaacgttataaaaatcttgaaattctgaatattaagtgacacttttttaagactcatttgctcccaattctagtctccctctaaggaaaatgctttctctagtaataaatagggcatcaacaccaatacaataaggatactttaccataatacaagtgttatgcagctgttatccatattttcaatatgtccttggaaagtgtcatcagcctagctgtgatgacttgagaactgggtttcttgtttctaagtgaatgacagcagtagtatcagtgtttgccctaatgatttttccttaaggtaggtagagaggaaactgcttttccttgattccctggtcatttgtagattaaatggagaaggtaataaattactgcccattcactctctcccccattacgatcaattaccttcaggcatgtcatctggaatctagtcaaccttgcaaggcacttttaagtataaataatagtatgtgtgtatgtataatcattcttacctataattctaagatgatgtttattatactgaaatatttatcctttccagtaccactaatgtgcaaattaatacacaaagccttgcagaaaagagatgtcactctttttttaatgtcagcagggtcaaaattttttctcaaagcaaacctaaacaatttctgtgagtttaggctcttgaggaggttttattgacatcatgcattcattattttggcaaatattaagtgcatgccatgtgacaatctatgtgacaagctaggcactgagcattaaaacataaaagggcataataccccctgggaagtggcttgtgctctgatagaggtatcatcctgaacaaaaccttctgatgctgtgtgatcactgctttatggaagacatatttatttttacttatttattgtttcatagagatgggggtcttgctatattgcccaggctagtctcaaactcctggtctcaagtaattctcctgcctcggccacccaaagtgctgggattacaggcatgtgctaccacgcccagctaaaatacatttaaagagcagtagaagccaatgagaccagtatggggaagtttctcaaaggacttttccaagtcatggtaagaggaaaggatgggtttcccaagccaagaaacagcacatgcaaaggcctagaatagggaagtgcacaggtcaaagtaactggagcttcaaccactgagaaaggggctgagagaggctagacagataggcagggacagagcctgaagagtttcaaaggcctgactcttcagcaagacccaaagtctccagagaagtggcccctgcttccctttccagctctgtctagcagaacaaacctgcaacccatgctgacaattatgtagtatttagtaccaggccccctttcgttctcagctctctaatcacaatggtctgccttctctcatggtcctcctacacatgccttgcaccttcccaccacaggaattttggtcaagcggtgccttgtgtctcaattgctttttcaagccccgttctttttggttaaccccactcatccttcaggtctgagctccagtatctcttcctcagggaagctttgtctgaggcgctttaccagggcatgcaccctattaagggcatccaagcaccctgaatttcccttcttagcctctgttgctgcatggttaagcattgacttgcctaataattcgtagcatgcctatgtcccccaggagtctgcaagctccatcagcggttttgcttaccactgaattcccaggggatggccacatataaacaccacaatatacattttttgagttgaatccattaaagtgaacaatataaaaatactaaaattttacttttaaatctgttttatcatatgactttcttacatctcacacatgtaaggaaataatctacaaagcctgccatttcatcatgaaaaatccaaaattatttcagagttgaattatacagaaagaaagaatagtttgatgcaaacggaagtgctcggttgatatgcacacaataaattacgtttaataaaggatttcattctgaatttaaaaactggtaaaacaaagcactctttatatattatttttatgtaataagtctgtgactgaaaagctctccctttaggtcttgggcatttttccattaaagttattctaatgatcaatatgcattacgacaaacctaatttatctataggtgaccagtctcattggctgattatgaatatacacagcccaagatatgctttaatgtagtagccatgtaataaaagctcacatatattgagtttttgccatatgccaacactatgaagtagttatcactattctgagtgtacagacacgcaaactgagacctaaaagggatgtaagtatcttgccaaaagtcaccatatagtaagtagcagaccgaggcttgatcctgggtatcagggctgcaacaatcatgttattaacaactaggctgtgcccgtgtagtataaacaaatgtgatgtttgagtctaggcatattcttccctggaccctactgagaggcttccacacacactggagctgcatagaactttcttttctgacagaaatagttacatttaaaaaacaatttattggatctagtttttctttttgagattcacacgcagatatcaaatccttttaaagtgtattgctcggtaataagaggcattaaactgcttctctgaacatgattattttaggaagacattacatttcctttcagaagccaatttcttctcactggaatctaatctgatttaattggatgctatacactaaacttctctctttatcacggctttccccatcgaacagttaagtgaatctgaccatgctgttcaggtgtctcacctgaggaatgattttcagtgtaagttgcttgagaattatgtttagcacaagaaagtgtttcctggctgactagggctgtgaggaccactatgttaggcaatctgggattatttacatgggaatcctacttaagcaacttcaaatgtgttcctttgttcccaaggagaggaccaccagtaaaggaatgttctggggtggtgggacacacttactgacgctgcagttctcctcatcactcccatccttgcagtcctcgtcaccatcacattgaaacgtgctggggatacattgtccatttctgcattccaccagaccctggctgtgacaggctaggaaggaccataacaatattcactttatttattaattcttctctctcaatctgcacatcaaataagcaacagccatttatcaagcatcgctaagaaacaaggtgttctgcacacacaaatgaacatatcattgattttatttctagaatttttcctgccttattgaacagcacttaccaagattaactttttcttgagaactgtgtgattgtttttagtgatggaagtatcatgatcctacttactaataaaaatgacaatttgtaaagggttcattatatggcaagagctgtgctaactgcattgtatatataatctcaaattctcatataaatcttgtaaagtagatactatcatctttgttttacagatgagaaactaaagtttacagagcatagtacttgctcaaagtcccatggctaagagctacagccagaatgtgaaggcaagctttttggactctcagccccaatatttcattatttatctacttgacctcataagccaacaaaatagtatatgggaaagaacttgcatagtaactaacacataataaacactttatttcaacacttgtttatgacaactgatatttgaaagggatggcctaatatccattaaccttctaattcctatcggttctctaaattctatacctattgtcttttagagtatcggaaacccatggatcatgtgacctcagccttcactgaattactaatattatgacctctctgttcttgagtcaagactccacaccagaagtgttctacctgagcaccatgtccttgcttctccaagatctagtgagatacagtccactctgttccactgtgtccactaggcaaggactcggaggacatcccacttcaaatccatttcagggaagaggagagctacgcattgtgactttttatatgacttttcttatgtcaaaataaaaactatgtaatccacatttctatttttgcctcaaattataagccaattaaatattcaatctcatgtatataatcaactttcttacttttactagacacaaaaagatgaaatgaaaagtataattaattcaaacatgcaaaagaacatatcacattaactctttcaggtcaactgcactctctcttaagacctgacagcttctattcaatcatgtatattattctctaatgggtatagtatattttccagggggaaaaagtgttaatagccatacttgttattagtttgaagtataacaactgtctgaagattttcattcacacagaaacacaacagtttataaatttatattattactacgttctctctttttttttttttaaagatggagtttcaccctgtcacccaggctggagggcaatggcttgatcttgactcagtgtaatctccacctccctggttcatgccagtctcctgcctcagcctcctgagtagctgggactacaggcacctgccaccacacccagctaatttttgtatttttactagagactgttggccaggctggtctcaaactcctgacctcaggtcatctacccatctctgcctcccaaagtgctgggactacaggcgtgagccaccatgcccggcctattatgctctctttgtatcatcatatgaacattaaaggctctcttctctctgacgattctttccatgttcttccacaaatggcccctgaaaacatgttagggcactcctgcagggaagcttaactactcatgtattgtttgcagaagaaaggttccccattctgtgggcagagcatcacctttgacaaagtcacagaagcataaaagagacatatggagcaacgagagagaaaacagacacccacttggctagatcagccaaatgaagcttggagttttgcagggagaggtgtggaagtcagatacactccattgctattgtcatcccatgactcagtgatctttacaggctagaaccaaagcataagaatctttcccttggaatgctgtgtatatagtgagtcttaagtacagtcctcaaccttgagtacagcctaaagaaccagaaatggaaaaataagcaaaacaaacgtcctcagagcactcacagcagttgacctcgtcagacttatccacacagtcgtggtcaccatcacacacccactccatggcgatgcagcgcccgtccccgcagcgatgctctgttgtgggattgcaatctggagaaatgaaaactcacgaggatgcagagaaccagcatgactaacaggcaggattctatggctcccagttcccatcgaagagagtctgttccaatggctccaataccttcaataacatttctacaataggtctggcccaattaaaatgccacgccctccccactcatgtgccccactgaccaccatcactgtggggtaagatgggtctgtttttcagataagtaactactctagctgccccaggacccgtagtttgttcttattgttgttggcttttgttttctttagttgtcattttctttccttatgaaaaatttatgatttctaccctggttcaaaaaacagaactgtgatttgtgtttcacaatgcggctagcggatttgatgtatctgtaacagctctctcacgtttctaggaattataacttacctgtctggcaaattgggaaggcacgtatctccttgtcatctctcctgatgctaagcttaagtttttaattgattatcttttttttgagacaaggtctctctctttctcccaggctggagtgcagtggtgtgatcatagctcactgcagcctcaacctcctaggatcaggtgatcctcccaccccagcctccaagtagttgggactacaaggaatatgccagcatgcctggccttatatccaaaagaactgctaggtaagccatgcaaaatatttatgttatattcatgattctttttagcctggacttcaactttgtcccaatttatatattagtgaaaaagaactaagtgataagttcgctctcacaaagggcagaatccataggatgctttgccatgagaggtggtataccctgaatataagcagtgttttagaagatgtatgtggattcatgaataatagattccatgagaaagtatgatgagtctagtaacagtgccatggtcatagacagacttccggagtgaccatggatcttaaagcatattttggatcaacagaggaaagtatagggaggacataggtttgagaaaagaagaaaagcataagaagtgcttgggcaggaaccagaagagcacagggagccagggcagaggctggtctgaaggaaagtgataattattgctattagatggagacaactggcatccagacacacaaacttcatgatagcctgctatcttcagaggaattctgttgcctgttaagaccattttttctcacatgctacctgcatgctggccctctccactaacctatccaactaccaaacgacactcactcattttcaatcccctgcatttcctaattatctcactggtaaagggaagggttgaatctgatgatctccaaggcctcctgcaactataatttctgtgatctatataattacaatttcctctcatcctttttctcaagactagtcagtcccaggatataacccacatctaaatgtaaattagtatagtcattatggaaaacaatatggaggttcttgagaaaactacaaatagaacttccatataacccagcaatcccactactgggcatatacccaaaggaaaggaaatcagtatatcaaacagacatctgcacccccacattcactgcagcactactcacaataaccatgatatggaatcaatttatgccatcaaaaaatgagtggagaagaaaatatggtacatctacacaatggaatactattcagccacgccaaaagaataaaatcctgttatttgtagcaacatggatgagcctggaggacattctgtttagtgaaataagccaggcatagaaacagaaataccacatgccctcactcatatgcagagttgatctcatggaaatagagagtagaacagtggttactagaggccagaagggtatggaggaggagggacaaagagagattgctgccaggtgcggtggctcatgcctgtaatcccagcactttgggaggccgaggcaggcaaatcatgagctcaggagttagagaccagcctgaccaacatgaagaaaccccatctctactaaaaatacaaaaattagctgagcgtggtggcacacacctgtagtcccaagtactcaggaggctgaggcaggagaatcacttgagcccgggaggcggagattgcagtgagccgggatagcgccactgcactccagcctgggtgatggagcaagactccatctcaaaaaaaaaaaaaaaaaaaaaagagagagagagacagagattgtttaactgatacaaaattacagctagataggaggaacaagttgtaggtttttatagcactggatggtgactatagttaatgataatttattgcatattttcaaataactaaatgagaagattctgaatgttcctaatacaaagaaatgataaatgtttgaggtgatggatacactaattaccctgatttgatcattacatattgtatacatgtattaaaatatcatgctgtattcaataaatatgtacaactattattagtcaaaataaaataaaaataaactattatcagaaaaaagcaataacccacctctatctagtcacacaggaatggtttgtacacatacattttaaaatatttttacagatacagcaagtggcagctagacagcgctcctagaaaccaccaggtttcccagcatggggttattcctaacattcatgattccaatgccttcctctgaccataccgctgatccttcccaaacattcattttgatgttatctaatgcaggacattgtctgatatcatttgtccagggtgtatcctcatcccagtttgcccttttgttcatgttgcaaagttcctacgtcactcaataatatgctacctaaaaattctgaagctagtcacaaagccaaaaaagtaaatgagcaagaggaattttgctgattttaattcatgagatggcattcagaattggacatgactctttaaaaagtggggttattctttaaaagataagatcaccatgtgtacacaaaacaaatgcatcatcctaaccctgggtgtagctgctgaacaggtggtccctgtactatttgaggattaaataaaggaggggacttcagtcacatgtaccaagggaatcaggcacagacaatatatctgccctcaaagtttgctcaaaagcccaaatctaacgtaagccactggctctaaccagaggagaaacagaacacatttgaggagaggaaaaaaaactattaatgcattaacaacctttaccagtcttcccatcccacttcttaaacattttcttaatatgattttttaggtattacatttacacataagacattactgaggacagtgactgaacaaacttcctccttctaaaaaacaagaaaccaatcattttgtaatttaaactgctaatcatattaacacataatgaactgtaagtttttggttataaatttctatgattttaaattaaaacctttggggaaacaatgctacttaccacagttttgctcatcactcaaatccccacagtcatcatatccatcacacacaaggctgtaattaaggcacttgcctgtgtgacagtgaaacagattctcgctgcagtctgcaaataaaagaagccaccagtgtgtcatcagagccatacagaatgctattgtagtacgatatttaacaaaagccaatcatggaagggacaccctaatggtaacctggtccacacctattgttttataggtgagaaggtggcacacagagatacaacgacctgttcaaggccacttgaacagtggctcccaagccaagtgattttatcactttctgatgtgtttctctgacttctattttatgtcacctgaacgatccttgattgttaaagatgagaaaagacattctcagttcaccatcattcctaatgaagttcttgttcatgcagaatagactttagtaactcttatgttttctttagagttgaagtctaggtttgtcagtagaaagcataaacataacaaataaaataagtcatttagattatggagttattatttcctttcacataaacattactgcttaagtcaattgagtgtttcataatgcaatcctcaaataagcaagtactgtccaaagactatggtggcaagatgagaagtgctatgtaatctcaggatgcttatagtttaatgttgaaataaacaacatccagggcaaatggtttcctgattttaataggaaaataaagtcttgtccttgggtaaaccagaactcctatcctggttctgccatctactagctgtgggacttttagtgtgttattgttagttcaagtctaggagtctgtgaactgatgtatgaaattgggacaaaatcagccacttaatagggtttgaaagaagagtttaatgaaatagtgtgtgtaaggcaattcaatggaaagagaatgttcttttcaacaaacggtattgggacaatactagaataatatttgcaaattatatgtatgataaagaaatttggatatccagagtctctatagaactcttacattcaataatcagacgaaaaagaattcaattataaatggtcaaaagacttgaatagaaagtcttcatgaaagacataaaaacacatgaaaaggtgctcaacgttattagtcattaagcaaaggcagcgggaggtgagagggcaggacaaaacaaaagaaaaaaaaataagctaaggcaaattaaaaccacaagaagatataactacacatcccttaaaatggctacaatggaaaagatggataatagcaagtattggcaaggattttgagaaaatgaatctcatggatctctggtgagactaaaataataatgccaccttggaaaactggcagtttcttatgaaggtaactgcaaccttaccatacaattaatttgtgaattccactcttaggaatctacccaagataaattaaacatatatccacatgaagatttatatatagatgttcacagcagcattattcataagccaaacactggaaaaaaatccaactactcactaactggaatggacaaacaaaacgtaatactcatgcagtgaaatactactcggtgattaaaaggatgaaactaccaatatatgtgacagtatggatgaaccccaaaaagttacgctgtgtgaaagaaatcagatacaaaaattacatattatatgactcgtttatggaattcccagaaaaaacaaatttatagaaacagaaatctgagaagtagttacagtagctgagggattagaattggtgactgactacaaatgtgtgggagataaattttgggggagatgcaaacattctagaactgtattgtgcggttagtcgcataactctataagtttactaaaaatcaatagatgaaatttataggatgtaaattatacctcaataaagctgtaaaaatgtttaaaatcaatatatgtaaagaaatctgcattttacagaaactagatttcttaagtatatttttatttcccttatttaaagtaaattaagtgcaaaacagtttgcttaaggctggagaaggaatacagaaaataggcggaatttcaatagggtggatgtaatgaaaagtttagcatatttcaagcagatgaaatagcaagaacaaaggaaagaggcaaaaaaatagggcacgtttgaagatcagtctacttggctgatgaaggccagaaatcaagcagtcagtggttcaatctcctgaattccagctgattgtttctcctcaagcagaagcctgtatctcatacaagtagcagccaccactttactgtaaacatcccatactagatgacgattcgttatccaaagcctttggcattgatcagttaaaacattaggcttgccaaaatatgacacttacatatacatgaatcataaattactgtttcaaaaaagcactcttctaaaaaaaaaacaacttaaagtttttagaatcacatcattttaggaatggaatgggccttagaaatcacctgttcagtgtcttcattaggaaggtgtgtatgtgcacagacacacacacgcatatatacacgtaagtccatacttataagcatacagaactttgtaagtactttttatttttcacttcccccagcctgaataattttcaaataaggacagccaccataagggaaaatataagaactaagaagtcctagcgatcaccttgacaacggtattttatcccactcagcagagggcgctatttccccaccctgcacccccactgctgaatgaggctacaacacatgtgacagctgagtggaaaggttatgacactggttcttctgcccacagggtagatctggggaattcgtgcatcaagatatatacactaccttgtgaaattctaaaagatctttttgatgtttttttgtcttaatctaaattactcttgtgggaagttttgagtcaacatgctagaatcagcaatagcccgggaaataaggcttctcaacttgacgatcagtgcaaagtatacgcatgcattcgcccagaggatgggggacagtgtttcagcacaatttaaaccctaggagttaatttctttgtaagcactacactcactttttttgacagtaggactactagggaatcaaatacccctttcagaatctgattaacctaagaacacaccaaaaatttccaaaagtttatttgtcttctatgaggcccattctaggacccctggtaattcatactaaaacactgcattggagatattttaaaaattgatgtcctcatttattaaattactttataaatggagaggattcaggcattttttaaaaatcctcattgttctcccaggtgtggattcaactttctactattataacttgcttggttagaagccatttttagaagtgagatacaaaatgagctgcatttggaaaacaatctgttacttccctaaggtctgtgtgattagtaaacacgcaaaaccttaaccagaggcactgcaaagccagaaatacaaatggcaaatgcaaatacagtagcaaatggcaaagatcacagtgtctccttttactgaaataaatgtttatttgacctggaaagagatgttgtcagtgcaatttggggccagcaaatcaaaatttgaaaaagctgcttgctgtgattttcttgctcaataacaagcataattttgcatggcctaaggtagatgtttttctagacacacctttttttttcttaaggagagcttgatacaaaatgtttcttctgaaattcttgcatgttaatattgatttcagtttggcatctcatacgcacactattaattcttgtctctcaaaattattgttaaattagagcagaaaactaacacacagaaaggctttttctcaaaggcttctttcaactgtacagtctctatgactataaacatgaatgtgttgcctcaactcaagatgcaagtacggatgctcagtttccacccacagaagattaaatatggaaaggaccagaggttatttcatccaatcctctgattctgaaatgaccagaggagttagacggtctgtccactgttgctcagctcatttacagcagaaccatgagaagaaccaggcttcttgactctctgagttctttctactattggcttccagctctagaaaagggtttctcaacggcagtatcatttgacattttggactgggtaattctttgttgttgggggctgccctgtgcagggtagtttgtttagcagcatctctggcctctacccactagatgccagtagcacctccctccactctcacagttgtgacaataaaaaaaagtctccatgcattgcaaaatgtcacctagagaattgaaaatcatgttgcacagtatacaaacatcacctgagtgcaaggcctagctttaatcccatcttttccatcagctgtctacgcaatccagcttctagtaatcttactctttttactagaaggactccctgctgctgcctttttttgtttgcttgtttacctcaatttttttgactttgtgatattgcttgtgttatactgttttaaaataccatatttaggctgggcacagtggttcacgccggtaatcctagcactttgggaagctgtggcaggctgatcactttgagctcaggagtttgagaccagcctgggcaacatggcaaaaccttgtttctacaaaaaatacaaaaatcaggcctggcgtggtggctcacgcctgtagttccagttactcaggaggctgagcctggagaattgcttgagctcgggtagtggaggctgcaatgagctgagatcacacctctgcactccagcctgggtgacagagtgagactccatctcaaaaaaaaattttaaaaaacatatttaatagtttctatgtgtatacgttagttccctgatttgattaaaagactcataaagaaagaaaccatggcttaacagtatctttctatttactaggtagctaaaacatgattcatacatagtaggaattaaagaatattcaatactttgattgattcagtataatcagattgccactatacaaaaaagtaaaatttgcaaacatttagtacttcttccataagcatagagtttttttatttttataattttgatgaaactatttctagcatttacttgcagctacatcttagtagaaagattattatagatacagtcatttttgatgattcaaacatcatttggaatatcaatttttattttgtgctttttaggctgcctccattctaaaatagcttcacgtggtgctgcttttaaaattgttgtgcatattttgtgtttctctcttccttacatgtatcagctgacattatcagctgtccccacgacttccagtggtcattctctgcacctagtaacaagaggtgctgggtgggagtggaggaacaataagataacaacagtgacaacaacagtcacgaccgcaaatcctagtgctttttgagacttactgcatgcaagacattggtctatatgctttatattcagtgaatcattattctgaacaatttgagagatattcactatttattgtttccattgtactactgaagaaactgaggcacagagaggttgagtaacttgcctaagttatcagaggcaggaaatggtaagatcgaaacctaagcagcctgactcaagaatttatagtagtcattactacaccgtattacactcggtgtaattagatagccaccatcctcaaaaataagtcaaccaattttacccaaaattcacagaaaatgattttcaaaaatatttgatagtggtttttatgtgtcataaaatgtgtgaactttgtggcagctatttcactgtgaaaacgttttccttgagtttctaatttaaaattaagaagtattcatctactaagcacttgctatgtcctaggcactattctaggagccagttatagactcaaaagattatagaatcttaacaacaaaagagacaccaagcaccttctagcccggtgcttccaagtctggccgtccattagaattacctggagagcgttacaaaagtactgctgcctggtccccactgcagacaaactgaatcaaaatctctgcagatggggcttcctgaggaggccagcatgcagccatccatgatgatactgaaagccagggttacagaagtggcctgcctaaagccacagaggtagacatttctaaaattttcctggtttttgaaaatttttctactgcaccactaaaattgtttcaggtgtttggaaatcttttcatccaacaaatacttaagaagagattgacaagacaaaaccagttaggggagaaagtcagaaagtcacagatacctggagtgctctttaataaacaattacctctgaaagccgtaatacatcaaaatcagttaaaacattttcctgcaatatgaatgatcagagtataatctcactaaatctgaacttttttatggacaaggacaagtcaaaggcagacgagctgaaagaaaaagcattagattttgaaccatttaagactgggttcaaatttagcgaatcatgggcaaatttattcattgccctaagctctgtctctgcacctgtacaaaaggtggtagataacacttcctatgctgataattaaatcaaagcatgtaggtaaatgcttctagcatagtttatgaggtaactcacaaataataagtcccttttctcccttcctttgaacctgactaaaaaggaaattaataactcaatgaactacacaggccacctaatatgacccatgttttataaaagcaggcaagtgcttagctagagatcatttttgcatctaatccatagaagcataatctcctctgacagtcctccttcttgcctacttgcgagaaccttaggaactaggcattttcttctgttcctcactgagaacgcacagcaaaacttccttctcctctcatgagtatctgtgggttgcattcactctgattcacatccaaggcctaattcagacttacactattccttcaccacagggtggtgacaaaaggagtatggcaccctccataaacactcatgctgaaacaccacaagcattcaaccttaaagctcaaaagcagatgtccttgtaaggtcaaaaacaattgcataagaagccttcaatgtctgtgttttcatacagaagttttctgaagggatgtatttccccaacggaccaaaagatcatttttgtgatatgttcatgggaaagggccatatctattttccttaataaatgcttcagctcctcagacattggcaaatgccttgcaaaacagtaacacgttgttgacaaggaaaattagccccttcaaatttaatgttaacaaatgcagcagaaagcacttacagggtttggagtgcaatgctcagtactattgaggaacatatgataaaaaccatagttggcccaccacaggagatacaggcatatgcagaatttgaacaataccataacttgggccacaatgggagaatagctagagattctaccaaattcccataaattggatatcgttacattgaattatttaaagttccctattttggctgctttgcacagcatcttctgctaagcccacagcaacacttcccagtgtaaatacacagcctacaaaaatgtttttatgtaaaattgtgtgccatgcgttgttttgaaaagaaaattccaagtcgtaaaacacaaatttcttactgaaaagaacgtttcctgaaatatgcgtggcataattgaagttccacgggatgctagatagtaggcagaataaaaaatgcatgaataaatgaataaataaaggtgaagattcacatgagaaataattctgatgaaataaaaagttaggcaaatgtctttttttaaaactacagaatttctcagaacctctaatatacaaatgtgtattctaaccctctaagaagtagacctgatagtatttcccaaagtttttttttttcaagcattattccagactcagatactacatgaaacaccagtttgggaaacactgacctgaaatgttaccatgataaactgccattcagtagttctgccattcagcaggacaaaggagcgtcctagcccatcagatgaaagatgagttggtccatttggcaaacagaccagaagaattttttgattaagatcagtattctcaagcacttattacatcttggcaattcccatgaggagtgaaacacagctcttgccatactaactgtggctgtttatataacccttaaagaacaattagaactcagatgaaagatgagttggtccatttggcaaacagaccagaagaattttttgattaagatcagtattctcaagcacttattacatcttggcaattcccataaggagtgaaacacagctcttgccatactaactgtggctgtttatataacccttaaagaacaattagaactcttgcatgtagtgttctaattggagatacttctgttttgaatacagattactcagtgtaattgttttctttttttaacctactaggggtgaacaaataggacactagctttgtttattacaatgtacttcttcaggatggttttccccttctttccagtttgtaagtgcaaaacaacttgaaatctgaatctatattggacaaaccactggccaattcagtcaaaatgactaatcaatcaatggggaataaattgaggacacataaggctgaatctactgattagtggattttaaacagttagtgccattgactatctccaggtttggaagaagcataaaaaaaaaaacaagaggctttgtatttactgtgtcatgaaagttaagaatcattagggtgaaaatgttgctataaaaatgtccttttttaaaaaaaattgacctttatactcataaacaaaaatgaaaattctcacccaatcaaaataaaccaaagccttctcccaatttaaaccactttgtgcaaaaacgctgcaatccctcatctgttccaatgcagcctctacctgttgagctcctaataaaccatgcctttgaaaggtgtgcaaacatgctgctgtcattctgggggaagataaacacgtttgctcgctttagaaaggcaaacaaaaagcagtctacacaaatgctgatgattgtcaggatttgagaatccctgtccactcagacaaaccctaaacagcttgtcacatactgcaatgagcctcgtcactccagtcgtcacagtcgttgtagccattacattgcagtttcccggggatgcagattccactggcacacagaaagttctcaccccttccacagagcactaaaaaaaaagggcaggaaataatgtcagaataagatgggttttttttcttttaagattacaaaaaataaatacatagaaaatcttcttttgctattcaacagatttgtttccaaattccctcagttttattgtcatcaatttttctttggcatcctagcacattaattgaaaaattacctggaaataatacaaagagtgattgcttgtctgaggaaagcaggagatagttcaccagtgggcttgcagagtgaggcatccatgttcagagagcaagagggtagcttcatcatttgcacaatttatgtggggagaatacccaatgggtgtatctttctaaataattgaaaattatgtccaagtaaagtgctactaattgaaccaacatttaaaaagtctacctttctaaaaagctactctatgtaccacagagaaagttccagtaaaaacagagtcagtaaataaccatttactgtgtgtttgaacatagcatagagacccagtgccctgtatttgaaatgtatttacttgccttaatgaaaatgccagttaaaatgtcagcgtctattttggcataaggaacgggaaatggcattcactaataaaattttcatttatttttccttaacacagtgacatttttatatttttgcttttaatattttggtgttctttttctcttcaaaatgcaataagtattccactgcttcaaaattacagtagacaataaatttaagacaaaaagatacaaaatttttcaggaagaccattaataaaaggataaatcagctcaacaaagtggatgttaagataaaaaatatttggtaatgtgcatcaaatgccttttaagtgtgcataatctttgactcaggaatcatcttatttcttagacttcacaaaaaggaaatcattatgaatttatgttttatgtttaatgatattcataccatcattgtttaaaatgaggaaactatgaaataaccactatgcaatattcaggggctagttaaataaattttgataccaccataatgaggaatactgttacagccattgaaaactacattgtagaaaatacttaatgtcctaggacaaagttcaagctactttagatgagaaaacaccaactggtcctagaaaacaaaatacagtttggcatcgggagaggtatattatctttggtattaggattaaagtaagtttactttttactgtattgtattctgcattttacaaattttcttacaatgatgatgttttatctttttagctgggaaaaaaataacttttttatgagctctagtttcagataaaaaaaagttaagtagaaccttcaaaaatctccttctgtctctctctcaccttccaccaaagcttgtgtgtgtgtgtgtttgtgtatgtgtgtgtgtgtgttgactgtgtggtcagttgcctggtcactgccaccattccctgcagtatgtattccttgataagatgaaccttgttgactagttacagggaatccaggaatatggaacattttaactcagcaatagaaatagagaaaagtacaggctgaaagctccagtcaatgaagcccatgtctgttatagttcccatcatgttcctaggacccagcggagtgcctggcactcaggaggttctcgattaatatatttcccacccatgttcctgggacccagccagtggctggcactcaggaggttctcgattcaatggaaaaagttacctaaatccctaatagaacaatatattgccataaagcagaaaaaaaacaaaattaatgaattatttcccaatgctatcaaggaaatcagcatttcaactcattgaacattaagcattagttgatctggtaagtttcttatgatactacttcatgtaacatcttcacaatatcaacaacaaaagcccagttttccattatagtccataatttcagtatcaatacaaattacatctatggatttcaactgccaaaatatccaacatgtttagtatggtgtcagaagattccgcacaggagtgcactcctatacctacaaatacagactcctaaacgattcatagaaaaccagatctaaaaatgaaaaaccaaaatactaagattttacctatccagtctgtacaatatcctctctctgggtttaagagaaagttttaaaggagggtttatcttattgtgagattgtttctgtattatactagagagtgcaaaaattccatatgtctgcatttcagcagctgcaatgcctcacaagaattattgcattccccacctatggctccgatgattcctcaggaaatggaactgaaagctcaagattcaatagctcctaacctccagattttatctttaagaccctacatatttgactccagtaaagccatttcttgcatatggtcatctcaaatctggatcaaatttaaaacccagcacagcttgcattgttttgattattgatatcccctgtcttggctgattcagcagaaactgacttcttttgtgtggttcctcatctggaagtgtggctgtccttggttttagggtatcataaattgttactgtattcttgttcttttttgaaagttcacagttttggtagttaatattacttttataaaactagaataacttttgtaaaatctttctgtttgatttcttcttaacctgtattcagaatttccactttacttgtataaaactgttcaattattaaagtactacaaacatattttatttggtagtttacaaatgaaggaaatgaagtatcatgaggtcaacattgaaatgggccaaagccacataattaaggaaagatgaaaaacaccccaaatcccaaggtctatgatctaggcccaatcctccatgccacacccactcccctgttcctggtacttgtgcaatagtgtagtcggctgatactcggccagtttaagggcactaggtttgagtaaaacttcaacattgtctttttctctctaaacaaaagacaaatgtctgtcttgcagtgaattggatccagatgagatgacattccatgtcagttctactttttttgaacaccctgagagagctcttatcaggtttctgtagagatttttctaccataaatatcactgtcttataacaatcattttccaacaggcttttgagtggccccttaggatgacaaagggagattccatgagaagtcatgctatacaatcttgaaactatttccactaactataattctaagaggtatatgttggaatttaaatcaatggcagattgataactggaacattcgttcattcattgaatatatatttactgagtgtctactatgtgcaaagtactattctagcctctggtaatatagcagagaagaaaacaaaaaaaaatccccaaatagagcatatattctattgatcatcatctgatgaagataattttaccaagtaaagatacttcactgccaaagctgacttccattacacatgggacagttaattaatactactgcaaaaatagcagtatatgaagttatactgcctaaaaagctagtttacatgtccagatgatggggacaattatggatcccctggacttcagaatgacatggatcttgaagagtacatacccaaaggatgatcagctcttttcagcattcttgtctctgacaacagactgctaaaataataatccctagcctgaaatcaccttgagattttctgcaattgcttccagcttcctaggctctctctgtctgtgtatcaatattattggcaaatgctcttattattctggttgttaacttttagagtccttttcaaaaattatccaccagcctgccacggactgtatggtgcccttacttgccctgtctttgagtccttgctgaaagtcaaaagctcagtttcaactccacctcggaagagaaagctgacacagctctgcacatcacatgggcccgtgctgagagcctgtcagcgctccattctccatgctgctcgaaatcaagtactataaaccactattgcccttaccttttacaaggttatgtcattagatgaaaaagactgagtgtaatctttcagcggctgatacaagaatacttcttggggagagcactgtatctgtaggcacaatagattggtaaaaggattggggtaaaagacaagaggtgagaaaggggagagaaaatctaagggtgtgctcaaccaacccaacatggactttaccctgccttctgaggaggtgagtcatattagatggaaggcccttcattctgctgaaattaagatattttcagtaggtatggatgagggtctggaagctctgagtacaaaaggagtgaggggccaggtgcagtgccgcatgcctgtaatcccagcactttggaaggccgaggcgggcagatcgcctgaggtcaggggttcaagaccagcctggccaacatggtgaaaccccatctctactaaaaatacaaaaattagctgggcatagagacatgtacctgtaatctcagctacccaggaggcgaggcaagagaatcaatcgcttgaacctgggaggcggaggttgcagtgagccaagatcatgccactgtgctccagcctaggcaacagagggagactctgtctcaaaaaataaaataaaataaaaatgaaaataaaaaataagaggagtgagaattcccatgaggagaaaggggagctggtgctgctgggcactgtgctgggggagagagaaatttgaaaaggtggctgagtctccattagaagtacagtatttccattttttggaaaatagaaatatctaatgacgtattttaagttatttcatgaggaactggagatataacacacgccttcctccatctgcaaggcttgtgttgccctctgatttatgcactcatttctttaacattctgtattattacagaataactattattctgtatattctataataattaattattatagaataattaatactattctgtattatgtatttttgaatacagaatagctcccttgccttgggaagcttatactctagaatgacaaactatatcaataagcataattttaaaattcttatataacacacaagatgttaataaatgctatgaagaagagagtactgcagggtaagggaggtatagggtataggagtggggtaataacattaatattattaatattggcacccaatattaattagggtgccagggcaggcctcactcaaacctgacatttgagcaacaacttgaaagaggtgagggagtctcaggaagattcaaggaagagctagtgcaaagttcctccggcaagagtctgcccggcaggtgtcaggatcagcaaaaagacctgtgtggctagagtagcatgagcagggaccaagcacaagaatgaggccaagcagaagggagggtccaaacacacaaggctctgcaggcctttgtaaggactttgtaactttaacacaagagtcattacatggttttcggtaaagagtggcatgatctgactgaaattcttaaaggattgctctgcctattgtgttggaaatagactctagggggacaagggaagaagtagggatagcagctgggagtctatttattgagtagctgtggaggtactgagacatgagtggatgctggatgtacaagccatgtaccacgtaacaacatttttcttaacaatggactacatatacaacagtggccccataggattacaataccaaatttttactgtaccttttctatgtgcagatatgtttacatacacaaatgcttattgtattacaactgcctagagtattcagtacagtaacatactgtataggtttgtagcctaaaagccataggctggactgcatagcctggacgtgtagtaggctctacatctaggttcgtgtaagtacactctgatgtttgcacatgatgaaatcacctaccaacacacttcttagaatgtatacccatcgttaggcaatatatgactgacagtactaacttctgactataggttggctcaggtcaaataaacaatgaccatccttgaatatctaggagcttgggaaatttcaaactttcttttgaaaacagagtatcatccacatcaagaatatacttacaatctaaaaatgaattcaatctatgtctttctgtccctctaatcccatcattaaatgtggcttcctcagaagtatctgtgttccaagctaagcaatccttctcactctcttcttagacatctattaaatgcagggcaggcactacactaaccactcctaatagtgccagtgcccaagaccatcaaaattgcagtcttctttaaaaaaactgttttattatagctcacataatttatattcacagaagatttccgtttgctgattgtctctctctcccttctagaatgcaatttccttgaagaaaggcattttatcagtttttcttactgctataccctgagtctagaatagaactgacacattatacgtgcaagttagatatctgttggataaataaatgaagactgagaatatgaggtgtctatggagcatgaataaatgatcgttcctatttattggctctcaatggcaatgaatatcttacaacttattatttacattgctaggagaataaactactgatgcaggaataaaaatccctttgtgttacagtgtgatgctcactcaagcctgcagacacatctggtttatgagtggcatttgctcttagtaggacaacagatggcccttctgcggaaaataatcttccccactggcctgtgatgatgtgtctaacattccacccctgacacccacattacccacactttgggttaaaatggtaggttttagaagaactctaggttagcaaggaaaggggctttggggccacatcatggattaaaggggtgtattcagtttcctactccatttcaaccaaagagctctactgttggctgctttatacacatgagtccatggaaaattttctttgaaaatgggcttttgttgtcaaaaacaagtttgaaaactccttcacccttaagattttctgttcagttgaacacttagttctgaatgtaattatagactgtttagctttatgttatcattagcttttcattgtacttagacttgagaaatgaaacatagaatgagtgacttttaggggtagagggggactcaggaaaggtatagaacatgaagactcagagtaagaagtgacacctggacccacaaatgagctcagaatagccctgcttgaaggtgtacagtgtgtggattcaacgctgttacatcagggtacaagaaaagccacaatattttcttaaagtaaattcatacttccccactcaaaaagctgatgagaaagatctttcaggcatattttgcagggatctctccctccttaggatggtacaaggatgcaaggggcttacatggaacctggaagaacgaaggaaggacttctagctttcattcctcagagaactgccagaggctcatggcctctaagtcctcaagtgagtgctagacagaacgcgccattgtgtctgtgccaagccagggtacagggccatggtccccagggtccagctttcctggctgccccacacagccattccttttggaggtccagcctcttctacaagcacgtgagcactggtctctgctatataatgggaaggccatcctacatccccctgcttcctcctccaccctccagacatttctctccatgccactcaacctgggtgacccaacacaatctctgctcagtccttccctcctcaatgctgctttccctttccggaggctgcagagatgaaaacacacttttttttgttttgtcttcttagtagatggtgctattatactgatgtttccttcactactgagaatgcaaaggtctccattagtaccttttaacttacacatttttggtgaaaagtagcatatgataggtggttggtaaatgcctgctgaataaatgcacttaaggagctcttaacatcaatattctaaaaaaggcaatgtcatggtgacatcttcttttatgggctgtaggcttcaccttgctgcaaagacaaggtaaaatcagccccttgacaacaatacaactctttcattcaacgtcccttggtgtcatttatatatcttttaattagtgagaaactgtctctgtcaaacaaatgttcagagaaaatcccaaacaactcctgaaattaagtcaactcattggttcatttttttcctttgaaataaagctatgctttgattcaatgaaaactttgccatctggccttcagcttaaattcctaaaaataagagctaagtatacttattgcctgcctgatagcatgatggaagagctattactctataaaaaaaaattagtcatcataacattttctaaaacattgtcaagaaacaacagaatagatctgtaactggtggcactttgataggagagagaatgtaaatagaatttagaaagcatttccatgtcatcattcaacatttcaagtacagtcacagtaaaaaatcctacccagtagattttaaatctaatttaaaaagtagaaagttttttttaaaaggcagagtaaaaagcaggaagctaagctttatgatcagagactgccagaaactgaaggccaagcagaaatctaaagaatcttaattacatttcaattttggaaggaaggaaggaagggcgggagggaggggtgagggagaagtcctaaatatgacctggaagcattttttttaaatcgttggaaaacaagatgtacatcatgattctgttatttatcatttcctgaacagaagtgcagtaacataatttcaaatttctaaaaaacatgggcaatttttaaacttttttgcttattatctatctgcctctcaatgagacagacagatgtttctaaattcaaagataatttctcatttaggtttcttgggaggtgctaccttccgaatttgttttaggaaataaacacttagtttctttaaaaaaattgtgtttaataatactttaatatatttttgagactttcctccaattataaggctgtttcaagtgacattttgcatttattcactatgaatcataaaatgatagcaatggaacaacatataaactacttctgacaaattttaaacaaatacaggatggtttctataaaagagttaaatgattgcatataaatctaagaaaaataaaggagataaattttatttggaaagaaaatagtctcttgcatacatatggtagtatctgaaaagctatatatatattagtattttttctagaccttttttaaatgtgtaactcagtcacaacgtttatggaaagacttaggacaaacataaacaaagaaaaatcatcagtttgaagagccatcccatggtatttttcttattcgttgggctatactgtacaaattgaacaaatttcattttacaagttaacaatttgtggacttcattccaactctaaccaaacttatttttaatcacagtttcttttagtccattttatgtattggctatttaaaagctaaaataaattgcctatgactttacaatattatgtatcctgagaaccagaaatagaaaaaaaacatacttctttcaaatttacagtgaaaagaactttgaaaaatatctttcaaaaacagattacggttctaccctaatgtctaaaaattcacttccaatcccatgaagaatgtattgcatcactttcctacctactctctattgttgattaccataacttgactatttcaaagcattagcattctttttttttcttttttttattatactttaagttctgggatacatgtgcagaacgtgcaggtttgttacataggtatacacatgccatggtggtgtgctgcacccatcaacccgtcatctacattaggtatttctcagcattagcatttttaaaaatccactgatcttcaggatattggtactgtaggacctcaactatcttccggattggataaccagcggttggatgccaagattctgaagccctaggtcagcactccgctggagcccctcctatactctccattcccttcactcaccacataaaccccacccaccagctcccatgcagcagccggtagtgacagcacatattcactgggtcaaggtagaattgggaaaacctagctacttctgaacatctgacccttcatgcttaaactaccccagaataatcagataacttccattctgaacactaccataattaagagaaaaaagttaatggtgaggaaatgagttcataaacaccctgatatccacactaatactgaatctacagaccagaaaagaaactattcacaatcatgacctgagataggaaaataaaggtaatcttgtagaaaagcagagattggtatttaaacttacactatctgcgctgctttggcgaattacttaacttttctgagcttcagtttccttacctgaatcccacctactttgggatcgtctctgagtatattaatcagtaatggacataaagtgccgagcaccaaatcaggtaaggcccagtatgttctgtttactaaggctgggaagtgtacaactcacctctgaaagatggccatctcaaactattgaaaaacgccttttgcttaaagggttaacctgcagttaagctgaggtcctaacccccaaacttatggatatagcatatctacttagacttggaaggtaggggcacctgggttctttgaaacaacccagataactggaggagaaagtggtctcaagtgatcaacacacacaggcattaatacaacaacatctaggaacagaattatttaatacgaacttctctttggctcataaacagaaaaggaagtcaattgcttcaggaaagttgattttcactgtttaatcgtttgtgtcctgttaaatgatttacacgctggtggaacacagaggtctctggattctttctcccaggctcctccgcttttctactaccgcatgcctttcacagcacactacataaaatctctctcagtatccctagttaccaggattgcatataacaaagccacacagactaaacctaacaggggaaaaaaaaattaaccttgcgtaaaactaaatacaagcacaatttaattaactcgcattccagagtcatagctcccaatttgctaagtctagaggattggttacacaacatccaagcactcagcagggaggggagaaaaactgctaaaatgtttccagaatcttcacaggactcacatgttcttttatactggtaaacaggaatgatggcccctgtgaacaatctatagccatccaatcaaggagacagaacgagccagggcaataaggggtaagaggttcaaagaggttgaagtttcaggagagactacaggggaagaaatgtacagaaaatatctggccttaagattagccctgagtcaagcagagaatggtctactttatccataaagagggaacgcattgagcagataacgggaagtcaaaaactgtgctcctattcctatgaactctcattgctgcaatttgagcagatacagagtctcctctaaaaacacgctatcgatcaactgaatatgcttaaccccgagaggtttcataacatgaagatatgtcagtggtggagggtgtgggaggaggggctgaactcagaatacaggtgatacttctgagagaaggttcatttttttccacttgacaaaagggtaggacacgtgcagttcccaagccatatcacacgatggcagccatactcagcacgtagtcgctgtgaggcacacacagggaagaattcagcctgatcccctcaactggtgagaggcatggcgacccagtggatttcagctaagagatatcttttctgaagggcatacttggcttgtgattgcgactgagtaaatctgaaataatgaaatcccacttctaccaatgattacttaaggtaagtgaaagcccttcacagtttatgcctactcctactgtttgcacacatttctactgctttttttccccctgactggtttatcagagctccttgtgttgcaattattttctcccagtgtttcctgtatttgtcttttaaatctatagcttcttcagctacatgaaagttttgcaaacgtgaagtctaacatgtcagtctttatggtttacgtcttcataaaccatgcttatatttgtgatagaacaaaaactctgtgagggcagtgaattttacctgtttggtttcttgctgtggctgaaggacccagaagagtgacaagtgtagagcatgaactaaataaactttgcattcacctagagcctttctaaagcagatggaaaatactactgccaaaattaagagatacattctggccacaatacaccaaaaacaggccacaagatagagaaactaggtcagatttcctaatagtcaaaactgatttcgacgtggccatagggggaggagacagattgatcaatcggttgatttttgttaaaataatcaagcttcccaaaagccatagtcaaaatgaaaaatacgtagcctgacctctcaaaatgctttccagattcaaatttcagcaaaagggaaagaaatttattaactgctttgaagccagtacctttcttaacacctaccacaagagggagaccacatcataaattcaagcacacggcccgtaaaatatttgtgaagtgccccccgtgtgtaacagtatttgaaaaccatcctatttcatgtgttttcagtatttattttaaaacaaaatcatagctcttttaaaaatcattttgcattttacatgccaacacaaaaatatgaatcctcataaaccaataactatgttatttgtgcatttattttagaatttgctttttacattcttataataaacaataacttcagaaattcagtttttactcagccagttttgtttcaaatggctttttatacatttttactactaatttgtacataatgtgatttctgtggatgctgaatggatttttcagcaggtgatctcattacaagataatctcattacaaatccctgttagaatttctcaccgtggtatccagattgaaatgaaattcttcacagctgtagaaaagttcttccgaaatttgttggtatcataagctctaaactgctctactctatggactttcaagaaaactaccaacttttgcctttccgtctggcggcagccatcaggtaagccaagatgggtgcatacaagtatatccaggagctatggagaaagaagcagtctgatgtcacgcgctttcttctgagggtccgctgctggcagtaccgccagctctctgctcttcacagggctccccgccccacccggcctgataaagcgcgccaactgggctacaaggccaagcaaggttacgttatacataggatttgtgttagccgtggtggccgaaaacgcccagttcctaagggtgcaacttacggcaagcctgtccatcatggtgttaaccagctaaaattttgctcgaagccttcagtccgttgcggaggagcgagctggacgccactgtggggctctgggagtcctgaattcttactgggttggtgaagattccacatacaaattttttgaggttatcctcattgatccattccataaagctatcagaagaaatcctgacaccccatggatcaccaaaccagtccacaagcacagggagatgcgtgggctgacatctgcaggccgaaagagccgtggccttggaaagggccataagttccaccacactatttgtggttctcgccgggcagcttggagaaggcgcaatactctccagctccaccgttaccgctaatacaagtaaagtttgtaaaattcatacctaataaacaatttaggacagtcatgtctgcttacaggtgttatttgtctgttaaaactagtctgcagatgtttcttgaatgctttgtcaaattaagaaagttaaagtgcaataatgtttgaagacaataagtggtggtgtatcttgtttctaataagataaacttttttatctttgctttatcttattagggagttgtatgttagtgtataaaacatactgcgtggtataataggcttaataaattcttaaaagaagagaaaaaaaagaaaactaccaacttttctcagcaactatcctatgaaaattttgtgacagtcatttcaagactgcttaaaagtagacagaacaggaggccaaaaacttcataaaatgtggtataattcgaaggaatcctgggaggtctctctgcttaaaatatttcccagctgaaattcctcactgtgaatcccactcgtttaacttaagccaaaagtcctcaattaaaagccaattcctaaggactcctctatcttgcaactaaccaagatttccagaggctctccacaaaaggcacagtcctggacatggcaaaactacaggaccttaagagatgaagccattatcagtgattaatacctcagcagatagcacttaatatattcatcttctttatttctactttttaaaagacattagagaatttagatgagaaaataggaaagggtggcatctaaagaatggggccctggtgagaatatacctgggtatgtactgaccctacaggaccaggggtcagtgtggggttagcaggggctaaagaagaggggagtagtaaattacaagggagtaagagtggagggaagtcctttgccatgctaagagccaggcatccatgatccttttaaagctaatacttatctggtgctttctcttcacagtatatgtcttaaagactttaccttcatttttccatagaacacattcaagaggtgataacctcgttgactagaggatgaaactaaagctccagttactttccccataaaatagctaataggtggtggagctacatatcagaatctaagcagtttgactccagagttcatgctgttaatatcaatgctcaagagggccgtattagtttcctattgctgccataaaaatttgccacaaattgggtggctgaaaacgacagaaatttattctcccacaatgctggaagtcaaaagtccaacaggggtctcactgggataaaatcaaggtgttggcaaagctgtcttctagaggcatccctcatttcttggcacatggatcccctttgtcttcaaagccagtaacatggcagttgtttgatcttagggctgtcatcacatctccttctctgactctcctcttctgcctacctttttaaagatgcttgtgactgcattgagcctaatgagataattcagaattcccctatttgaaggtcagatgaggagcacccttatttccatcttcaacttcaatttccattgccacataacctaattacaggtcccaggatttaggacatggacatctttgggggggtcattattctccctaccacaggtgccttaatatcttattcattttttatgtgcctctgggttccataccaacaaccacctgcaaatggctgactcaagcaagtgtgccttctctcccacctgctgactgccctcttcttccctcctattgcctttgtcagaaatgctgcagcctggaatctttctctagtcgaaatctttggctctggtcttatttcgctcatttctcctacagcgaggagccaaggtggcagccatcttggccatgcaagatcagtgggaggagaactgctgttagatcctactcctgtaatgagaatgttcaaaagactggggaataatactctaaaatgtaaataaatctgacatcaggccttggttcaaccaagtgttccctgtgcttttgtagctatcagctacaagtgcttgtgactttcccaggaagcaaaagctgagcaagaaacagaagagggcaatggcctgacgaggagcttagccttgacttccctccctttccatttgtcgttaacaacccaaatctctttgaaacctcaaaagagcaatatatttcaggacaaaaaataaggtaggagatgtcatattgttctgcagcagacatagaaaagacagcaaagaggcagttgcagaaagctgaacagatagataaatccttcagccagggctggctacataatttgcagtactttatttatttatttatttatttatttatttatttatttagacacaaggtctccctctgtcgcccatgcttgagtgcagtggcacaatcttggctcactgcagcctcgatctcccaggctcaagcaatcttcctacctcagtccccaagtagctgggacgacaggcacccaccaccacacctggctaatttttgtattttttgtaaaaacgggttttgccatgttgcccaggctagtctcaaactcctgagctcaagcgactcacccatctcggcctctcaaagtactagaattacaggcatgaaccactgcacctggccagaagtgctttaaagatactaaaatataaatatgtttttcctttaaaaataataaataaaataaataccaatacattattaatgtgacatcacaattgattataaggtttttttcttactcaatgttttgaaaatttattttttaggccatcaaaattgtactgtagcaaaattattttcattctgaatagctgtaaatggcattagtagctctacacacagacaaggttgcaagcaatttttgttaacttttaagtttgacaaggatttttcttcttatgcaactgttactggagctgttaagaatattttagaagctatgacaacatttgggataaatttcaataaattatttcaaaatacaaattttagtatgtctagagttgatgagtctcatggaacaattttaatacaaagacttaactcttcatatgagtcagttttgtgtaagtctgaattttaagtgtaaatttattcaatgacattttgatgtttcttctgacatttgctgaaaattgtggagatcgtacaagaaattgaaagtagcctcatgatttgtatataattttaagtgcctgtttatacattctataactctattttcaacttcaagggaaattttcattttattttatcttcctcattaataattggtccatctgaagttcacgtgaaaataacgttcttttccactgagaatgtgaaatgtaacttgtttctaagcttgtggatattcattttgcaatgtttcagcatttaaatccaaagattctaaaatctttaaagagctctaataattccttgataaatgctttattgcaatgttcatgtgtatgactttattttgtaataatctactaataacgtctacttcctgatgttgccaagcagtttctgtcccaaggttcaggctaaagcgttaatatttgtgtagatgccacagagacggactttggggacaaacagccaggctggcctcacaggggtaccagtgctgcccccctatagagctcctccttccccgcttgtccttggccgctgctaccatacctgctgcttctgctgttgccaatctgtgcccaggcactggcccggccaccttgttgccctgtaattaccagctgaagactccatttcccagtcctgtttgtaactaggtgtggcacaagcatgggctttgggtagccaggctaattatcccacatgcatgctgcctatgtgcccctgatgcacacgctataccatctagtctatccccactgctcacacgcatgatctattacccatcaaacttacctgcaaaatgcaagtttaaggataaagttattaagaattttaaggcagtgacaacagagcattaaaccaaatgctgatcccttctgagagtagggtcctgtgcccctgcagaagtcacccacccatgaaggcagccctgccctcagactttgaagaacaaagaatgtcaaggagggtagtgggatgaaagcttgagagaagtcccctaagaagtcccactggcaggggtctcagcatcccagtacccctcaaacctgaccccttgatcactgtacccatcttccacccacatctctcctgccacacccaccaaagtccatcctgcaggagccactctatagacaagggagccatgactataatgtggcagggactgccggttgtcatcagaatgcactccccgcgtttttcacagtaatggagtttaagatgcctccatgtacccagccaaagactacatttcccagttccctttgtgataggtgcagccatgttactaaggtctctccaacagaatgggagcaagtcattcttctacttcacctccttcaaagagacgtgctgccatgtacttcctctctgtaccattccacaagctggaacacagatacagggctcagccagctgcaaccacacaggtgaagaccatagtctagggattggtgaagcaagaaatagatggagcccaagtctttggataatttcatggggtaagcctgacttggcaaactgaaaagctcaccttggatctcttgcttaacagagaaaaaaaagttttatttaagccactctattttgggatctctattgttatggcagcttagtatttgcataatttgaatctggagagggttcattcccattgttgatctattcattgagcaggtctgaaaataaggtcaagcccctggtatgagagtaaggtccctgggaagaaggtgggtgggttcttcacatcacaatgagaactctgaaagcactttcccacaaaggcattcatttactcacgttagctataaacgtgacagacttcagcaatccagtccagcctagggctgtacctacaacattgctactacgagaaagcagctttcatatctgaaataaccaatttgtaaatataactttgaaatgcagccaatttattagctgaaatcttcctggaattctgtacctacatcatagaactgtagtgaagattaattgagataatatatgttaacaattaagcatagcatctgataccaaatgagctttcaatcaatttgatctttttattattactgacattattaaaccggcatcataatatagtcataattaacataatatagtcataatatgacacattatcatgatatatatgataatataatgtcatatatattgacatcatttaattatttttattttgagacaggatcatgctctgtagcccagcctggagttaagtgggacactctccactcactgcaaactctgcctcccaggctcaagtgatcctcctgcctcagtttcccaagtagttaggactacaggtgtgcatcaccatgcctggttaatttttgtattttttgtagagacagggtttccccatgttgcccaggctggtcttgaactcctgggctcaaacagtccactctccttggcctcccaaagtgctatgatttcaggagtgagccactgcacccggctgacatcatttattttaaggaagtatatggcaacaggcttggggaaacaatccttcctcccctggctgccacacagagagggataagagataaattacttaaatgtttacaaatctcttagtttccacaagaagttttagcaagtcttttcaaaacaaactgcataaaatattacctcaaaaatacatgaggtgttaaaatattactcaaactagtcaattagaagtaatgggttaagaaatcaccaaggaaagaaatgtgcatcagaaagaagaaaccaagaattcagtacatgagagaaacataaaaggaagagctgccaaaagtggagagtgggcatgattcattctggagatcactgtaaggtttccccgaaagacaatagaagaaataagttttgcttttacaggattaactttatagtagataatacgcatagatcagggtaaggcagtttttaaaaactgagaggaaaaatgggcttctactctgaaaaaaattagaagaatagaaagaaaacaataaaactttcttcaaagctatagggaataaaaagagataatggaaaaatcttaagacttaattaggtgtggagaaaaatctgccaagagatgaagccaagaagtcagattgttaattgcttatttatttctagagcattgtcatcagaacgtgaataatgaataagacagtaacaaacaacagaaaagtaagaagtagttgaacatctggggaaagatttcttaaataacctagacttggcagtatttcatccactcagcatttttaaggaagaaaatatcccatgcagggaaacattcaaacaactgaagcttatctacttaagagttgtaaattctttcatgattttattaaaattctgttaaagggaaacctgttctctactttctgaaatgtagtgtgttaattttaaccactttcttaatgctccagggtacttttggtgaacagcaaaaacttctcagccctgcgtggaggctcctggggtgaatttgtccccgtgctaacctgcctaagactttcttgctatttagagtgtgtcgctcttctccacgatgtaatcacagcagtcccgatctctaccagtgcccatatccctgcaccagtaactgtacccctccacatttccaatctatttcccagtaattacagagatctaggaaacccaaaaaagcaaatttttaatgtttttttttaaataaaagtgaacaagctccaaaagagggcctcagggaatctttttttttaatggcataaatgaacatctatttagatcataaccacttttgtttttttgctttttaataattacttatattctgagtaatttgggtagcaatctctggagaagtgaggtgtggccatatattcaaatgactgaattaaaatagaggtacctcatgaaaggagacagttgctatagtggaaagggcacggggttttaccaatggaactgggttcaagcaccagctctgcctcttaccagctgtctctgagtctcaacaccttactctttaaaaagtgaacatacacacccacaatgcagagttattttaaagattaaaagaaatacagtattgtgcctgcctttatacttggcacatatagagcttacgtagacaaactttagtattatttttatatctttgaatatgtatggacatttctatgtatgtctaatatactcacaagtgattaacacaaaccgaaaatttaatctgtaagaaaaaaaatctactttagattattttaggtaaaataagattcattagatttctggaattttacagctagaagagactggcaatcaatcacacagtcctgcttccaatcccagaaatgaggaaaccaatgctggagagtaaacatgacttggccaatgtcataaagctaattagaaactagaggtagaactggaactacgattttctaatgtccaattcagagttaacctagaacagagactgacaaacattttctgtaaagggccagatagtaaattgttagactttgtgatgcatacagtttctgttacaactgttcaactacaccaatgtggagcaaaagcagccataggcaatatgtaagagaatgagtgtggttgtgtttcaatattttattcagaaaaacaggctgcaggctgtctttggctcacaggctatagtttgctgacccctgatccagaagaagttaacagattttttagctagaggaaacatgatggacataattccaaatcaacacatctttctgctttctatcgccagtgcactagaaaagctgtgtgacaatgaaagaactcagaagaatgagacttaaatgttgctattatgactaacatcttaaaatagtgtttaataaacacaaatcttgacctcaagattattttattacttagtagcaattaggataatctaaaaaagaagctctaagaaagcaggaggagactcaaagaattggaattcaaaattatcttggctaaataataacagtgaagagaactaaaatagtagtacacatacaatgaagcaaaaactaaaacagaaaatactatggaaaagataaaagtgttctaacctaaagaaataagtaaatactgccatcaaaatttactgattacaactgaaaacatgtcttatctatccaagtagtacttttacattagaacctatctctccaagagatcatccttaaagtcagaatcaaagagcatgatgttggggccaggcccagtggctcacatctgtaatcctagcattttgggaggcagaggcaggcggattgcctaagctcaggagtttaagacccaccctgggcaacatggcgaaacctcgtctctactaaaatacaaaaaattagccgtgtggtggcagatgcctgtagtcccagctactcgggaggctgaggcctgagaattgcttgaatccaggagacggaggtgagctgagatcgtgccacagcactccatcctgggtgaaagagcaagactctgtctccaaaaaaaaagggggggagcatgatattggaaccaggaataatctaccagaaataagaacacctccaaaaatgtgtctttctggtttgtgtcaggacctcctgataacattggtcccatgatcataatcgtcataatattcttcagacacataaagaaagatctcatggaggaaggtgaccaaatgctttttcctttccactgaggatgaatgtgaagaaatacctatgctgcaatatgaggcagagataaatttcttgttcctaagaagtatgacatattggaacgggttggcaaaggaatagtgttcaagcttcctctagagaggctttgagagagtctaaactttgcatctgtttggcgtgaggtttcctccctaagagaaagggaagtagaagaattttcaacctctgaattttaagggagctgttcaaattgtaatttgacatactcaattgaactaaatgtagtactctattttccctaacacttgtgttgctccctagtagtaaattggttgtttacttttgaacatctaccttggaggcactaaagagtaacaggatgatctatgattggaattgggttcattacattgtaccaacttgctcccaacatctgttctgtttacacaatgacacattcagagtattcagtgcttagtgcaaacaactatgatcttccaatatttgatttctccttgggctttcacacacctcagctttggtttcactgaatgatttttggaagaaaaaagggcataaaataaagctataccaatgaatgagagattgagtgataactatgaaagttttgtgtatacaacttctgcaactcaaagggctctctgatggtgttagcaaaaaaccgtgtaaacacccttgccctctgtcaggacacaataaaagctgtttctttaatatcacagtatcattgtctgtttttaacttttctatttacatagtaaaggaaatttttcacttaatatttaaaggattatataacgatccaatacaatattaaagcacacagaataatgttgttcaaatatataatatatatagatgactttttctacttgtatatgttcacttagaatgcttttaaaatttatagctaaatccagctacaagaaaattttcatttcttcaatatagatcataggcattttatttctgtgcatcaacttttaaaaagacagcttcaactatcacataataatgttgacactttataaatattagtaaaaagtcaataaaaatgaagccactttcatactgttaaaaataacatgttaactaaaaaaaatactgttggaagacatgtatataccacattcattacaatggaaagtagagaaatacctgttagttgtaactaatgttacaaacaaaatttctatagaaagaatactatgaaaattagaactaaagcatatttttaaaagttcaattggcaggatccaaaaaaatacctacccttgaacaagagaaattatatttaatttctttaaaggaaaagtcactttttatgttaaaactcaaaaatctcagaaccacagttttttctcttttattttccaatgtaacatcctccaggctttttcaagcaaccacatggatctaatagacaactcacgtatacgaaccagtacacactcaattttaccaattggtaaaaattgttttctctcacccacagctttgaccaggtcacccctgcccccactgtggcttctctattgttcttatcaaatgcagactcccgggatctcagcttcaaagacctcctctagttttctcagctttcatttcctctgtaaccagtctgtattcttccagccaagaaatccttcattcagccctttgattcaccgtccccaatccttcatccatcctttttcttacacttccaacactggctcagaccacattcaacagtgacttcgcccctgaaatgggattcaacctcaacttattaggttaaatatccaactgcttttgtttgcttctttatatttttaaatctaatgctatttgctctgtacaaaagagattattagataggaccaggccccctgcatcaaatttctcaagtattttagtctttcatgttcaatctgttagacctctaaagggcatagcacagaatgaaagaaaagtatctgtattacatttaaagaccgaaaaaaagagaggcactgtagtatattttatgattgcaggttgtaggaatgtccattgatattgctttagggaccatgacagaagcagaagatagtgggaatgttaagcactagatacaagatgaacaaagacacacacaaccccatatcacaccaccgaagtgataaactggcaacgagaggtgagaaggaggaacagagatggatacaggagggaggggaaactgggaagcaaatgggcacagtattcccagtaggaatacaagtcaccagagttcttcctgccaggcagaacacaagccatctgactatgtgccaagtgctgaaatggacacacaacattagcaacacaaagcactatctcattagacttcgtttccaaaagtctattttctttcctccaataaacattaggattagcctacttattctgttgctcccaacactaattccaatgaaactcccagttaccatgtgaaaggttggattaattcaatgaccctattttcttcattgctaagagcacctttatacattctctcattcaaaaatacattgagtatcaaggttatcttgtcagagaatatcctgaaatgatgagccctagtttcttcatctgtaaaataaggataataattatgtaactattaggtagtaaggaaaattaaatgagacagggtatgtaaaccacttagcagtcattggcatccagcatgcgtgcaataaaagttagctatgattattgtcattgttattactataagaaccttgattttagcagatgacagttgtcattgtaacctaacgtgagctttaaactagaaaatttaatttttagactaaacaatatttatatgccttttctatcttcctatcaaatacaatgaatcccactgtttttcagttttcctgaattcatgcaactcccttccaattctgaattcaacaggttgctggcctgtttcctagtcaacactacagaggaaaaacatgagcgaggaaggaaaagtactaaagcagaagatgtctattccttagtccgtgttgtagttaaaagatgagtctgttgagtcattacccacaactcctatgggtcccaagggaggacagttgtcatcagaactgcttttgcaacctgcccttttaaatgctctgagatatttgtcctctttcttcttgactttttgctttgcacttcacatgccccctccatgagctcattcactcctttgattttagcccaacacatacatgaataactcccaagctcttgtctctgcagctcaagcctctctcctgaatttcagggacctgcaaccaactgatatgccaggaaatttacatctccaaattattctttatcataaacttttctattccttgtggtctctactttggcaagtagtatgacaaacatgtttcaccttttcccaaccaaccacctggtggtcatccttccttctaccttttgctcttcccagtgaaccaccaaattctccatatgtgagtccttgagaacagggattttgccttatttgttcctcaaccccagtgactaaaacaatccccagcacatagcaggctctccgtacatatttgttatataaatgaatagtgcatagttaccgctccataaccatctgctatatgaaggactggatgctttaagctgcattctcacaaaacaggaacaacatacaaattattctcctttacttaaatgtttctaataatttcttcttataaataagaatattaaaccatataatgcagttttgttttctatcagaacaacaagacatcatgtgttttgttacaatgttcaaatgttagtcctctggctgttgagtttcatagctaaacaagaagtttttcagtcttcagactttgtaaaaatctgtaaaaaccctctattcaagttatactcagcaaggggtcttctgaaatgtgcgtggagaaaattggaaacagcttagcaactgaaaagaataatatttcataatatcctatggagtaaaaagtcagatcccgtggggccactcactgggcatgttaggcaatttcagaaaacattttcagaaaattttttcaaatattctatatgctatttggtggacagaagtaacctgtcatatgttgcccacgacttttgagtggttagcctcacttttcatttaaaacgtttttatttgaatcggttgtagtagtataggggtctaaaggacatatgtgcattcttgctagaaagtatgtggcctgccttttactttgtgtctatagtcaaatcaacttgcattgctttgcttcataaaaatagcataaaatgtgctacaaataaataaaaggaaagtacattcatgcctgcatctgtgtttgacttgcaaaacaaaagacttcatgaaataaaaatattttgaggctcttttatttttatcactacttattctgtactgggcagatctgaacactacatgttttcttcaattagaagtcatccaacaggtggacttattttcagtgcaaagtcttagccaagattaagccatatatttcatacatcttgttcaagatgactgagaccaaacctctaaatttctttttctccaggtcaatattcgcagttctaaactaaataaccacttttttttggtactgtgttgagatttattcaaactgccaaccatgaaaagaaaaataggaacattcccaggaaaaagagtggggtacatgcagataactattggttatccatcacaaattataaggttagtgaatagtatttgcttttatatgcaatcatgtgctatttttatatacatctacatagagctatccctacacatctacttcttgtatgagatgaactcatcccttctttcgtgggctgaatgctataggtctacctttaatttatgctattaagtgcctgcaagagatgatttttaaataagtagttttgcatacagaaccaccatttgattccaactttgaatgctattaagctaaatgtacacagaaatcctttttactccttttaagatgtgtacactatgtttatgacagtgaagtcctaggtctttgaaacactaacaggcccagattcaaaggggttcagatcacagctcagtcaagttccacctctatgatcttgagcaaatcacttaatctccctatcagttctgtcatctataaaatgggaagtgcctcagtccattcaggctgctaaaacagactaccacagatggggtggcttaaacaagaaacatttatttttcatagttctggaaggtggaagtccaggatcagggtgcacagtggcattcttagtgagggccctcttcccggtttagtcctcacgtggcctctcttgatgcatgtacagacagagagagagagagagagagcacacaagagcgctctatctcttactcttcttctaggagcacttctaatcccatcatgggggctccacccccataacctcattttttctttttttttttttgagacggagtcttgctctgtcacccaggctagagtgcaatggtgcgatctcagctcactgcaacctccacctcctgggttcaagtgattctcctgcctcagacacccaagtagctgtgattacaggtgtgtgtcaccacaccagttaatttttgtatttttagaagagatggggttttgccatgttggccaggctggtctcgaactcctgacctcaggtgatctgcccgccttggcctcccaaaatgctgggattacaggcgtgagccactgcacccagcccataacctcatctaaacctaattatctcccaaagtctccaccttctaataccatcctcttggggttacggtttcagcatgtaaatttgtgggtgggggatgcaaacacgcagttcatcacaggaagaataaccataatcctcacagtgctgctgggaggagtaaataagaacatgtatctaaagggcttagcacagcacttagtacataataaatgctcagcaagatacatactattatgataacactgttattattaaacactattaggaaaacaccattatttgaattgcaaagtctggccatcgtttcttcattttgtttgttttattctgttactaccttaaccatattcaccagagtgcagcatggcttaaaattaattgattttttattctacaaatctttaatccaaacactatttccacagaccccaccagcttctaacatttagctattccgtcttcacaatttcagcatttttctgagcttagtattcatcacacatactgatgcaatcacttgcatatgagtacatgtattcccatcactcacgttccattttcatccaatgtttgcctgttttcacacataagttatcactggagaagtggaaccaggataatagccaggtctgcttaatcctacaacagccatcttctaactgtggaaggtgtttccttagagatatacaagggctttccaagggtatattacaggcagagatagttttaaaggaatcaatttccacacccttaaatttcctcttttctatcattgcctatctgagggcacatgcaggataacgtcctttcttaccgcccttttcgcaatgttcctttttttcatctgacaaaagaaaggcactttttaaacatttcaaacctgctatggcacatgctcctgggtataaaacatctggagttccaaacacatagacaatttaaaatatcttccatcttgctatcctgcctcctcattctccaaatgttgtcagagaagatattgttcctgaaggaaaatatttgaaggacaaagttaaaagagcacaaataaaccccgaaagcagaggaccagaggctcatttcaggcaacaaacttattttattttgtctgtccatctgtctaccgaaatacgtatcttaaaatttgaagtgaaacgtgggattctaagattctaggtccagttaaaatggagtaaaaatgtcccaccttacctccccctgtgattgtaactaaatgttgtggacagaatacacaaagcaattgtctgtggtatccaaacagtaaagaccagtaagcggactaggaagggaaataaaaacttaaagaaagagtaataaggaggtgagctttctggtgtttttctttttctactcatatttcccaacatagaatgaatgcaacaaaatcatggaactgtgcagcagtcttgaccaagagaaactctctccttggtcagacgaataagcaggaggggccctgcaaaaccaaaggacggggagtcccctgagacatctcttctcctgaccgtcccttggagggggccctagaagctgtgctcatggaagctgtactcatgcaacagtggcagcagcagccaaggttgcctatttgccccagagttggctgcaacagtgcaaaaggctaaaactagagcttttttgacagaggaccagggcaaatggtccctggaagtcagagagtttcagggagatcacagagaagagggagcttgagatgaaagatcccacagagctatgtataaagtcctgcctgggtttatccctcaggtctccatgcatgaaaatgatttgaaatagaataccaaaagctttgagaagtaagcaacaatgtaatccatggcccagatatcagactgatccctgggaaatacactcatggggaggatccagagagcactacaaaggctttgaaaactgaactgacattggaaacaaagcccttagaaggcataatgtgacttgtgaccggaacttaactgggtcaactgactatgaaaagaaacaaacacacaaacaaaattagcattttccagagaattctaacaggacccagaatatcataatattttcaaaatgcccaggatataagttaaaattaattaacatacaaagaagcagggcaaggccaggcacggtggctcatgcctgtaatcccagcactttgggaggccgaggtcaggatcacaaggtcaggaaatcgagaccatcctggctaacacggtgaaaccctgtctctactaaaaatacaaaaaattagccaggcatggtggtgggcgcctgtagtcccacctactagggaggctgaggcaggagaacggcgtgaacctggaagagggagcttgcaatgagctgagatcgcgccacagcactccagcctggacgacagagtgagactccatctcaaaaaaaaaaaaaaaaaaaagaagcagggcattctcagcaacccctaagtgaaaagataattaataggcaccacccctgaagtgacctagatgttgaaattattgaacaaagacttactttaaagcagctgtaataaccatactccatgaagtaagggtcaacaaatttgaagtgaatgaaggatagaagttatcagtaaagaaatagcagctatggaagctcagaactgaaaaataaaataactaaaatatttttaaaagacactgaaattgcagagtgaagatgacaagacagagtaagtgaacttatagctaaattaatagatattatctaatatgaacaaaagagaaaagttttcaaaaaacgaacataacttcaggtacctgctgtatattatcaaaaggtccaatattgatgtcattaaaaatataggaaggaaaggaaggagaatgagatttgtacagaagaaaagtttgaaaatttaatggctgaagttttctaaatcaaaagaaagatataaatttagactcaagaacctaaatctttggaatttttttggaactcaagaatctcaacagaacccagataagataaactaagaaaataaaatcaaaataatcaaatgactggaatttattcaggaatgcaaggctaatgtaacagtcaaaaagtaataaatgtaatctctacattaataagctaaagaaaaactacgtgatcatgccaactcatacagaaaaagcatttgataaaattcaacatctttcataataaaaactcctagaaaatgagatttagtttatgggattacctgattaggtctactgaggatattctacctttcttaaagtcagctgtgccaaataacataatctaattataggagtgactgcaacatcatattcagttcatccccacattcagaggtgaggggattatacagggtgagtgaaccacagaactggaaccctaggaaccatcttagaacaatgtttaccataactagcaatgaacaatgggaactcaatgttttaaaattagtaccttttacaatagctctcaaagtatctaacaaaatacgtgcaagacctatatgagcaaattataaatgccaatagaagaatcaagaaagacctaaataaatgataaaccaagttcatggtttgaaagacttaatatgtttaagatgccaagtctccccaaattgatccacagctttaatacaaatccaatcaagatttttggaacacttttttttttgtagacatagacaagctaattctaacacttacatagaaaggcaaagaactacaactgaaaaataaatgttgagacataacacagtggaaaaactcatactattctttgttaagtcttaatatcaagccatactaatcaaaacaatgtggtttggttaaggaatgagcacataaattaatgaaacagaatgaacagtccagaaatagacccacgagaataaggtcaattaatttttgatggaggtgcaaaagcaatttaataggagaaatataggccttttaacaaatgtgtctggaacaaatggacatccatttggaaaaggaaaaaaataccacttgacctataccttataccttaggcaaaaagtaactcaatgcaggtcatataaaatgaaaactgaaaaagtcttgggagaaattatgaaggaaaatctttatgcagttgagataagtaaatagttcttatatgatacaaaagtatgttgcattaaaaaattggtaaataaaatcatttgttctgtgaaagacactgtgaagagaatgaaaagacaaggtacagagagtgggaaaatattcccaaatcatatattgaacaaaagacttgtacccagaatatataaagaactctcaaaacccaacagtaagaaatcaaacaacatcaaacaaccccccactcctgccataaaatgagcaaaagatacgaacagacacttcataaaggtgatattccgatggcaagtaagcatattaaaagatattcatcattaggcaaatttaaccacagtgagatgcttctacacacctattagagtggtcaaaacagaaacaacaaaagtcaatctgacaataccaagtactggtgaagatgtgaagcaactggaagttgcatacattgttattgatgggtatgcaaaatgatacagccactctggaaaaactgttgacagataccaatctaggtattcatcttagagaaatttgcctataaaaactgtaagtgaatgtttatagcagtaattttcacaattaccaaaaaactggaaacaatcaaattcctttcaatgagcaaataaacaaattgaggtacagccatacaatggaatactagtaagcattaaaaataaccactgatacatgtaacaacatggatgaatattaaaggcattatcgtaagtgaaagaaacaggtttcaaaagggaatatactgtatgattccatgtgtgacattctagaaaagccaaaccagagatgtggagaacagatcagcagtttccagaggtttggagtgtggttttggccataaaggacaagacgaagatgatatatgtaggatgatagaactgttcagtaatctaattttgtggtggttacaaatatctatgcatgtgttaaaactcagaactatatatacacacacatacagtgaatttcattgtatggaaatttaaacataaaaactaaagtcagcctatttctttcagaaagtaactctgatttgatgaataagttttgacattgaagactggcattactagttagataaattttacataaactggatgaacaaaactgacagctccaagttttgataaatatatatttaaagcatgtaataatataaaaagcattttattaaaatattgtattagaaaaaattaattgaaattaaccaatatttccattttttataaatttttctgaatatatagagctaaacaaagtgcctcaaagtgaaagagtaataaacagatatttgataaatcctggcaatattctcagaagtagagaccatgcatggctttactgactgggtaacaaattcatttgcaagtaaggtgctttccaagtctgtgctttcaaaaatggaaggagaatctaatcaagttgtcatctaatcattaaaaataattttaatgataaatcattactatttgctttttgacagtacagtgggaagcttctcaaataattgaatgccattattcaataaaactctttctatgcccatgtgtttaatcatatgagtaagttttcaaagcactaccatctagaagaaaaaagtaggaacacaattgatgccaaactctgatatagtctacacaaaccagtgttcaaagaaaataaactgcatctaatacatcaagatatggaattctaatatgtgtcacatttaaggttagtaattatttataaacatttataatagattgaaagtacaactttttgataaattaatcagaaaataaactgttgacagagtcttatgactgaaggaaagttttttaaagtaataatttccattttatgcacagttttgttctagagatgcatggtagggggataaaaataatctaagcattaaaaagatattacactgtaatgaaattctgtaggtgaaaggaaatagaaatgacttcagagagaaaaaggagcaaagtaaaatttgctgaatgttacaagaggagcttataattttttaatgtttggtgaatgtcaaggcactatgggatttaggtttcactagacacatttaaaatagttatatgtcaattattataatagtctttaaattctattatctgacactatttacattcacagttaaaattttgtagatattaatttaaaattgtacaagggctgtgtactttgtcaaaatcctttgagggtacacagcaaaaatatttggaagaccacatatctaaaacactatgttgcactgcctcctcgataagagcttaactttttgtttaaatgtgtgcagggtttcagacacaaaataaacatatggatagagcaggtgagaatggagacttcaaattgcttcccaattgctgagctcaatggaattgcagttatgaagctcacaatgctatttagcagaatgaagtcacaatttcaaaagagattcatagattttcatgtgatgattctgaatcatgcattattttcagtgggtggcccagagtttagagttcaaactctaggatgtctgaattactagataactgccacattactgttgagaatatcaaaaagaactgattaagcttaaagaataatgttcacctaaaagacatagatagtatcctttcccaggaattttgggaaacaaatacgaaacttagaactaagctaatatttctgctatgtgaaagaaaaaaaaccagcattttgtttttcatttacctggttctgtaaagatctatcagctatgattaaattgaccatgatggggcgtacaaagctgaatacagaactaaaatagatgatgttttgaatagcaaatgagcagcattcttgttagagtaatcagaactgattattgaccaaaatagactcagggatgtgcacttatgatcatacatattaaataatatcagacttttgacttgttgctaaaaatttccatattctactgtaatctgtaagaccacaaatgtggatttctgattgtgattctgaaatgtgattctgatttctgattcagaggcataatattgacaaaatgaagatggtcttggtctccagccactgaacaaaataatattctgtaagaagcccaaggatcaacctatgatcttgagcttctgagctatcaacctgtaagccaagcagctagcttggcaagagagtgagaagaatgaatgcagatgaggaaagaaaacctctatatttctgttttaggaaccactgtgccacttcaagcaaagcaatatttggcagagaatagaaacttaatctcaaatgatctataaacaagaattacggagcccgcagagaacaggtagtatttaggctcaacaagaaaacgattttatctggcactgcttctttatcctgggtatgtggcatagcaaagtcaaaacaagcctgtaattctcccagaaaaacagtggaaactcacaggatgagcatttctcgtggtcacagatcaaaagaagttgttagggacttaaaagtatttttaaagcttcaagttacagcaaaatgaaatgttaaataccagaaaagttgatcatgaagtttcttcataagaattctggcatatccttagctctatcactacccaataatgacagctgtttcttacatagcttctcttcttcatctcatttttgaccactctccctagcatgttctatgtaacagccctacagacagtttctgacagctgattaaaagaactgaggggagatatctggggcaagaacgtcgcagcagatggaacagagtagctacagcctagagagcaaaaacaaaaacattaggagaaaagtcagagacgcaatcagggccagataatgtagagtgggatgtctatgttgcacaactctaggaggcacaaatgatacagacgggaggtggaaatgctgggtagaagagggcggttccccaacaaaggccccacccttaagctggaagacccacagctctaagtgaggacaggcatttctgttttcacacccaaaaagttgccttttggcccaccacacccctcatcctgccctcatataaacccaagaccttagcgcgcacacacacggagcggctgaatatcggaaccagcagatcagtgaaaacggaataacttggcagagaaagagagaagagagaggttcggccacagaggggagttcagcggagaagtctggccgctgggtgctccggctccagggaaagaccaccttcccactccattcccctgcttccggctccccatccacctcgctgagagccacctccaccactcaataaaaccttgcactcatccttggagctcacgtgtgatctaattcttccagtacacactgggcaagaacttggggtacagaaggctgtcacactggctccctgcccttgcgatagggcagagggtccattgagttgattaacacacaagctgtctgcagaaggcaaatttaaaagagcttgcaggccgggcgcggtggctcacgcctgtaatcccagcactttgggaggctgaggcaggcggatcacgaggtcaggagttcgagaccagcctggccaatatggtgaaaccccatctctactaaaaatacaaaaattagccaggcgtggtggcggctgcctgtagtcctagctactcgggaggctgaggcaggagaatcgcatgaacccggaaggcagaggttgcagtgaactgagattgtgccactgcactccagcctgggcgacagagcgagactccatctcaaaaaaaaaaaaaaaaaaaaaaaagagcttgcccacttgggcttcaggagccacagacacccacccccagaccctgcggtggggctggagcccaaaagcactcttgcaggcctctgcacctgcccatctgcatgctccccctaggggtttgagctgcagggtgaccacacaggagacacccctgttgcatgtgctgagaggggaatcagggaactctcccgttttactattcacattgctttctatatgactggtattctcccgcagttgtgcaatgcagcaatactgatgaagtcctgacagttgtaaagaccaagggcttttatactgagtgagagggaaagccttaggaaacttagagagaatagatgtgaaagtttaaaagatccctttctctgctgtgtgcatagggaggtatcaaggaagaggcagtaatagcccaaaggggcagagggaggcagcaaggaagccaataatgaggctggaaggataatccaggcacaaatccaagtgagctgggcccggtggttgtggagatagtgagcactggttggatcacgcatacattttgacagttgaaccactaaaatttacagacaaatcaggtatggagtgaaagagaaaaagaagagtcaaggatgaccccaagtttttaactagaacaactgaaagaactacattgttattgactaaggagggaaaagctgggagaagagaaagtgcatgggcaatatcagattggttttgtatctgtttcgtttgacatgccttttagaaactcaaatagaaacaaatagaaggcaaatttgtgtgtgtgtgtgtctgcatgctgcaagcatacatatgcatgcaggtccagaggtcagaggagggatgtgggctagagatccgcatttgtagttgtcagtgtaccagtggtatttaaagccatgagcctgaattagatcaccaaaaggagagagatccaaggcctgaggcactccagtgtctacaggtgaaatgaggcgaaaacacaaaggagactagactaagtggccaaagaaagaggaaaacccaattggaagtcaggtgaagagtttatcaggtaggagggagtgattaaatgtagcaaatgctggccgggcacggtggctcacgcctgtaaacccagtactttgggaggctgagacaggtggatcacaaggtcaggagttcgagactagcctggccaacatggtgaaaccccatctctaccaataatacaaaaattagctgggtgtggtggcgcacacctgtagtctcagctacttgggaggctgaggcagaagaattgcttgaacccaggaggcggaggttgcagtgagccaagattgcaccactgcactccagcctgggtgacagagcaagactccatctcaaaaaaaaaaaagaaaaaaaattagcaaatgttgttggaggtcaaaaactactgagaactactatgggatatagccacacaggtagagacccttggagatgtggggacaaaggagtttttcttgagaggtgtaagcaaggacagtggaatggaggtttgaagcttagggaagtggaataaaattggggatgatagatagatttaagaatcatcagtgcatatgtggctataagcaaatatgagatttcccagagaaaatatataagatgttgagaaaagaaggttgaaaatagtatcctgtggaatatcaacatttaaggggccagtagacaaaggaaggagactagagggtggccagggcagtgacaggcagatcagaatagaaatgtgctagaaaccaaaggcaaagagtgctacgaatgaagaagaaaccaacagagacaaaagtcttccattgcagggggcagccaagtttatactccctccttcacaaccccacatctcttctcctataggacattgtccttatgggctgtaacagatactgtcagtttcaaagactaaaggaagtgcataccccagctccctcacccctctagtagactaattctaaaccatatgttgtacactagttcccagattttcccatgggattgctccagttgcccactatggtagctggtttagtaatctactcttttttttttttttttgagatggagttttgctccatctcccaggctggagtgcagtggcacgacctcagctcactgcaacctccgcctcccaggctcaagcaattctcctgcctcagcctcttgagggcctgggattacaggcacacgccaccacgcccggcttttttatatttttagtagagacgcggtttcactatgttggccaggctggtctctgaactcttaacctcaagtgatccaccatccttggcctcccaaagtgctgggattacaggtgtgagccaccgcgcctggccagtaatctactctttattggcctgtttcccttcccactcccgtgacccccaccccaccactgtctcgcgtctctcccaaatgtaccatggctcaactccttgtctcaggtctgtgtctgtgcgtcccatgtccatctctccactggcctatgaactctttaaaaatatgcctgtcttcatgccttctccagttcctggtaaactgcctggtacatagaatatacttactacatgtctgttgaattgaaggatttacatttgcacagggcatgtggcttctctcaaataaagaagttatctgaaatacattatcccatttagcccataacacaattctaccacttaggtattattatttctattgtaaagttggagcaatagaggtttaaagggcttgagagacatgctcagcgccttcacgatgctatttgcaaaatatccatataagtacctcatctatctctagcaaaatattgatgtaagtacctcaaagaaatagtattaaattatttcttccaaataaacccacaattcaataggagaaattcggactatgtgttttaccaggatcctgaaactatcattttgctgcttgtgcactgaaatggttgctagcagcaaccggagctaggcagagcaaataaggtgctatgaaaaggaagaggaaaatgaatgaataaataactgaagttctttcatggcagagagatctcttcaggcccacagaaatacgatttaaaatcaactttccatatatgattacagactaggtaaaggattagtcagaaagctcagcatgattgataggtcctgaactttagccccctgagttctcacatctcaactatggaaacacacaaatgtttattttaaaacctctgacgaacagttcccacagcattatcactttagcacattatttactttacaagacctagcatcaacataagatagaaaggataagacaactgtgtgtccttctatatgggaacaaaataccttaggagttatgactgacttaaaggatattaagagaagatgaatcgaatttacagagctaagcattgggaaaagcagctgttacaagttgtgggttttggctcgattcactctggaaagacacgtgagagctcttgtgagaagggggctgtagcggcgggtattaataaggattaataatcaaatctcaagatggtcccaggatggtggactatttgggggaggatggagcctgggggactggatttaaaataagctgggaatgacctcctgaacctcagtttcttaatttataaaataaagatgataataccttggagatttactctgaaagcaaattgaactaacagctgtgaaagcacttcagaaaggagaatggggtacataatgtaaagggagggaattactatttccttgggcaaatgatttcacaagttggaagaagacgattgagacaagagtcaacttttagtcaccattcatttcatcggctaattaggaacctgacacccaacgcaagtccacagtgccgaatatcttcaccagaacaccttcttccgtcccctttgctaagtaggagcctttctcttttaaaatattcaggattcatttatgtaattgacttcactctattccattgacatttaacctgtgtccttttatactttctgtatcacagcatatttacatgtagttattaatgctcttttaacattctgtttcttacacgtgggtatcacagattaggtttaacactccttaaaggtaggaagtatgttaaactattattataattattactgttagaaagtactttgcaaaacatatagccctggaccacggtttctcaaaagcagcactcctaacattttaggccatgtaattttttgttgtgggaggctgtcctgcatgtacattgtaggatgtttggcagcatatcttgcctctacctactaggtgttagtagcaactccccctgttctcacagttgtgacaaccaaaaatgtctacagacattgccaaatgttcccaaatgggggctgcaaaatcacccctagtgaagaaccaatgcgttaaacagatacagattaaaattatggtcatcataattacttttactttttcagagtacctggaatgatacgcagaaaagaaaaagtgctcaatcaatattgaatgaaaaaatgaaagaaaaactacattagttgtatttataaagtggctctatagcataatcccttatatgattaagactgtattatataataaacactttgctggttggcatacaatatattcttacactttttagtaactatgtctgtgtatacaagaaattacattcttatgcatatacaaagattgtagctggcagtgactttctctatagcacacaaactatgaatagtgtctagcatcctgtttacccataaagcaagagacagaatacttattttaaattctaggtaaatattacatcaaacaccaattgtcagatgcatttttggagaattatctctacatgaaaaaaatattacaaccaagaattctaaaaaagattatctgacaagtagaggatctcagatgagtgtacttcggaaatttctgttctatttaaacatacatttttaaatataaatgtttcatcaatctttctaagattttttccaagatcatcaatctcttccaagattagaatatttgcaatatcctctgatattagagagccaatgttttaagtggcattttagtttgttattaaaaaatactaataatgggctgggcatggtggctcatgcctgtaatcccagcactttggaaggccgaggcgggcggatcacgaggtcaggagatcaagaccaccctggctaacacggtgaaaccacgtctctactaaaaatacaaaaaattagccggaagtggtggtgggcacctgtagtcccagctactccggaggctgagacattctcctgagaatgacgtgaacccgggaggcgaagcttgcagtgagcagagatcgcgtcactgcactccagcctgggcgacagagactccagcctgggcgacagagactccatcttaaaaaaaaaaaaaaaaaaaaaaagaggatactaataatgttattttgattttcaagaactgatatgttttgagcaacagtgttacataacactgatgatttttttattttcaagttttctctatgaattcttaaatcccgtatcaatgggttacattttccaaattaccactaatgaagactgtaagcattcttataaaacaggagaaaatgtagttaaaacagaaaagacttaaaggacttctctttcagttttactcactcagccttctagtggcttttagctatatactatcttttggagggaatcctaatttagcagcagacctctactaaacaacgtgtgaaaaagaaaacaaacttccatttctggccatgaggtagtaacttgcagcagatcaatgcccctgtcaagtacaactagaaaagccagataaaacacaagaaacatctgttggaaggcatctgagagctgatgagataattaagatgtgagtggccaaggtcccagagagaagataactatagaacaaagagtctacattcttttttaaagttttattttaagttcaaaagtacatatgcaagtttgttatataggtaaacttgtgtcatgggggtttgttgtacagatcactcacttattaagcctagtacccattaattatttttcctgatcctttttctcctcctaccctccaccttctggtagaccccagtatcagtcgttcccctctatgtgtctatgtattcttatcatttagctaagtgagaacatgccctaagagtctacaatctgtgtatgccttgtccttcatggaacttgccagttcttggcatggtgctacacatgtgaccactgcaaagacaagataagccagcagaacttttggcaattccacaaaggcgaagagacaaaaattagagtttggtgttgctgaagcagccagatactaaggggccaggtgagcagtgaaaggggagacatagagaagcagatctatcacttgggagggttgccttgcaaggcatttgccacagagggcaggagcctaaagaactaagcagaaaacttcagaaaagtagaatggaaattacagaaattatactgctctgagcagaaaataaaataaaatttggaactactcaaggaggaagggaatatagtaagcctaccagtttctcagttgagactactggagaaccacactctcagaatggagaaaaaccagaggtagacggagccttataacaatgaggcaaaatcagcttagtctctgattaaattaaggctatctggccccatatgtgcctagtgatcatatatgtggcacatacgtgtgatcatatatgtgtctggcccatatcacatatacgatctggccatatatgtctacccttcaagaatctattgctacatttgctggcccactgcctttagctgtcagatccttcgggttttgcctcagctgtggaacactgaagagatctgcctcactcagtggcacactcttcccaggaaggaccacatccaatgactgattgaggtggagacacatagactcaactattttggatcaacatgagataactcttgtaggcttaatacattccagaactccccaaggatttagctgaggctttggtgggcctggatcatatttcaactccttctgcccaattctgctttctctccctcccttaacacaaaggctgaagcttaataaatactctgtacaccaaactccatctcagttactatttgcagaaaactcaacttttagcacctagtgtcagacatggtctaagaaagcaggtgataagatatggttattgatctagataacctcacaactacatcagctgtgaaaactagcagccaagcagccactagaaggggcaaaacatgcttggagctctccacaatgccccattaccaaagaattgtcattatttttcttgtctgttagctccctggaaactcagagcaaatgtgattatttgacctgaataagagcttactcagtgcaaaagccttttccccggggtgtttctaaaaaaaaaaattaataatcgattaacactgtaactgtctgaggtggggatatcacttggggcaaacaagaagctaaccagaaaaattaaaagaaaaatgtggggaattcctgtaggaaaatttgaaaagctctaatacattgctgagaatctagaagatcccatgaatgtgcaggactatgcatatacctaagaaggacccagaaaggcccaaatatctcacctgtggcagacattgagaccctgtacaagcagaaatttaaggataaggcagagctgtaaactctgctatagtattgactgctatagcattgactctgctatagtgtcgactctgctacagtactgactatgcaccctaacatgcacagaatcccttggcaaagactaggatatatacctgttaaaggcatttaaggaaattctgtccaaccattagttgaccactaggctgctatctgggcaaaaacttcagtggccagacatgacaaagaacaaacttaacataatttgtttcagggaactcactgaacaaataaataacaataattaaagcaacaagaaacagaaacagcaactaatgttggggggaagaattcaacttgcagagttgaacattatattattttaaatgtccaactttcaacaaaaaattacaagatgtccaaagagactggaacatatgcccatatagagggggaaaaaacagtcaacaaaaactgttcctgaggaagctcagacattgaatttactggacagacttttaaatcagttattttaactcattcaaagaactaaggaacacatttctagagaactaaagggaagtataagagcaatggctcaaaaaatacaaaatattaataaagatatatagattattttaaaatattagaaattatgcagtaaaatatataataactgaaattaaaaatttactagaaagacttaacagcagacttgatcaggcagaagagaaaatccgcaaactttaagataagtaagctgagattatctagtctaaggaacagaaagaaaaaaaagaagaaaaattaaaaggtccttaatgacttggaggatgtaccaacatactcataatgggagtcccagaaagagataaaagaatgagtcagaaagaatgtttgaagatataatagctgaaaacttctcaaatttggagaaaaacatacatctgcataacaaagaagtacaaaaattcaaataaactctaaaggatctacacttagacacattgtaattaatctatcaaaaatcagacacagaaaattttgaaaacactgggagataagcaactcatcagataaaatggagcttcagaaaggttaacatctgacttctcatccaaactgaggagtccaaaaggaagtgggataacatattcaaagtgctgaaaataaaagactgtcaaacagaaattctatgtacagcaaaatatcctttcaaaatgaaagacaaattatgatattcccagataaacaaaagtggagagaatttgctattaacagaaccaccctgtaagaagtactaaaggaagtcctttgggataaaataaaaggacagtatacagcaacttgaatccatatgaagaaataaaaggtattggtagaggtaattaaataggtaaaagtaagataaaagaaatgtattttttctataaatcttttattatcctatctgattcttaaaaacaactgcataaataatttataatcataatcaataaacctatgttgagattatattatataaagatgtaatttgtatacataatggtacaaagaaggaaaaagaaacaaagctatacagaagcaaagtgtagatattgttgaaattcggttaggattcatctgaactagactgttataacttaagacgttaattttaagttccagcacaaccaataagaataactaaaaaaaatagccaagcaacaagaaatttaaaatggcacaccccaatatatctaacacaaaaaaagtcagtaatgaaggatcaagaaatacaaaagtcatagagaaaacaaatttcaaaacagcatatgcaaatacttataattacattaagtgtaaatgaattaaacactacaatcaaaaggcagagatttgtctcatagataaaaatatgagattcaattatatactgtgtgtaaaaggcatactttatattcagaaacacaaataggttgtaagctcaaaaatggaaatttttaggtgcctatgtgtttacacatattttctattgctgggtggagtgtactacagatgtctattagatctcattggtttatcgtgctttgtaagtcttgtatttcccttttaatcttctacctagttctactcattattgacagtggaatattatggttgaattgtctatttttccttcagttctgtcagatttaagtatttctggctctgtgttatgttttcctgacgaattgaccctttatcattaaaaaatccctcctcttttctgataacaattttgttttaaaatctatttgatcaaatattagtatagccattccagctcttttagcaaagattgaatggtatatttacatatgtaatctttatcaaaattatagctgaatttttttcagaaattgacaagttaatcctaaaatttatacagaaaggcaagggacccaggatagctaaagtaatccttaaaaagttaaagtatgcacacttcataatttcaaaatgtattgcaaactgtggtaatcaagaaagatagatagatcaataaaaaataattgaaagtccagaaataaacccatacatctatggccaattgttttttaacaaggggctccaagtccattcagtgggaaagaatagctcttcaacaatacatactaggacaactgaatttccatacgcaaatgaaagaagttggactcctacttcacaacatacagaaaagttaatttaaaatggatcaatgacttaaatataagagctaaatctattaaaatcttaaaagaaaacaaaggaataaataattagtcaccttgtattagccaatttttaaaatacatacactagaagcatacacaacaaaagaaaagacagataaactggacttcctcaaagttaaaaactgttgttaaaatgaaaacagcccccgaagaatgtaggaagatatttgaagattatatagcttaaaaggcacacttgcatccagaatatataaagaacctgacaattcaacaatttaaagaggcaacctaattttaaaatgggcaaagtatttgaatagatatttctcaatataaggcatacaaatggctaacactaacaagcacatgacatgttgctcaacataattagtcattagcaaactgcaaatcaaaaccacaatgggataccacttcacatcaactaggacagctataaacaaaagagacaagtgtggtgaaaatgtggaaacactggagccctcatacattgtttgtaggaatggcatttcctcaaaatgttaaacatagagttaatactagtcacagcaattctactcctaggtatatagctgagagaattaaaacagtatgtccacacaaaaacacaaaatcttatacgcaaatattatacagacagcattattcataacagtccaaaagtgaaaacagtccaaatattcctcaattaatgtatggatttttaatgtggtatattcctacaatggagtatcaattgacaataaaaatgaatgaagtactaataatacatgctacagcatatatgaaccctgaaaatattttgctatgtgaaagaagtcagtcacaagagtcccatactgtatgatttaattcatattaaatgtccaaaatagtcatgtttatagaaacagaaagttaattagtgtttaccaggggctgaggagagggatagcaatttactgctaatgcgtgtaggtttctttctagggtgataaaaacattctgaaattattatagatgattatgatggttgtacaattctgtgtgtatactaaaccacttaataatatactttaaagagatgaattttatagtatgtgaatgatctcagtaaagctggcatttctaaaaggtaactagcataatatgaaaaaataatacatcatcttaatagatatagaaaaaaataataaaattcaaaacccattcaggattttttaaaaagtcttagcaaactacaaatagaaagagcttccttaatctgaccaagagtatcctaaaaacccttcaccaaacatcagaattaaaggtgaaatattgaaaaccttcttcctgacatagaagaaacagaaagcagaatgactgaaaaggaggaaataaattgtcattattttagatgacatgattgtgtacttagaaaattcaaatgaatttacagacaaattataaaaattgttgagtgatttatcaaatttcttggatacataaaaacagaaaataaaggaaatgttttaaaaatatataatttacaataacatcaaaaataccagataccacaaataaatctaaagatgtgcaagatctctatggttaaacctataacacataattgagagaaattttaaaatgcctcattgaaaatacctacttaaatattaccatagtatataattgttatggttggaagactgactgttgtaaagaaattttcctgaatttgatctatatatttaatgcagtcccaatttaaaaacaaaacaaaaacaaaaacagcatttgtggaaattacatagtgattttaaaatttacattaaacgcaaagggccaaaaatagtcaatctttaagaagaacaaagatagaggacatataatattcaatataaagatgctataaaactatagtaatccagatagtgtggtattgtcttaattctattctgtcaattagagggttcaaaaatagatatacatgtaatcattcacttgattgatagcagcagtgatattacagtgcagagggaaaaattgtcttctaaataattaaatggtggtgggtcaattgaatatacacatagaaaaaaattaattcctatcttttacctttcaccatgcacaaaaaataattccagaattatagtagatgtaaaactgaatgtcaaaacaataaagattctagaagaaacataggagaaaaacttctatgtttgggggtgagcaaagatttcttaagacacagaaaaaaaaaacacaaaagaaaagattgatattatggacccattaaaattaagaccttctattccatcatagatgctaataagagtagaaaggcaagccatagggcatgagatctttgcaatacatatatccaacagatgacttgtatccagaattcatacaaaactataaactgaagacaaaaagacagaccatcaaaaaataggcaaaatatttggacagacatttcacaatactcccatcaaaattgttaaaatgaaaaagactgacaatgctaaagattgggaaggatttggagcaactacaacttttataaggagctggtaagagcataaattggtacaaccactttagaaaacttttttgttgaataaatataaccatattcaattaaagacaggcacaagaggctgggaacggtgactcatgtctgtaatccaaacactttgggaggccaaggtgggtggatcacgacataaggagttcaagaccagcctggccaacatggcgaaaccatgtctctactaaaaatacaaaagttagccaggcatgatggcgtgcacctataatcccagctactcgggaggctgaggcaggagaattgctcgaacccgaaaggcagaggttgcagtgagctgagatcatgccactgcactccagcctgggtggcagagcaagtctctgtctccagaaaaaaaaaaaaagacatgcacaagaatagtaatagcatcactgtaatagctgaaaattggatacaatgcaaatgtccatcaacagtgaaatggaaaaatatattttggttcaatcatatattagaatgctgtataacaatgagaatgaatgaaccacaatatgaagatgtaattaatttcttgaacataatgctgagcaaaagaagacaggttttaaaaagttacatattgtatgattccatttatatgaagttcagaagtaagcaaaactaaggtgatagaagtaaggatagaggtttcttttggaagggtgagatatgacaggcagcgggcttgaaggcatttctggggatgttgttaatattctattccttgatctgggttctggttacatggatcttgtcacttggttaaaatttatcagactgtacacttattatttatatccattcctgtataaatggcatactcaaataaaatcttctaaaaatgaaatgaaacacagacacctacattgctttccgttttcctgctgaggtgagaagcaaattctgctgacattgctgctttcagtttggtttctaaactgggagcatctgaggaaatccggccaggagtaattcaccatccccaggactgattcacagccttcttttgcagcctcacagaaggacctacagggcaggagtccatgactaaaaaaaaaaaaagagaaaggtgaaaattagtgtctttacagaataggttttgaaataatagtgaaattaaagttagcccctgtgttgtgatattatcttaatttatacttactatagtcagcaacttaaatttttacattcagtcctatgacagtgattttagctattctatggtcttgattctagaagaaatagctagttccacatcatctaactatttcttgtaggaacatttatcaataatttgtttaatatttactgggctaaaatatatagttgtcagcctaaaagagctctatttaatatcaaaaggggaaaattaacatggaaacgaaggccctcagattgcaaaggaagaagtaggtcaaaaatatgttattcttgtatttttatcttccctttgagaaattcaagtatctctgagtggcagcagagagtaagctgttccattattaacttccccagcctccctggaaaatgaacattatacagatgagtggcaacttggaagaccttgtacagttatttatcttttcagatttctagtctgtcatctgcaaaataaaaaaaaatgcacacaattgtctgttaatagtatgagtaatgatgcccccagagcttatctttattcacttaacatgccatgaaacagtcctagatccatagctctgtggatggagatgggatactaacaaagtcaaggccacggacttgcttccttgcagacccaggtaattgtttctactttacagctgaaggctgcatctctcaccctggctggtcaattgctaaaagcatttcaaatagttttaaggaaactgggaaagaaaatagacatgtcagttaaatcaaagcatacacttcacaaatgtggagccaataagatatcacagaatcgtacaatattagatatgtaacaaaccttaaacaataccttattcaaatccttcaaatgagatagttccagggagattctaggacagacttgaggtcaaatagctcctaatggcagaagcaggaatagaatcctggtgtttcaagtttcaggacacattctacctactctccctgtctcttctcttctaaggacctaatagttgggcttttaaaactccttgatccaacaagcacatttacaataccccattcatacttctacagattacaaaaacataaggggataggccagccgttgagatcaaatgaaactaatagggtctgtaaaataatcttagggcagagatctttgtacataaaaatggaaaaagggaattcaacaattacattcagataaaaatatcttaccttcctctcagaaagtcaccttaaaactgagtatcttttggaatactgatcttcatataattgtctacatacattaatatgtaaccaaattcaacagtgaggatgttgaagaagaggttttgtatttgaaagaattagcttcagcatataaaatatgaattggttcaggcaagtttcttggtataaagaagacacccgaaatatattagatatttctgggactaagaaaggatcacttaaataacactgtttttcattatttcctgcctgtcctgactcttatcccagagaagttagcgaatatactttctcaaataaaactaggatacacagtaaaggaaggtggagaacataaaattactatatgcagttacttatgtttgccaggcactgttcttagtaccacacatgcatcacctcactgatttctcagaacaggatgagtaataggtgttattactaatccccaatatacaaataaggaaagaagcacagacaaataagacatttgtccaagttcactgaggcaatgagagtcagagccgggattagaactcgggcagattgacccaggacctattctatttactactgtactacgagtaagtcctaatttcatgaatgcatgtcttgaaagcacaacgcaaatctttttttttttttcaaatggagtctggctttgttgccctggctagactgcagtggcgccataggctcactgcaggctctgcctcctggtttcaagcgattctcctgccacagcttcccgagtagctgggattacaggcatgcgccacctcgcccggctaattttgtatttttagtagagacagggtttcaacatgttggccaggctggtctcaaactcctgacctcaggtgatctgcccaccttagcctcccaaagtgcagggattacaggcctgagccaccgcacccagccaagagtgcaaatcttgatatgcactttgtgagtggcaccatcatatacgtgatgggtgagatctccattctacaaaagcctacaaatgtgcattgaatcagtatttgtcaaaggggctaagaaacacaaggaaagggtaaatacatttgtgctttcttctctaggtgtgagccagcccacagtaaagctataaaacaagctaggcttgtcgttggtgttcctcctttgccttctagttcttgaccaaggtcccagggtcccaatgcccttgtgatcaccccgatgccagcaccccacctagatggccacctctaccagagtgcttgaaacatattattcccttcctacaatcaaaacagtactcccaattgcagctgatctcaattaagcttttaaataagaaaatagatgaaaaaaacacagaataatgcataataatagatgaacacttaaccctcccagagatttttgcatctttaaaagaagactgctcactggggcaatggaatctctaactgatgaaattccagataccatttaaagggaaaaaaaaacattcaacattttttgaagatgagaaagatgtctgcaaactgaacaacactctggagcccaactctcccaagcagttcctggacctttcctcatttctgaactgagttattttattttattttatttcatttcatttcatttcattttatttatcattctacatcttttcttagaaccttctagggtaacaaaaatgaagtttcatacaggaggccagcagactgttttcaagttctaaagttaagtctttaattcagaaatggaatcattgtcattgactcttacggtggtcatttttctacaggaaagcctcagtctatcaccctgcaactttcacatggccactcctccactgttgaatcttgggcaatagctcactcatgtcaaaactcagtttcctcatttgaaaagtgaaggttttggaagagctggagtttggaccatttttcatagtccttttactactaacattctgtaagtcaaaattcattctttaaggcaatgtttctcagaggagcactgataatcccaccagatttgctaaatttcaaaaggtaacaggcattttcctcaagatttgttctgggaatatatagagacattaaaataccattaggccctccattctaaaaatagggcctaagaaaaatgtctactgtgtttccaaatagttctcttaagaggtgtaaccaactgagacccataagctttaaactgctggaccaggatatgtgaaatagtgatggggtattaataactagcaacactttccaacagtgagcaaaatgtgtagtcattttttcttactttgcataaaattcaactgcctagggaaggttgaagcattttgcttttcatcacatggaacagcgtggtgagataggccacactattttggaatatgtgtctatatccaagcaacaaacagattgatgactttaaaacagctctgcacagggaaggagaccactttagctatctaaaaactattttagaaagggtgattattttaaattgatgtctgaagtgcatttggtgttgtgcaaaagtacctagtacatttcaactaaagttaaagcagaaagcttttatacctcctctataattatttgttcaaacatttgatagctatataaataatactacaatatagtgatagtgaagtttttatggtgttctcactaggaaggctgttataaaattatttatctaccaaaacttgtacagtttatctataaaaatgttagagaatttatcttcaaataattttgttatagtatatatacaaattaatatatagattttatctgcaaaaaacaagttctgataaggacataaagtttaaattatgaaataagtcatagccacaaagcaggcttatatggttaatggatttttaagttttataaatcatttttctcttaacttttgattttgaactactgttaaacttacagaaaagttataaaaatagtacagaaaatttccatatatccttcatccagactccactaaggtaaacatcttacataactgtagcataattattagaaccaggacattagcattgatacaatatctttaacaaaactaaggaccctatttgaattttgccaggatctccatttaggatcccacattgcattcaattgtcactttttacttttggcaaataaactaatctttaaatattattaggagaactcagaatttaaaactcttttttcatgagaaaaaaaaaaacagaatctttgtgacaggtggactttaagatggcccgcaatgatctctgcttcctggtattcatgccctgtttaatcccctcctctggagtgtaggttgcctgagtgatttgctcccaaccaacagaaggtaatggaatgtcaacttcatcattagtctacataagattgtgacttctgcattgctaacagactctctcccttactggctttgatgaagcaacttgtcatattgaggagacccacatggcaaggatctgaaggttgccactggctaatagacagctaggaactaagaccctccaaccaaagcctttaaggaactgaagtttttccaagaatcacatgagcttggaagttgatccttcccaggtcaagccttcagataagaccccaaccctgccaacatctttaattcacctatgtgacagaccctaaagcagaggacctggctgggccactcccagatatccggcccatagcaactgtataataatatatgtgtgttgctttaagctgataggtttatggtagtttgcaatatataactaatacacttttcttgacacatcacattgtcagaggcatgctactgagtttgatgttctattcattgacaagactcacacaatcatctttttaaaaatacattcctaagtttgtctttgttaggctgagctgttcagtgaaaaatgctcacaaaatcatagtcacaggcacctcccagagctgcagaacttacttagtcgtgaagagaatgttaatgctggaaggatcttccaagataatctactcccattttctccttttgcattatgaggaaattgaagcctaaacagattttcatagccaaatactgtgactccagtccagtgctcccaaatatcttgcctatctgacctccttgcacaatctatgagcaacagataacacaggaacataaatcaacagatgacaacactactggaaaacccaaataacaatagatggcttgttctccctatgataagcgaacagcattggtttcctatgtcagcatcttctgcgacctcaagagaccatataagaggttaggcttagcggggtatgagaagcagaaaagaggcttctttggtttctactccactaaacgtggggatggacagcggtgcaagggaatttttacatgtgtcattgtctcccatcagaagataaataatggaagcatttgtggtattttttggtcacattggtctgactctaaaatccaggactgtgtctttctttttcttcatttgtaatagtcatgatcctaccaggaaagaggtgagccactaaagcaggttcactgcagaatgtttaatgaagggctctgatcacctacagaaggaaaaggtacaggcagggtttagataaaccaacaaggcatagtacagtaggctgctgcagggagctgttagcaccctaggtttaagagacaaggggaaaaagaattttctggaacttggagagagttgtatggggaaggctgcttgataggggtcgtggcctcttacagtgagtgggttgcagtcaacccatgtaacctggcagaaaggaaaccaggggatcactacccaaactgtctattctcccacactatgatctcatgctggtggcttccattggctgaacccaacaggaagctagaaagtagccactgttgaagcggcctcccctgggaagagttaggatggaggagagtggaaagtagatatggagaagtaaatgagaaacagccagcacaaagctgcatgccttgcacctagtgaaagttcagcaaatacttgtcaagggatgaaacacagtgatgtgtgagcagacggttaaactatgattagcttgacatctggtgggactgtttacaccacaagaatcagcaaattatgcaaataatggttttgttgttggtttgttttttcttcctcagggatccaatttaccagcacaccactgaataaaagtctaaatcatgtcatctactacagaaggaaagctgttttcatttccactcaaaagaaaattacagccatgaacttcttgaatccacataagaaatgatctcaatattaactccttctccaccacttctaccactcctccttcacatacattattttttcggggagtatagctcaggggtagagcatttgactgcatatacattatgtttttggtggtaataccatctacctaagtctccaagtccaaaagcctttgccttccagtcaacttagacattcatatgcaaataatcactaaatactgccaatattacttcctaaaaatccgtcaaatccattttcccttctctcccattttattttctagaaaaattaagccagctgtactctctctaatatatggtagatctggctgttacttcatctgaattgcctttttaccccaccttgtttacatggcaaatttttcttcttcctccaaaattaatttcagcagttacctcctccctgctagtagccttccctaataatgccagataaaatgaattcctcccctttctctgtgttacctccatgccttgtaaactgatcacattttacagcaatttaattgtgtttatgtctggtcctctattacgctaagtcccttgaagacagtagtatgttttattcatttgcgtaacccagcatctagcagtgtgcctggcacattataggcaccaataagtgtttgctaaaggaataaattgataattttccaggtatctttgttgaataaactgatgccaggagctgagatagagctagttcctagtaagaccctctattcctcccttacgtcaggcccccccacccacactcccaaccttggcaacagtaactgcttgcaggactgatcccatcatgacctcttttcccacttcaatcaattatgacaggatgctcagtatatccggctctccctcacctcccggacttccagatcctcatggatcaaatgtaagcttcgcagtgagttttcctgaacaacactgcctaaaattgcacctcttttcaccatactcccaccctcccaaagctctccattcccctgctttgctattttcattgcacttatcactatccgctaaacgagtatttattatctgtctatttatttgcttactgcctatctctcaccggcataacataagctctgtgaagccagggatatttgtttatttcatctgcagctctatccctcctgtgcacagtcagcactccataattatctgttgaataagtaaatgaatcacacgcagaggtgactcctgcctgagataaagctgtcagtagcaaagttgggaggagaacctaactcccaacttaattgggaatacaaaagctcacactaccctgcccaagaggtgccctccacttcaggtcagcaggttctacatgcactattcaacatttaagtaatgcccacgtaagagttaaatgtcagtaaaactgtcataaatgaaaagcctacagactgagggtcttgtttgctatgccaatagcagtgtgtccctcttaaaatacagaaacttagaaaatactaacagataaacacagtttgaattaagatgggcataaataatgtaaaaatgacacagccactctgaaagagaatataaaagtccatactcttttaaccaacacattcctgattctcattaatatttggcatacttaccagggcccaggggatgagagattaacagatcacaaaagaaatgtgcaattgttgaattattttgcagttgttttgatttttacacattataaaaggatgccatgaatacggatattcaaatgaattgaatcacaagtattatttatacattctagtcagagccacataattatcgggggaaccagcccccaatatttcaatgtaggttctttctattttccctaagagttggccagtctaagaaataaagagagtacaaagagaggaattttactgttgggcctccaggggtgacatcacatattggtagatccgtgatgtccccttgagccgcaaaaccagcaggtttttattaaggactttaaaaggggtgggggtgtacgaacaaggaataggtcacaaagatcacatgctttaaagggcaataaagatcacaaggcaaagggcaaagcaaagatcacaaggtaaagggcaaaattagaattactgatgagggtctgttttcagctgtgcacatattgtcttgttaaacatcttaagcaacagaaaacagggttcgagagcagagaactagtctgacctcaactttaccaggacgcgatcttttccagaccttaataagcctgagggtactgcaggagaccagggcgtatttcagtccttatctcaaccgcatcagacagacaaccccagagtggccgtttatagacctccccccaggaatgcactccttccccagagtattaattattaatattccttgctgggaaaagaattcagtgatatctttcctacttgcacatccgtttataggctctctgcaagaagaaaaatatggctgtattctgcccgaccccgcaggcagtcagaccttatggttatcttcccttgttccctgaaaatcgctgttactctgttttttttcaaggtgcactgatttcatattgttcaaacacacgttttacaatcaatttgtacaatagtggtcctgaggtgatgtacattctcagtttaagaagataacaggattaagagattaaagtaaaaacaggcataagaaattataagagtattatttgggaactgataaatgtccatgaaatcttcacaatttatgtttctctgccacggctccagctggtccctccattcagggtccctcactttcctcaacacataataccgatgaattattgaggagaaaagtactgcacagagcttgatgaaatgtgtgtgcttgtgacactgtcagtaacatgacaaggcatttttagaaatatttgatctgtcatggcctgattctctagctttacatctttgtaaaatgaaagtaattggaattatatgacagtatcttacctatgctttgagctattttggctcataaaatgaaacctcatctatcacttcatattttatgcataatgccaaaaaagcaactaagtcaccagtgttgcctgatgttgaaaagggaactttgctacaaccagctgcctaaacagccaggttgccagaactcatgtggctgactgctgtttccaggttagcagataaattcaggaaagtaagcagcaaatgacttcagaatatttctttggtaacagcaacagtgctcatcttttttgtttgactactgatctatatatattttaaaaaattataaatatgaaagtatttaattccttaatgtttccatttattcccaaatgagatacaatttgggacatatgtaacttaacacctagagcctgaaattctattttctaccatgaactgtttaagcaaagaccaatccatccaatacacagaggggtccaagcagatgacctggctcctccccagggtgatactctttaaatatttgtttaatatttatttagctgagaaactgagatttgcactgaagagaaacaggacttcaggtagcagggacccaatttgcaaactcaacttagtaaaccagaagtcctgcagttaactcagcccattctttctgaaggcagttaggtggccagttgttgctactggatatgatccatcatatgtcaacacaatgccccccaaaaccttcaagtagattctctgattagtattccaaagcaaacataaaagagtttttgagaaaacctatgctaaatttaattttcttcatcttgtttcatgagtttttggagctccttattcatcagtgccatgggccactgtaaacggacctgcctctcaacccagtgaaaaaccaagtaaccttaggatgctggattccttaccctagtgtctccagtaagttctcatcagtcagtttaaatacctccagtaatagcaaactcaccatttcctgagacaacaattctatatttacacaagtttattatccataaaattcttcctttagctaagtaggaatttacttctcaatgactttcaattactagttctattaatatgtttgccctgtggaagaacacagaaaaagtatgctcccccttccatctcatggcccagaaacatctaagaacggccatggtatgccctcaaagtttcacacccccagttccctcaagtattcttcacatgaacagattctcaatcgctattctcatcagtatcctctacatattttattgttgttttctttctgttctttatataaactttaatgctaaaattttcaattagaaagtctttttaactgagtgcatatgagttaatattaagaagaagcacagagctgctaagccagtcttcaggcacaatctagtaattcctcatccattaggtccaggattttaacagtgatggagaagtgagagttaatttagtatctgttagctggttattctgccaaccagatcatcagtgttgcctgattttaaaaagggaagctcaggagcttcagaaggaagctaaattatctctggaaatattatccaagtcgccttaaagtttcaattcccttaatatacacacaaaatttgatttatgcaaaaattttaggaacatataaattatacaaaaagtgtagtacaactatagtcaacatattttgaactctcattaacctagacatttaggagggttccctgattgaagagttcatttattcctttactcagctatttaatgagcacctgctatgtgttgggcagtgttctgaacaatgggtatacaatgatgtacaaagtcaacaagttctctgccactgtggagcttgtaaagtaagagaggcaataaacagacaggcaaaaggggttataactgtgccatggtgaaagataacaggccctattgagggtgatcagagatttgtctgcagagatgtcttctgagaagagggcttagtgtgaggagaaagatactaccaggtaaaaggaacattatacacaaaggaagctagaaagagattggcatttttgagaggtagaaaggaaggtcagtgcaactggagccaggtcaacaacactagagaagcaaaaagggcttcagaaactatggtagggacttacaactggctatgggcagagctatgctttgaatcaaatgtaatctgcccccaaactttcaagcgcattctctgcagttgccagatgaaattctttaatcttcagtgaacacacataatataaaatttgggtaacagtatggtgtttttcaagaagctcatttgaggaaactcatttggttctcactgcaaacctacaaggattaagtacactaaagaaaactgtagtatactatggaaaattgagtacatgacagaaaacatgtagtttccatgcttcaggtgtaatttttaatcttagtcatgtggctaagtaattttttttataaaattgctctagatattaagaatagttgtttaggacctaatggcaaatcaatatgtcagagggaaaaacaaataaccaacacatcaaattcttaaagttaaaatctcacttcaggagcatggaatatctctgcaatgtactggaacatataagcaagctggagataatctgctgggtctcctccatttcaattagcctgttttgcagtacatgatgtgtacatttattaaaagcagacacagtctaaaagagaaactgtgaaagctcattgttataacatatgatatagttgatcaggatctgaggtctcaaaggaatcaagttaaaaactataacatttacacataccattataatatttttaaattaagttttaaatagtattatgtaggtattgtctctaggatgaaatacaagcaaatcttcattatttggttagcaggggaaattagtatgatgaatgatccaaaataatgaaatataaaagaaaaatatatttgactttagaatttttttttataatacattttacttctctgaactcactttgcttattaaatttagcttgcagatcccacacatacactaagtgacagcaagaagcattggtctgaaagtgcaattataaaattaaatataataataaatgcagggccaggagtggtggctcacacctgtaatcccagtactttgggaggctgaggtgggtggatcacttgaggtcagaagttcgagaccagcctggccaatatggtgaaaccccatctccactaaaaatacaaaaattagccaggcgcggtggtgggcgcctgtaatcccagctactcaggaggctgaagcagggagaattgcttgaacctaagaggcagaggttgcagtgagccgagatcacactactacactccagccttagcagcagagcgagaccctgcctcaaaaaataataataataaatgccacaataaaaaataaaataaggccccaaaggatacttgaaaactaatataataatggatatcattatccatgaaaatagaagtaaaaaattaccatattagcacacttatcaggtcaggggaaaaggaaattgtacctaaaagtgccctgaaaactgtaagcagcttaactaaaaatttacagctaacattcaagtagagattgaattataatcaggagaatgattgaaatgagtttacacatatatatacatatatatatgtatatatatatatatatatatatatatacacaaatatacacatatatatatttgagacagagtctcactccatcgtccaggctgaagtgcagtggcacgatctcagctcactgcaagctccacctcccggattcatgccatcctcctgcctcagcctcccgagtagctgggactacaggcgcctgccactatgcctggctaatttttttgtatttttagtagagacggggtttcaccatgttagccagaatggtctcaatctcctgacctcgtgatctgctcgcctggcctcccaaagtgctgggattacaggtgtgagccaccacgcccagcctgaaaaatatattttaaaaacccaatcctgcttacaatagctacaaaaaacactttggaataaacaaggaagtgaaagatctctacacaaataactataaacattgaaaaaaattgaagaaggcacaaataagtggaaagaaatggatgttcatggttggaagaattcatattttcaatgtgtccgtactacccaaagtgatctagagtcaatgcaattcctatcaaaataccaatgacatttttcacagaaacagaaaaaataatccccaagtttgcatggaaacacaaaagacaaaacagccaaaccaagcctattaaaaaaacaaagctggaggcatcacactacctaacttcaaaatatactacaaagcataatgatatggtttagctgtgtccccacccaaatctcatcttaaattgtagtttccataatcctcatttgtcataggaagtactcagtggaaggtaattgaatcataggggcagttacccccatgttgctgttcttgtgatagtgagtgagttctcatgagatctgatggttttataaggggctttccccattttgctccgcacttctccttcctgccatcatgtgaagaaggatgtgtttgcttccctttccaccattataagtttcctgaggtcttcccagccatgcagaactgtgagtcaattaaatctccttcgtttgtaaattacccagtctcatgcagtcctttatagcagtgtgagactggaataataacacatagtaactgaaacagtatggtattggtataaaaacagtcacatagaccaatggaatggaaccaagatccaataaataaatccatgcctttacagtaaactggtttttgacaaggtgccaagaacacacaatggagaaaagacagtcatttcatgcaatggagaaaagacactcaataaatggcattagggaaactgcctatcaacatgcagaagaatgaaattagactcttatcgcataggatatgcaaaaatgaactcaaaatgggttaaagacttaaatgtaagggcccaaactatgaaactactaaaagaaaacatagggggaacctatagcctggttaatgatttttgggaaatgatcccaaaagctcaaacatcaaaagcaaaagtagacaaatgagatttcatcaaactaaaagcttctgcacagcaaaggaaataacagagtgaagagacaacctatggaatgggagaaaatatttgcaagctatacatctaataaagggttaatatccaaaatacataaggaactcaaacacctcagtagcaagaaaacaaatcacctgatgacaaaatgatcaaaaaaacctgaatagacatttctcaaaagaagacatataaatggccaacaggtatatgaaaaaatgttaaacatcactaattatcagggcaatgcaaatcaaaacctcaaatcccaccactgctttatcaaataagttaaggtaatattcaaaatcttttgttgtcatttcagcaatgttcacagcagcttcaccaggaatagacttcatctcaagaaaccactttctttgttcatccataaaaaagctactcctcatccattcaagtttgatcatgagattgtagcaattcagtcacatctttaggctccacttttaattatagttctcttgctattttcacaacctctgcaattactttctccactaaagtcttgaacttctcaaagtcatccacgagtgttggaatcaagttcttccaaattcctgttaatgttaatgttttcacctcctgtcatgaatcacaagcattcttaatggaatctagaatggtaaatcatttcctaaaggttttcaattttctttgcccagatccattagagaaatcacaatctatctatagcagctacagccttatgaaatgtatttctgaaataataagacttgaaagtcaaaattattccctgattaatgggctgcagaatagatattttgttaacaggcaagaaaacaacattcatctcctcttacatctccgtagagctcttgggtgaccaggtgcattgtcagtgagtagtaatattttaaaagaaatctgtttttttctgagcagtaggtgtcaaaaatgggcttcaaaataatcagtaagcagtttctctaatgccatttattgactgtcttttctccattgcatgaaatgactgtcctttctccattgagtgttcttggtgcttttgtcaaaaaccagtttgatgtaaaggcatggatttatttattggatctcgattccattccattggtctatcagtaaacaggtgtgctgtcatccaggcttttctgttacacttatagagtatgagtagagtagatttagcatacttgttaacggccttaggattttgggaatggtaaaagatcattggcttcaacttacagtcatcagctgaattagaccttaacaacagagtcagtctgtcctttgaagttttaaagccaggcactgacttctcttctctagctagcaaagtcctagatggcatcttcttccagtacaaagctgttttgcctaaactgaaaatctgctgtttagtgtagccatctttatcaatgatcttagctaaatcttctagatgacttgctgcagcttctaaatgagcacttgttacgtcatcttgcacatttatgtcatggagatggtttctttccttaaatctcatgaaccaatctctgctagcatcaaacttttcttctccagcttcctcacctcttccagccttcacaaaattgaagagttacaatcttgctctagattaggctttggcttaagagaatgttgtggctgttttgatcttccatccagaccacaaaaactttctccatatcagcaataaggctgttttgccttctaatcatttgtgtgttcacggatgtagcactgtttgttgcctataagaacttttgctttgcattcacaattggctaactgttgggtgcaagaggcctagctttcagcatatcttggctttcaacacgccttcctcactaaacttaatcatctctagcttttcatttaaagtgagagatatgccactcttcccttcacctgaatacttagaggccattgtagggttgttaattagcctaatttgaatattactgtgtctcgcagaataggaaggccccaggcgagggagagagacaatggaacaatagtcaatatatggaatcaacctaagtatccactaaccaatgaatgcataaagaaaatgtgatacacacacacacacacacacacacacacatatacacaatggaatactattcagccataaaaaagaaaaaaatcctgttatttgccacaacatggatcaacctggaggacacttcgttaagtggcgtaagtcaggcacagaaagacaaataccacaggatctcattcatatatagagtatttaaaatttgatctcattgaaatagagaatagaataaaggtgaaaagagactggggaagttcaagggtgaagattggggaaatgttggtcaaatgacacaaaattacagttagctagggggaataagttaaagagatcttttgtatagcatggtgactacagttattgataacatattgtattcttagctggtcatggtggtgtgtgcctacagtactcccagctagctgaggggctgaagcaggaggactgcttgagcctaggagcttgaggccagcctggacaatatagcgacaccccatctctaagtgtgtatatatatacacacaaatatatacatatatacacacatatatatacacatattaatgtatatatacacatgtatacacacatatatgcacacatacatatatgtatgtgtctgtatatatatgtacacacatatgtgtatatttgtatgtatatgtgtatgtgtagtattcttaaaaaatgctaaaatgatggatgtaaagtgttctcaccacaaaaatggtacaatgtgatgtgatgtatttgttaatcagctagatttagccattccatcatgtatgtatacttcaaaacatcatgttgacacagtaaatgcatgcaattttatctgccaatttaacataaataggaattcaaacacacagaaaaaatgcaacttattcttgtattactattctaaaactttgtaacattttaattcagaaaataattgatgttatatgtgaataagtaatacatgctttgaaatttttttaagtgtatacttaatatttcaaaaattccatgatatacttttgattgatgtacttattgaaattatccctgatcctgtttgatattgtgctggatagcctctgtctatctctctgtgtctacactttggccttcttgccctgctctgcctcccagtgttgagtggaagaaccacccaacatctatgtatggttcacacttgctttaaagtataagatttgggacttttgaactgatgagatttagttgagattctggatctcatccaccatgctcacatgaattatgcacccttgtcctctggttgtggatgagttcatttgatgagaggcactggcagatgggagggtgggaggtgagtgaggtcagggtatttatccttccttctctctcactgcaagactgaagggttggcagtggccgtgctcctctgcctagggtcatagcacctggcctgtccaagaccctttacccatagatacaactctctctaactctctctaggtgctactggccattattccccttcaatcttgggtggtggaactgtatccccgtatcatgagaccctggtgcctcccatcacttatttgttctcttaaccctgcccacagctccataaatagtctcttcaagaaactctcttatcacccctttgagtgtgttgtctgtcttatgctggatcctcactagaacagctattatggaattcctctgatagcatcaatctaacattgtgaataattttttcccataaataaaattattccagattttcaaaacatttctattttcaaagaattagaactagccatgactaatgtggctaataacaaccaaaataaaagggagtcatttggataattttttttctcctaggacacttctgctataaccaactcttatcactgaataatctgggttccgaaatacctgtcatcgccatcaatgatgcactcagggaaggcgagggtacagccaaacagcatgatatgttgatagcaactgaggcgatggagatatgtgaaaaacttgaggaacttttccatttccatgtttctgacaactgagaggagaggtgtcagcgtggcgtggtagggcagcatctgacactggctgtgggtgatgttcatacaggcacctgggaagtaaagacatgcacatttaagagtggacacatcagaagtatatgtttgcaaactcatttaatatttgtttataagataaagtatacttatcacaagaaaaaatttagatatgcaatcatacacataggtgcatgtaagtatgtgtatgtgtatgataatgaaatcaagctacaaatatttacagaggaaaagcattcgtgtcctgggaaaatgtgtggaaaatacatactcctcatacatatctagtaggcatataaactggcaatcaccttttcttttggatcacagctgggcagggcaatatgtatccaaaaaaatcttttcaccatgcatattctttgacattatcaagtcatttctagaaacttatcctaaggaaataatcatatttgtgaatgtggatttatctacggggatcttgatctttgcatagtttacaatttttaaaagatagaaatcatctaaatattcagcaaaaagaattgttctttagaatatggaacaaacaatagaatatttaatttaggtacatgaaagatgcttcagaagactatttaatcacaacggatgatgctcataatataataagtaaaagtaggaagtcacaaaacaatttgtatacaatgatcttgtttttaaaacacacaattatgcaaagatttgtaatcccgcctatgtcaacagttcaggagcagctcagagcctctgacattatcttctcccatagttggctcttttgggcgccaccatatccatggcttttccattgccttcatgccagaaatttgcctggttgacccgatataaacaaaaatgttgacatgcattcatatgatgggattttaggaatcgaccacattttcttttttattccttattctcttgtctgtataaagattcattgcttttattgttgctgcttaaacaagattctcttattcacaatcgcctcagtttcaagacccagttacatgaaatcatatctatattatacatgagaaaactcaatttttagaaggctaagaaatttgcctagaggtgcatagccattatgtagaaatttcagatctgaaacctatgtcttctgagtaatttccattacttagagctaatgtagagggttatgttaaaaatagttcttgagataattcttaatggctcatgaaaggaagaggctaaaaagcatataatgacatatctcaaggtctgtatgtatagtaatatgtaatacacctgtatattttgaccacacctttttatcagttttaattacattattttatttaggggttatcagcttttgggcttatgcttttgatggaagcccatatttgaagcaattagaatactaaaaggctcattccctccacccagccaaagaaaccactgaatattaagagatcattttaaaaatgcaagatagaaaacatcctaggggccgggtgcggtggctcactcctgtaatcccagcactttgggaggccgaggcaggcagatcacgaggtcaggagactgagaccatcctggttaacacggtgaaaccccatctctactaaaaatacaaaaaattagccgggcgtggtggcgggcgttgtggggggcgtggtggcgggaggctgaggcaggagaatggtgtgaacccgggaggcggagcttgtagtgagctgagatcgcgccactgcaccccagcctgggcgacagagcgagactccgtcccccaaaaaaaaaaaaaaagaatcctaggaattttcccatattagcatttggagagcttcactgtttcctttactgctgcataacattccactatatgttgtactgggatttatttaagcaatctccctttaataaatatttggactgttttcaactttttgctattatattgctgtaataagtaacctgtacatatgcctgagatgtacaatagattcccagaagtaggattgctgggtaaacggataaatgctttcagaattttggtagctattgtcaaattcccccatcatcgagaagtaccattttgaattctcgccaacaatgtatgaggatgtctgctttctcagtctcaccaacagagaacagtgtcaaacttttggatttttgctaatctgataggtgagaaattatattgtagggtgatttttcatttgcatttaacttgttgccagtgaagttgagcaccttttcatatatttaaggaccatttgcattttgtcttcagtttcatatgcttggaagatttttcctactgacttttaggggtgttttttctacttttacaaactccttattagggagattaatgtactgaaaatattctaacactttttctatagttttgtggttttgaaatcattttaaagaactaacaactatataatcatttaacagatgaatatattttattctactttaatccagccgttgaaatatttaaagggggctttctttgaaaagtagccggttcagaggcagagctcaaaatcgaatctggagtaaggtatgataatatctgacatttcagtacccctttgtagtttacgaaccacttctacccttatcttttaaggttgtattagttaggtttggtttggctgtagtgaaggaaaatggaatataacattgctttaagcagaacaaaatttctctgccccataaaagtctagatgagtggtctaggacaggaattggatcccgtggtgccagaaacataggctctttatgtagccctaacttcatggcccaagatagtgaaatctacagtccagacagaagggtggagaagtagtaaagaggacaaagacacacactcttactatttcttaagaacagtttcagctgctacaagacccttccacatatatcccattatccagaatgtcgtcacatggccacatctagttgcatgagaggctaggattattccagtttgacatgtgcccagataaaaatggggagtgggatcaactacaaacgaaggagaatgaatactggtgttcaaccagaaacctttgccagaaaaacaaatagagaaggcatcattatactcattataaaagaaaacaaaggccgggcgcagtggctcacacctgtaatcccagcactttgggaggctgaggtgggcggatcacctgaggtcaggagttcgagaccaccctggccaacatggtgaaaccccatctctagtaaaaatacaaaaattagccgggtgtgatggtgggcgcctgtaatcccagctactcgggaggctgaggcagaagaattgcttaaactcgggaggcggaggttggcagtgagctgagatcatgtcactgcactccagtctgagcaaaagagcaagactctgtctcaaaaaaaaaaaaaaaaaaaggtacaactattttcctattcaagatgtttgattaagcacatatcctccctcctgacatttcaccaaaaaaagaatagtaaaggggaaaaaggcataaactcataacagcaaagagcatggagaggggcttccatcagaagataaatatttttagcaaatttctgccagccaaaaagagcatgcaagaaattttgaagtttgtggaagaggatgaagtcaatctgcccagcagaacctaggagaggttctgggcttgagttgtcagataaggcagagaagaacaaaaactggaactaaaaaagggagatattaaagatctgtatatgaaacaattgctcctcactccacccacacgcacagaatacaagacagccacaaaattaccaccattaaaaagaaaaaaaaagaaaaatattcatctatctctaaagaaattacacaatggtctgaaaactgagaaagctggtatggctattggtaccacagataaggttaacaataactgaaaatgtcgctctgaaaaaatagaaatagttcaagacagaagagaactttaaaaaaatcatcaataacttcagagtaaagtgcccatgtaatttatcatcctacctgagaaaatttaaagaatgataacaatgagctattaatagctatgccaggaaaataaatataaaccatgactgtctcctatgagccaagatatatagatttaaataggtattgcatccataaatgagaataggatgctaagaaaaagaaaactcagaagagaaaaccttacaatcgacaccacataaatgcaaaggatcataagagattactataaataattatacaccaacaaattagataacctagaagaaatggataaattcctgggcacatacaacttaacaagactgactcatgaaaaatcagaaaatctgaacagcccaataatgagaaaggatattgaacctgtcaggcctctgagcccaagctaagccatcatatcccctgtgacctgcaagtatacatccagatggcctgaagtaactgaagaatcacaaaagaagtgaaaatggcctgttcttgccttaactgatgacattacctttgaaattccttctcctggctcaccccggctcaaaagctcccccactgagcaccttgtgacccccatccctgccctctggagaacaacccctttgactgtaattttccactatccacccaaatcttataaaacggccccacccctgtctcccttcgctaactctcttttcggactcagcccgcctgcacccaggtgaaggaaacagccttgttgctcacacaaagcctgttcggtggtctcttctcacggactcaagtgaaagaaccagtaacaaaaagtcttccatcacagaaaagcccaggacctgacgtcttcactattaattccacaaaacatttaaagaactaatatcaattcctctcaaactcttccaaaaaactgaagaaaagtgaacatttgtaaacacattttacaaagccagcattgccctgataccaaagccagacaaggacactacaagagaagaaaattacaccttaataactttgatgaatatagatacaaaaatcctcaacaaaatgctggcaaaccaaattcaacagcacattaaaaagatcatttaccatgatcaagtggaatttatacctgggatgcaaggatgtttcaacatacacaaattaataaatgtgatacatcaccttaatagaatgaaagacaaaagccatacgaccatctcaaaagacagaaaaaacacttgagaaaattaaacatcctttcatgataagaccttcaacaaattaggtatagaagaaatgtacttcaacacaataaaggccatctacgacaaacccacagctaacaacatatgcaatgggaaaagagaaaagccatcctctaagatcaggaagagaacaaggatgcctgctcttgccactaataatcaacatagcactggaagtcctaaccagagcaattaggcaagagaaagaaataaaaggcaatcaaatcagaaagaaagaagttaaacggtctctgtttgtaacaacatgatcttatatttagaaaaacctaaagattccacaaggaaacctgttagaataagcacattcagaaaagtagtaaaagtagtatgttcaaaatcaacataaaaaatcagttgtttcaatcagaaatggagagaaaaataaacttaaattaaaaataaaaataaaccagttctgcttttatacattaacaacaaactgtacaaaaaagaaatcgagaaaacaatcacatttacaatagctacaaaaaaaatacttaggaataaatttaaccaaggaggtgaaagatcttacactgaaaatgatgaagcattgatgaaagaagtgaaaggaaacacaaataaatagaaaaatatcctgtattcatggtttggaaggattaatctcattaaaatattcatactacccaaagtgatctacagattcagtgcaatccctattataattctaataacatttttcaaagaaatacaaaaaatcctagaattcatatggaaacacacaaaaaacaaagaaccaaaaaaaaattgagcgaaaagaaaactgaaggtttcacactacttgatttccaaatacactataaagctatagtaatcaaaaaagcatgatattggggtataagcataaaaccaatgtaactgaatgaagaatccagaaataaatccacacattgatgaccaattgattttcaacaaagatgccaagaatacacaatggggaaacaacagtctcttcaataaatagtgttgaaaaaactggatataaagatttagaagaatgagattagtcttattttacaccatatacaaaattaactcaaaatgaattaaaaacttacatgtaaaacctaaaactataacactactagaagaatacatagggggaaagctcagtgacattggtctggttaataattttttgaatatgatcccaaaggcaagggcaacaaaagtataaatacacaaatgggattacatcaaactaaaaagcttcttcccaggaaacagtcagcacagcaaagaaataacttacaaaatgggagaaaatatttgcaaaccatacacctgataaggggttaatatccaaaatacaaaaggaattttatttagtagttaggaaacaataactaaatttaaaagtgggaaaaggccctaaatagacatttcacaaaaaaatacatacgaatggccaacaggtatatgaaaaaaagttcaacatctctagccatcagagaaatgcaaattaaaaccataatgagctattacctcatacctgttaggatggctattactaaaacaaaaattaaaaaatgaaaaaacagaaaataacaagtgctggtgaggatgtggagaaaagggagcatttgcacactgttgatagggttgtaaattagtgtagccattatggaagacagtatggacattcctcccaaaaattaaaaatagaattacaaaacgatccaacaaccccaatactagctgtatattccaaggatgtaaaatcagtgttttgaagagaaatctacactcccatgttcactgcagcattattcacaatagcgaagatatggactcaataaaaatgtccatcaatggatgaatggataaagaacatgtagtatatacacacaatgaaatatgatttggcctttaaaaagaaggaaatcttgtcatttatgacaagatggatgaacctagagaacattatgttaagtgaaatcaactaagcacaaaaagacaaaaaccacatgatttcacttatatgtggaatcttaaaaagttgaactcatagaagcagagagtaaaatgatggctaccagggactaggggtataagggtgaggattgcaatatgttggtcaaaggatccaaaatttcagttagacaggagaagtaagatcaagcgacctattgtacagcatggtgactatagttaataataatgccctgtacactttgaaaattgctaagaaagtagattttaagtatactcaccccccaaaattatttgaggttaaaaaataaaaacagatccaagtgatgttacaacaacttttttcatatttcatgtaaataaaggcagcattttgcattgggaaaaaatgggttatgagccctcacagagggaccaactagactggaaatttttggtgcctgttcctggctgtaccaggaagtcaactcaggtcaggactacatcagcagagtggaataatgaaggtcattctctattctagataattcacctaagaagaaacattttgccagaatgatttctgggaaaaatcaatttgaaaggatatcgtgtacttaggaagatctgtaagagggttacagtaagctaagagaaaacataaaactgaagacagggtctctccatgaagatttaagctttcgtttttaacttttattttaagttcaggggtacatgtgcaggtatattacatagataaacttgtgtcatggggggctgtcatacagattatttcgtcacccaagtattaagcctagtacccattagttatttttcctgattctttccctcctcccaccctccaccctctgatagaccccagtgtgaattgtttccctctatgtgtccatgtgttctcatcatttagctcccacttataagtgaaaacatgtggtatttggttttctattcaggtcttaactaactgtaaaccaaacctaaacacagtaactattctacttctcataagagaaaatcaggaaacaaaagatgcattttcttaatgagtgatttacaacatttgtaaaaagtctttacagacatagtgaaggcacagttaagccaatgtcttgctaagttatacaaaaatatgtaagtattttgtgcaatgccacgtaaattatcagagttaagtaaaagctagctattcttgtcaagagaaatacgaggtttgggagtttattttctatataattgtatatattctagactaaacgctttttaatgcaccccgattctcttggtgatgtattttgccaagcttcaagctttcacattacatagatagatagatagatagatagatagatagatagataggtagatagataattgtctctatcttattcctaaacgcaccttcatacttggttttaagatgtttaaatcataagtaaaggctcataacctgttgcaattcattcattcaagaaactacttactgtgacaatgctttaacacagtgaggggtcaaggtagagaaatgagccgtaatataggcctcggccgatgtgtaggaagaggcagatgaagaatattgaggcgccattggcgtgaaggtagcggatttctttgtaaatcaattattcacattccatagaattaagtgagacttaacattgcagctgtagcagcatctgtcaggcattttttataaattttgaaagaactacaccttgccccataaaatcatccatcctagagttatgaatgaatgataacaataattaaaatgtatatagtgtcttcaagtttgttaaacagttttctatacataatatggtggttccacagtctgattcaaaatcctggctactattttatatttctgtggcctttggcaagttattgaactcctctgtttatcagtttcctcatctgtaaaatggaaataataataactgtgtaataggtttattataaggataaaacaatgcttacacaatgtccagcacatagtatgtgataagaagtttttgctattattattatctcatttgtgactcacaaaaactctgtgaactagacaggggagagatttgtatccatgttacataggtaagaaaattgaggcagaaagctttcattctgcttttttcttctggattctataatgtatccatttataaagggaataattattcatttatataggaacaaaattcaaaattgaactacttagttttgcttacttgtacaataaaacaatgctgggagttataatttttttttaaaaaagtaagcattttaaaacattagtcatttaaaaatacgtattgagtctctactatacaaaggcacttagtgctatagaatgtttttaaaaaaagaatttggaattagaccacatttcacatatttagccaaaatttaacacatatagaaattatttgtttttcatgccaacagtggtaaaaataaattctataatgatgagagtataaaaaattacttactggagcaacatgttcaataaggaaaggatttattgtaaaatccactacctcactagtagtttgttttaaatttcaccactcatgaaggtgatgagatctcagtagactttcagccctatgtagtttattgggaatctcatttagtaatagttaagatttgagtacgggagtaatgaattctaggactaacagggcaggtctgcataccaaagcctggattacaccagctgggtattgtggtccttaatgtatttgtaaaaggctcatttaaataacgctctctaattcagaatcctctaaacttaaaatctatcataagtcagaatcaagttgagcaattgtttacctttttactctctgactctgcaaaggaagattttatggagaataagatcgtaaggaaaggcatgttctacatactcaaaaggaaacatttaaaatgaacttctagtctccttaaaatacacataaaacatgtcatttctttcttttaataaatataccttttatattctaataaatataccttctaggtatatttagtatataaatgtatacctaggtatatatatttattaaaaccaggttcattgatttgaaagataaaaggtatatttatcttttatatttattattaattactaaaagataaaaggtatatttattatataccttttggggagacaaacattctgtccataagattgatctataattttcattttcatattgtctttgctttaaatatctagtttctacttgattcaaaactacctatcggcattttctattttctctagaatattttgcatttaatggtgattaattgttccttaaaagtgtgataaaacttgtctataaaattatctgggattttaaaataaatttttaaaagtaagaatgatttttataggtagttttaaaactactgattatgatggcagcggtggcccatctggagatgctgagaagatgccagctgcagtgcgggaggcatggccagggctgcatgctccactggccgaagtcggtgggagccgggaacaggtgggagccccacccccttctcagctggcagggcaggagccctgcactcccgggtgtgaaagtatgtttagttcatattattaaacatggtttctttctgggtaggggaatttggtatgattttttccttcttgctttatgcttccagttttctatattgcttaaattaaatagtagatatataattctgataaataataaaattattatttttaaaagagcttttaaaataaacttaaaaatatgaccatcttctccgccataagtctggcttgtttttggtgagggatgtgggagtcagcacgaaagggaaattgtagtacatgggtcaaagcaaagaggaaaagggagcaagtagactcttcctgacctttctggctagtattttctgagttcttatcatgtgccagactgtaagactagccccattgacaagtcttgcagtggcttcttctataaaagcagcagcaacctcaacaaagaaggaaatcctgccatatgatatggtatgcatgaaacttgaggacattatgctaagtaaaataagccagtcacaaaagggcaaatactgcatgattccacttacctaaagtatcaaacatagtcaaactcatagaagcagaaaagcggaatgatggttgccagaggttgggcagaaggggaaatgaggagttgctaaccaatgggtatagagtttcaggcgtgcaagatgaatgggcacattaacaagtgtaatgtatactcaaaactttgttaagaagttagatttcatgttttctttttaacaataaagaaattagagataggacaagatggctgactagacgcatacaagtggaacagctcccctggagggactgagatgactggcatgcttttttgttgttgtttttttaataattgtctcatttattatctttctttttttttcatatatactttaagttctagggtacatgtgcacaacgtacaggttttttacctatgtatacatgtgccatgttggtgtgctgcacccattaattcttcatttacattaggtatatctcctaatgctatctctcccccctcctcccaccccacgacgggcccccgtgtgtgatgttccccatcctgtgtccaagtgttctcattgttcaattcccacctatgagtgagaacatggggtgtttggttttctgtccttgcgatagtttgctgagaataatggtttccagcttcatccatgtccctacaaagtcatgaactcatccttttttatggctgcatagtgttccatggtgtatatatgccacattttcttaatgactggcatgctttaaacagatcttcagagggaaggtgctgagggtggatggagggaagacacagaagctcagctgaagagggagaaagttggcacctgtagggccaactctactgggaggttgacagcgtttgatgtgtccccaggcattttctgcttcactgcttctcatgattggctgtgatatgactggccagtacccaaactctagaataagctagagaaactctaggaaaaaactttagatttaaggtttccatttctatggatttggggctttgtcttttgttttttggggtttttttgagtcaaggtttcactctgttgcccaggctggagtgcaatggcgagatctcagctcgcttcaacttcaacctcccaggctcaagtgcttctcccatctcagcctcccaagtagctgggggtttttttgagtcaaggtttcactctgttgcccaggctggagtgcaatggcaagatctcggctcacttcaacttcaacctcccaggctcaagtgcttctcccacctcagcctcccgagtagctgggactacaggcactcctcaccatgcccagctatttgtattttttgtagagatagttttgccatgttgcccaggctggtctcaaactcctgaattcaagcaatccacccacctcagcctcccaaagtgctaggattttggggggtttttttgagtcaaggtctcactctgttgcccagactggagtgcaatggtgagatctcggctcacttgaacttcagcctcccaggctcaagttgctgcgtgtggtatgagccaccacacccaaccaggtctccatttctttcccacagcaacctcccatattattcatttaaaaaaatttctcattaactttaaaggacatattatatggtaacatagttactgtggcttaacagccatcaggacatcataaatcagtctcctgaaatgcacattctagaggattatattgagtgcatatctataaacacatagccacaacaaaacagactctctgagcttgagtacttaaaacacaatggaggaatttggaggccattccaatgagaaaattacaaaattttatatctcccacttcctgaggtgataacattcccattaatacctgcaacagcaatgttggccttcccatactctacagacaaaattgaaaactaaagtctctgttcaattgattcaagataattattaaattttaaaatgaagcagtttaatctgtttaaaaatagaagctccaggatagacctttaaattaaaatatatttttgtccttgtaaagaaaactttacaaaaaaagttgtatttattatagaattaaaatggtatgaattagcaatattatattttagaaaaataaaaagaattgaaatcgatcatgtttgtttctgagcctgtcttatagaatttctcactttatttctcaagttgtaagaatatgttcatgttgcaaggcagttagtagacaactggctgcttggggacaggacttctgtcttatccatctttatagtccatagagccaaaacctggagtatgacatccaataaatagctactgattaacaaatggtgcttcacagaatattaacctagattctccaaaatttgagacatctcatacaatttagaaaagtacacaggcatgagaatgggtttacacagcttaatataattacaaacaagtactataccataagtcttattaattcaaacactggccaggcgcggtggctcacgtctgtaatcccagcactttgggaggccgaggcaggcagatcaagacgtcaggagttcaagaccagcctagccaatatggtgaaaccccatctctactaaaaatacaaaaattagctaagcgtggtggcacacacctgttatcccagctactcgggaggctgaggcaggagaatcacttgaactcaggaggtggaggttgcagtgtgccaagatcgcgccattgcactccagcctgggtgacagagcaagactccgtctcaaaaacagaaattcaaacaccacatgtgaatattagattaatgatctggagcagcaaaatagagaataaaatgtgttaacactgaaacacaagaagtggattgcgtcaaattgaaaagatgtaaagcttttggtttggaaaactcattaccttactcatttcagctacaagtgaaaaggcatattttccaaaggcacaagtaacagcaaacagattcccactgatgggttttttgctctcaacacaaaattatacaaatacttaaaacctgagacagtcaacaaattgaataattcaggcaaaagattacatacagtgccaattttctttcagaaccagaggaaaaagtaaattacatagtttgggtttttttggttttttgatttttgttttgactttcatctgagcctttgacttttaaaagatcattttgaccagtattatttttacaatgctgttaacatgctactgttttgcttgttttcctttttttctctctgtgaatcaaaggtattattaggctgttcttcctaaagaggaaattgtgataatgaagctggagagaaaaaatttgagccacaagcccttttgatgtgactgtttgactctcacttgctgtatgtattaatatggcataaacatataagttttgggggcatttgtcacctgggggatattgcaggattcatttaggagagagggtcaggagtcttgccaagacatctttgaaaaaggaaatctaggactgtacccaaaggagagtgaaacagtcactgttccattactgctttcagaagcctagttctgcagatgactgagtttgctctttctgggaggaacccaatacatcctagggaaagaatcatctaaagatggaatgaggaggaagggaaggaaatcagggaaaagagaagaagagaatccattcttatattcgagctacttttctctctctagaattgtgcaagtctttactagaatgctgacaaccaaacaagcatgcaacgattacttaaatgttgcactcattcttgcttagatgttgctgttagccagaagcccatgtctgaatctcataattgttctttcagaataaaggatatgatttaatatatagaggagagaaaccaactggacctgaacaatgggggtctaacactagtgtccaccagagcacatgggaatggcgtctagaggtcatgactacagtgacttttggaatatcactaagaccttgagaagcagcttaggcagacttcagaccctccaaggtaccaacaaaatatttttttcctctacagcaggtgcccataatcagaatccaaagaaccaatggcccctacataaaatttaggctgtctatgaacttgtatggggaaaaaataacatctccatttccaataacacccaactgaaatttagtataattaaattgccaatgtaggcaacaactatagaaaaaattagaaatcagatatttccatcaatatagagttgttacaaacatttcaagatattatttatgctcatccctattataaaataatggttataggtcgagcacagaggctcacgcctgtattcccagcactttgggaggctgaggcaggcggatcactcaaggtcaggagtttgagaccagcctggccaacatccttaacgggtaagagatttaccagatttcagatatctaattagactccctttctcaaactctcctctaagatagttgcctgatgagtagtaatccaggtaaaactccaaggcctgctctgatcctcttagctgcatattcttttttttttcttttttttttttcttttttagatggagttttgctgtttcacccaggctggagtgaagtggtgcgatctcggctcactgcaacctccgcccccaggttcaagtgattctcctgcctcagcctcccgagtagctgggattacatgtgtttgccaccatgcctggataatttttgtatttttagtagagacaaggtttcaccatgttggtcaggctggtcccgaactcttgacctcaggtgatccacctgcctcggcctcccaaagtgctaggattacaggtgtgagccaccgtgcctggccagctgtatattcttgtagagctcatgttaaagctaatgaaaacatctcatgttaaaaacataaaactaagaagaaagaacaacctaagggttttgaattggtgcgtaagctttctacacccagtaacttttgggtatgagtttagggcatttcggtccatgtctagttatcaatgtaaataaatcactgcaatttagacagcatcatggtcatcatccaaatcattttttcttcagaaagaagactatgtagttcactgagggggaaaaagctagatataaagtgaattcccattattggggaaatggttgaaataaattatggtataatgacaacatggaatactatttagtcattataacaatagattagaattaagctattgccttgaagatactaacttgaagtattcttggatgggaaagatattttgtaaaaaaaaaaaagtaataaaaacaatgacccaaatcctctatgtgaatattatcctgtgtacatgtatgtgtatatgttcatataagattgtaagaggatggagaaaactataaaatcatacatatttggctattaggttcttcttaggcagaggaaaggagaagaaatgaaggaatttatgcaaaaatgggaaataaaaacttcaattacaaataacatatatatcataatcacattcatacattatataaaagagaaaaatcaattccccatattgaaggaaatgaaaaagaagaaatcagagtgaataaataaggtaaaaacaattgaggagtaggaaataatcccagaacagcaaagtaagatcctccaaaaatctactcctccacaaaagcagtgaaaacactgggaaaaaaaactgtcaaagttaatttttttttactagagagcatctggaaagatggtgggataggaaacaccagcaatctgtctccccacctagacaacaattgcactggcagaatctgtctgatataactattttggaactctggattctattgaatgtttgaaagtttcagaggtgggacagagcagttaaaggaacagagtttttgtttgttattgaagttaaactggtataaattcaagttagagtgctgtaactttaagatgttaaatatgatgccaatggtaaccataaataaaatagctatcgaatatatatatatcctttgagattttatatatatatatatgacaaaggaaatgaaaaaggaatttaaacgtttcaatattaaaaaaaaaactaaacacaaaagaaggcagtaatccaggaaatgagggatgaaaaaaagctacaaggtatataaaaaacaaatagcaaaatgacagaagtaggtcttcatcagtaattactttaaatattaatggattaaattttttcaatcaaaagacagagattggcagaatgggttaaaaaaaccataatccaactatatgctgtctaccacagactcactttagattcaaagacacaaataggttgtaagtgaaaggatacataaaaatattccctgcaaataataaccaaaagaagagagtgggatgactcacttatgatggtttgacttttataatttttcaactttacaattgtgcaaaagtgacacacatttaatagaaactgtattttgagtactcatataaccattctgtttttcactttcagtaaggtgtacaataaaatacacgagctgtccaatatgttattataaaatagggtttgtattagatggtttgtccaactgtaggctaatgtaaatgttctgagcacatttaaggtgaaggctaagctaagctacaatgttctataggttcgatgtattaaatgtatttttgacttacaatagtttcaacttacaatgggtttataaggatataactccataataagttgaggagaatcagtatccacaaaataggctttaaatcaacaacggtggctgggcgcagtggctaactcctgtgatcccagcactttgggaggccaaggtcaggagatcaagaccatcctagccaacatggtgaaaccgtgtctctagtaaaaatacaaaaattagccaggcatggtggcatgcgcctgtagtcccagctactcaggaggctgaggcaggagaatcgcgtgaacctggaaggcagaggttgcagtgagccgagatcatgccactgcactccagcctgggcaacagagcaagactccatctcaaaaaaagaaaaataaatcaaaaatggttagaagaaataaagaaggacattttatattaataaaaggttcaatataaaaagaagatacaacaattgtaaatatttacacacctaatgacagaccgtcaaaatgtctgacgcaaaaaattgatagaactgaaagaaggccaggcgcagtggctcatgactgtaatctcagcacttcgggaggccaaggtgggcagatcacttgaggtcaggagttcaagaccagcctggccaacgtggcaaaaccctgtctctactaaaaatacaaaaattagccaggcatagtggcgtgtgcttgtaatcccagctactcaggagactgagtcaggagaatcgcctgaacccaggaggcgaaggttgcagtgaactgagatcgtgccactgcactccagcctgggcaacagagcaagactccatctcaagaaaaaaaaaaaaaaagaaagaaagaaaaaaagacaagaaacagacaaatctacaataatagttggagacttgaataccccactctcaataatggatagaacaactagactgaagacaagtaaggaaacagagaaataacacaattccacttctaggtataaacccaagagaaccagaaacgttttcacacaaaaacttgcacgtgaatattcacagaagcattattgataatagttttaaaaaatgtatatgcaatcctaatttccaacaatggatgactggataaagaaaatgtgatagagccatatgaaggaatattactcagcactaaaaagaaatgaaatactgacacatgctatatcacggatgcattctgaaaacatcatgcaaaataaaagaaggcagatacaaaggaccacatattgtctgttgctttttatataaaagtttcagaataagaaaatccatagagattgaaactagattagttttggccaggagctgagggaaaggggaaataagggacagggaatatgccttttttttttgcaatgatgagaatattctaaaattagatagtggtgatggtctgaaatagaagattcaggatccggttatcaaagatgtgataagagaacagaacactttaagctttcagcacatcaatttactctcttgtcactttaactcctcatcagagttactaggttattttattgtgttccatattatcttttacccaaaagatcttggttggcaaaagtttcccctttccttaaagttaaatatatatttaaatagttataaaatacataaggaaaaaatggtgaaaataaaaacccagatatagaatacaacctaaaaaaagtccttgctgaaacatagtatgaacattaactatgggccttttcctttttcacattataatttgttttcaaaatgtaactaatgttaactccagaagtaccagatgtcacataaagcttatttcactttcacaaaacctaactgtactacatagtgtaatatgggggtattctggttaaagctttacaaaatgcaggattctatgtcttggcatgacatgaagaacccccaagaaaaatgtcttagggaaagactatttcttggtattttcctacccaggatatttgggtagaatagaatgaatgtctggccattgtatttttggactgaagtatatttaaatagcttttacatatgccaggaattgaaaataacatcttaatttgagcataataaaagaggaggataaaaataaactctctgctcagtgttaatacagatctaagacattaaatgatattttaagtaaaactggtgaaataaacatcaagtcatagaagtgtgatcaggcacttctagcaaaagtgataaatcatatattaaaatttaaaatgactatagttcatttatttattcattcagctaatattttattacacattgactatacagcaataaaaacaacaacaaaataatctactctttcttctctcccagaacttaaaatttgtttaataatgttacggcaaagaaaacaataagattaaatgatgatgaaaaacttgaaagagcactgatcttggagtcctaagatctgaatcaaaatttcatgtctactaattactaggcaagtgatactggatacatcaactaatttctctaagcctcaaattcacaccgtgaaaaatggggtatgctactacctgtctggtgtatttcatcagttaattataaggatcacagagaaaatattcaaacattccctaaaaactctaaaagttctataatcacaggcttgcattattactgaaatgtatggaaagctatccaatttcttgcaataaataattttagttgatattaacagtatactgagagtctatgtggccagacaggaaagactaatgctaactgtcaagtacattaacaatataaaatgacacatatgctagggttttggcctttctccatttagccattctaatttgacctggatttcctctacatgtcaatttatgctcatattcacaagcaatgttccaatcataggaagagcaaatgagtcagacagacttctatcaaacttccaatctgagcaacaacagccacatgtttctttactcttcaggacatgtatttgtcaatcctgtttgaatcttaacaaataatggaactttcaaaataaagacaaatgcacttagtagaagaaaataacaattactgtaattgcaaccacattaacttgactgagtttttgtttaaattacttctgtacttctatgaaaaacactgttcttaagaataatgaagtgcttaagacatgactgaaaaataaaacctcacaattaaacccatgaggaaaataaatttaacttggcataattctggtttgcaaaaatactgtcaggtaatgaacccaaatccatatgaatcactggtaaacactatgcacaacaaacagttaatacctataggtgctctgtgaaacagtggaatccaaactgtctgtctcttttgggttggagaaatagaataatcctgcttttcctcaaacactggcaaacatatactatgatagctaaaagtcaacttaatccttcctttcctggctcaaaataaaaataaatacgccatctcagacttaagatgtgatatccctttgtgggttttcatgaaagagagagaaacacacaagaaaatgatcatggttggatgggctttgtgtaattttcaatcacataaccttgttttagaaagtagaaatgaagagccaagacaactatggagaaaattctggcagtggctgtactgtgctctgattattttttattagcattggttgtatcacacccaaagcttcttggcattttccatacaaatccactcccaccgagtattctgtattccggaagggcagtaactttatcaaaaggtagagtcacattccagagcatatcatctgtcacctctcaccaactcaccacgccccatgtccacactttctgtcttttctctctcccagctcttctggaataactaacaaatccttccctttgccctcatgcagaagagtttggcacatgccatttttctcaaggtgtgatttttttttttgtcattcaccaacatgtaaaataaattttacagccaataatagcaggtgaaaagggaagcaagatgaaaaaaggacacatgaatgtctcaaaaggaaatagggggctgggtgcagtggctcatgcctgtaatcccagcactttgggaggccgaggcgggtggatcatgaggttaggagttcaagaccagcctgactaacatggtgaaaccctgtctctactaaaaatacaaaaattagccaggcatggtggcgcatgcctgtaatcccagctactcaggcggctgaggcaggagaatcacttgaacccaggaggcagagattgcagtgagctgagattgtgctactgcattccagactaggagacagagagactccatctcaaaaaaaaaaaaaaaaaaaaaggtaaatagggggatagctcccattaaatcactcagcatcctgttattgaattggtcctcctgcaagggaccaaccacaaagtcagtgacttaacttacttattaactcaaaataagtaacttaaaacttcaaaaacttcaaagctgaagcgcaaactttcacagatgaaccactacaaaatcaatgccactatactggggcaagcagcataaattttcagacctcagaaatattgaatggcattgatacgttttcatttcttactcagtcctacctgaacatctgggctaatggcatttcatgtttaagaatagggcactcagcagggcgcggtggctcacgcctgtaatcctggcactttgggaggccgaggcgggcggatcacttgaggtcaggagttcgagaccagcctggccaatatggtgaaaccccatctctaccaaaactacagaaaaaaaaattagctgggcgtggtggcgggcgcctgtaatcccagccactcaagaggctgaggcaggagaattgcttaaacctgggaggcggaggttgcagtgaggtcagattgcaccactgcacttcagcctgggtgacaagagcaaaactccgcctgaaaaacaacaacaacaacaacaacaaacaaaatagggcactcagctacgcttaccaggaaactgagtggagattttcctgtgtgaccggcaagtgattgtgaactaaaagcattggttgccaaacttaaaaacctacctgtgggacattaaaagcctctagcatgtatcacctttggacttacttgtattcctgtgactttggtcccctgggagagaagcatccgtagtccaggctggaacgtgttggtcgggatgtgcagtagacaccacagtgctctggttataaattgtatttgtaagaataacatcggacccttggatttcaccatcagtgaccaaaggttcactcccatttgatttaaaatagaccttttgtaatgttcctgaaagacaaaaacaaacacaaaaaaaacctatctttgaaacattactagaagtgtttattttaaaaaacattaagaaaactctagagctactttccctatgtcattctaaccaggtaaacacaaagacgaagatgaaagccgtaatagtgacctccttcttggggtcaacaaccacaaaaccaagagtttctcttctaccacaaatcacacagccctgtgatgaaacatggctttctcaagagcttacggtttagaaactgggtctcctatcaaggtttcctggtgcttcaaaaatgtagggtaattctacctcacctgagactcaccacacaataaaatgtggtgaatcttacagcattctctttcacttccttagtttcttaatctcaccggtcattgtttgctactcaggacccaggacatgtgctctacctctctctgtatctgtcatcaaaggacacaatggtgcttgccatcagctttatatttcccacattttgcactaatgttcagtaaactatgcatcacacacaaataaaaaataagagggctcatacatttatcaaaacttgtatcataggaaccaaaaaaaaaaaaacctctaaagcacaaactaaaagaagaaactaaattatcttcatcttcgaccagaaaataaaaatgtaattatatgaaataagaaatactcatttaaaaaatttatttccataggttattggggaacaggtggtgtttggtaacgagtaagttccttagtggtgatttgtgagattttggtgcacccatgcaccatgcaaagtttggcacatgccatgagcagtatacactgcacctaacttgtagacttttaccccaactctctttccacactttccccgagtccccaaagttcattgtgtcattcttatgcctttgcatcctcatagcttagctcccacttatgagtgagaacatacgatgtttggttttccatactcattaaactaagattatcaactggccactttctcaaggtatccattcattgacaaaacaaagaaccaaacctaagattattgaaaaccaccttgctttgtctttaggaagaaacatttgaaaactttgaaagagatcgtgtatttttaactcagtcaaaatagacagcagattgtgtttccagaatatcgcactgtacttgagcatgccacgaaaataaatgaatgtgatattgacccatcgatagaaagagccaagggagattttcttttctaaaagcatttacagtgaatgctctaattggctctcacttttctaaatagtcccaaggaccattaaaaataaaagaaacataaataaaatgtttaatatcagtctatggaaacaatttctctacatatgcttgacacttggaaaacattaactacaaataaaaatagaaaagcagctgtttctagctaactgagatcaacagtttcctctgccaaaagattgtaaataaaacattgaagcataaaagctaaatcatgatcatgtaatgcgggtaacatgctctccaaaccatctgtgtgatcatgagtaaaagtcaaatgcagtaggtaaaatgaaggaattcatttaattgttattgattttcaaaatgatttagactttatcctaatcaaaataaatgtgataggtttaattactataggaaatgtatttcacacatacagaataattagtaattaatcaattacctatagttttccttacatccatttgttaattgctctcttccttgcttatttttggcataaagagattttttccataaggtgatatttatgctaatgtggttgtaatgaatatataggcccattaagttgatttacttatcttgctgaatctatgagtaggcatccagttctgtcaacatacttttagcaaatgccaattgttcacggttgtaccctggagtaattcccttaaaattagttccttctcatataaaatatttgaacacttgttcctaactttttggtaataattagccttattaataatctttcctttgtcattttaatatttcctttatcattttaaccaaacagtgtttaaagtgttcataacatctggctgggcacagagactcatgcctgtaatcccagcactttgggaggccgaggcaggtggatcacctgaggtcaggagttctagaccaccctgacccgcgtgaaaccccgtctctactaaaaatacaaaataaaattagctgggcatggtggcgggcacctgtaatctcagctactagggaggctgtggcaggagaattgtttgaacccggcaggcagaggttgcagtgagccgagtttgcaccattgcactccagccagggcaacaagagtgaaattctgtctcaaaaataaataaataaataaataaaaataaagtcttcataacatctgtttatcctaagaagtcctctgaaacattgacatttttaagaaaacactgacttggataacaactttcttttaaaaaggcagcttcattgctcttaagctttatgtattgaaagcaatttggcagaataaaaagaaagataatatttgagaggtactgtagttaatgtttttaaagtatattttgggggaagagaaacagaataaacttaaaggacatgtctttaaaagcctgaactcactggacaacttgttttcaagtatctctggaagctgaccaactcccaacacggttgtctactatgcattttcttttaagcacaagaattagaactcaataaaactaaatgctttcaacctgtatcatgatgagctataaaaatgctaagaggccgggcgcggtggctcacgcctgtaatcccagcactttgggaggctgaggcaggcgcatcatgaggtcaggaaatagagaccgtcctggctaacacagtgaaaccccgtctctactaaaaatacaaaaaaaattagccgggtgtggtggcgggcgcctgtagtcccagctactcgggaggctgaggcaggagaatggcatgaacccgggaggtggaggttgcagtgagctgagatcgcgccactgcactccagcctgggagacagagcgagactccgtctcaaaaaaataataataatactgctaagagatattagcccaaagtagagtatttattcttctaatactgcctcattcttttctacatttctatgtttattgtgctatggttaaaagtacaggtttaaatcccatctctaccacttgccctgaaactttggacaaagtcttaactgccataaaggaaggaaaaataaaatacctcttcatggggctggctgtggtgagacagccaagtaaaaatggctccccggcagaacccccgactggcctgcgcactgggaggagcgtgcactggggtggagcctcaggaggttcacaccgtttgcagaggtgaggagcctggcctctcctgttccggggtggtatttgggactcaacttgtgaggcaggaaactggctagcaggactgtcattttgctgagagtccctgtttcccttttttttccccttttagcccgataaattccagttttctcaccgttcaaagtgtctgtgagcctaatctttcatggctgtgtaacaagagcccagcttttaggtgaactaaggagaaagtcctacaacattgggatcaaatcagtcaatacctatataaacacttcgaatggcttttggcactaagttctccgtaactgttagtcattactacacattgatggtaatgacaataaaattgtcttctttaggactgctaaggtacttttagataaatatcaatttcattttactataagtggatcccagtgtcacaaaatggctaactttcagaagtgaatcacttaacccacatttggagtgagaaaactatggctttttcgtgctaaattattaatagaaagtcacattgtattaagatagtctggctcaaaagtgtttcagctctatagccaaaaaaaatgtaatgatatttaagaaatagtatataattctaataataataatagtcaaactttactgattccttgtaatgaagagattgggcactgtggtagacagaataatgctcccccagagatgccacatcccaattcctagaacctgtgaatattctgctttacatactttacgtggtaaaagggatgttgcagatgtgattgaagtaaaaattttgagatgaagagactatcctggattattcaggtgagcccaatgtaatcacaagggtctttataagcagaagagggagataagagagtatgtgtcagggtcatgaactgtgagaaaaactcaatggaccattgcttgttttgaagatggaaagagccacaagccaaggaatgcaggaagccctagaagctagaaaaagcaagagaatagattgtcccatagagtctgcagaaggaacacctaaattttgcccagtgagacctattttgaacttcttaactctaagataataaatttgtactatctttttaagctaccaagtttgtggtaatttgttacaggagcaataaaaaattaatacaagcaccttgctaagttccctcactataggcatcaactgagttaaccttccaataatcctataaaacagataatataattaatcgtttgacagagttttagagagatggaaactgaagtttatgagagtgaattagcttgctcaagatttgagttgggacatggcaaatagacatatacatatacacacacttttcattctggacaaaacatacaggttttaaaagtcaaccattatgtgcttgcagaatttatcttcctataatgtgattttaaaattaatttcttagctttgtatctttagccatgtgaaacacatttactttgcattttctatgtgccaagaacttcatacttactctgctgagaacacaatatttagtaagaggtccttactatcaagatgtttatagattagttgagggagacgggcaggcaatctaaaaaatattaatataaactatggtacaagtgctttgagaatgatatgcctaggacaatctggtagcaaaaagtagagagatagtcctcattccatttgaaaaagtcaggaaagcctgtttagagacgagtatcctaaatgtgaatcttaaaagatgattagggattttctaggtttaagcaaagtatttgtggggaggagagtggcgtggcaagaggaagtgaaacattttctagataaagccaagggaaaaacatatgaaaaggcccagcagcaagtaatttaaaaacatggctagtacacaggagcctggtaagagaaaagactgaaaagggaagagacaccagacaggataggtcttgtacaaggcttggaatttaccttgtgatagaaaattttagaaaggtcttaaatagggtgaaacatattagaatgatcactttggcagcagggtgacgtttaaaagtttagagggtagttagaaggctattgtaatactccaagtgagaaaagagtaaggccttagccaacgcaaaaaccctatggacaaagggaacattaggagaaagctccaaagatgcaaaatcatatgaacatgagagaaaggtcccttcgaggtctctggtttgaataatgtagtaaacaaacatatccccaactgaattggtgtcatatcgttagtgttgttcatcaaatatttccagttctctctccttctactggggcataagctgagcattgcattctctggcctcttgagtgaggccttgcttcaagttcaaggctataagcaaaactaaaaagtgttgcttctaggcagaagcatttaattgctgatgtaagagccttcagagctctgacacaatcatcacaaaggctcaagatggtggctagttcatcaatttggaccctgaaggacctcgatgagcacaggccccctgccatcttgcaaaggacatgtagtattgtaataaattaactattgttgtttgtaaatcaccagtattgggggatttgctgttgttacatgacagagtctagccaatcttgactaaaacaatagataacagagaatgaaaaatagatttgtagaagcctgttgttgttgttgttgttgttgttacactttattgaatataaagggcctgtgaaacattcaggggggaaaaagcccaaatctgaagcaatctgatgatttcctccagatgcctcaccagactcccccacaatgctgtccctcctttgtgttcccagagcacgcactggttatattgtagcacatatgcactcaagtggaactgtctgtcccatgcatctatacatcaatccccgagcagaacacctagcaccagtgtagggctccataaatattcgttgaacgtatgaatgatgaatggactaatggaaatggctgatattgccaagaggggtatcagtgtaaagtgagaagacagctgaggacagacagctctttttaatgccatttaatggacagttaaagaaaggttagcttaaggaaaatgagaaacagcaggcagagatactgaaggataatcagaggtgacaatatgaaggcatagttgaagagcataatgagatgaaagtagtactcaacactgaggaagatcatatgcgcatagcacatctggggagaagaaagcattgctggcaccaactaacaatgaacattcttaccatgaattgatgtacacagacacagagagaaacataggttcttcatttcaaagtctcgttcaaatacacattggtttccaatgcagcacattggataaaaagacactggtgggcttgctaagtacagatataggagtatgaaaagaagtgaaagagatgatcagaaggggactgatagaggtataggaatcatctggggtggttcttgttagaattcaaattcagcaggtttggagtggggactgagattctggattctgcattttacacaaacttccaagtgatgctgatgctgctcgtccatgggccacacttgagaacaaggctttagactaccatttcaaaaagctttagacataacatataacctcgggcctcagtagttaaagaaaaaaaattgtcatgcttgagaatcctccgctggtgaatctgcaacagaaagccagatttattcaaagaatttgaagtcttaagtaatgtggagtcaggtcatgaaagatcatagagaatcttaaattttgggtgtgaagaaacaagaatttgggaggttttctatttttaagtgatactaagaatacattataagttaggaagttaagattcttttaactccaaattcttgtaaaagccacaaactgctgagaaatttgctaagagaaaactgtatttaaattcaatgatctccagttcatctagcatttttgaggagaaaggtcatttctgaagagaaatatttttatcgaattcaagaaaaatgaatggtttattaaactttctatagtctacataccactataatttttcttttttcctcatttactcaaaaaattaagaagccacacatacattttccatcatattaagaaaactagaaatgtaattttaagctagttttcataagcttatggctaaaataaatttgttttagatatatatggatgagtgaataagcagatgaatatttaaaaccaagtcttcgacaggctgagaaagaaaaagtcaggagaattctaatgagaatttttggaacataacttgggtgaataaattgagatgaagaatagtttgaaaaaactaattcagaccataccccatacatttataggactccctgccacatactcagctgtaaccctttctccatacagctgccaatgacaccttttaaagctgaaacgctttctccatacagctgccaatgacaccttttaaaagtcccaaccaagataatcatttccaagaccttgaaagagcttttttttccgatgttttcttctaggagttttatggtttccagttttatgttttagtctttaatccattttgacttgattttggtatgatggtataagataagggtcccatttcatccttttggatgtggatatgcaattttcctaacaccatttgtcaaagagagtattctttccccctcgtgtactcttcacacctttgttgaagatccaatgaccatatacatgtggatttatttctgggctctatattctgttccattggtctatatgtctgtttctattctagtgctatactgctttgattgctgtagcctcataatatagtttgaaatcagcacatttgatgcctctatctttgtcgtttctgctcaaaatcgctttgggtatttgggatcttttgtggctccaaatgaattttaggattgttttatctgaaaaatgccactgggatttagctagggactgcattgaatctatagatcactctgggtagtatggacattttaacaatattaattcctccagtcaatgaatattaaatgtcttttcatttatttgtgtctgatttaatttcttttatcagcattttatagttttcagtgtaaaaatatttcccttccttagttatgtttattcccaagtacttattcttgttaatcctattaacaaggatttcttagacatgacataaaaagcactggcaacaaagaaaaaaaaaagaccagcagtgttacatcaaactgaaaactttgcacagcaaaacaatcaacagaggttgagtggacctaaaaaatgagagaaattatttgtaaaccacatatttgatcaagagttaatattcaaaatatgtaaaaataagaaactcacaaatcaatagcaaaaaaaaaggtaacctgatttttttaacaggcaacggatctgaatagacatttctccaaagaagacacatacgcagagccagtagccagtaagtatatgagatggtgctcaaatcactagtcattagcgaaatgcaaatcaaaatgataaagagatgtcacatcatggttgttatgatggctattaccaaaaacaaaagataacagatgttggtgataatgtgaagaaattgaaacccttgtacactgttagtaggaatgtaaattgatgcagccactatggaaaacagaatggaaggtccttcaaaaaaattaaaaatagaactatcgcatgatccagcaatcccacttctgggtatacatccaaaaaattgaaatcaggatctcctatctgcactcccatgttccgtgcagcattattcacaatagccaagacatggaagcagcctaaatgtccactgatagatgaataaattttaaaaatgtggcatacacacaatggtatatcatttggccttaaaaaagaagaaaatcttatcacttgtggcaacatggatgaacctgggggccattatgctaaggacaaatactacatgatcacactcatatgagaaatctaaaatagattcatagaagcagaaagcagaatggcgattgccagaggggaagaggaaataaggcgatatccaagggtataaagtttcagtaatataagataaataagttctagagatgactatacaacatagtgactatggttaatacttctttgggtacttaaacatttgttaaaagggcagatcttatgcaaaatgttcttatcatggaaaaaaataataaagatgtgaggaaacttttggaggtgatggatatgtttattgcagaaattgtggtgatgatttcacaggtatatacttgtttccaaactcatcaagttgtgatacattaaatatgtgcagctttttgtatgccaatcatacctcattaaaagggcttaatgaatgaataaataaacaaataaataaataaatgctacaaccagaccctgtcactctcttatatcaacatccttattgtggatttcatgtttaaagtactacttactccctagggaatcttccctcatctcagcccagtttctgtccctgtcgtaagttctcttagcaccttgtctcttcccacatagcagtaaactctgttgtaattacttaatgaagtgatcatttgtttcatgccttcttccctcactgtggagtccctgagggtaggctttattcactgctgtccccaatacctatagcacactgtgttgcatataacagacactcaatacatatttgttaaaggggtgaatagtattacattatagctaattttgtttcttttaaatgtttctcaacatatcaaaataattttactttaaatgttgcatgatgatgtatatttataatatataatataatatataattataatacataatattgtgaatttataatatagtaaataattatatatgtatatgtaaaatttgaggaaggtatcagttcaatctcaaagtactctatggcataaagtgacacttgttgtcacatgaaggcagcacaaaccattgcaggtttagttcttataagaaagaaattagtctctgaaagtaaatctcaggcctaagaataaaaggcctgtcaaacttgccatcacgttacaaatccaactgttggtcaactttatttcttcctagctacttttaggcaattcaaatatcttgcagcaacagcctgattctagggctatggggttatggatcatggggttactatgacaacaggtcatagcacaaaggttttaattcttatggacagagttaatgtgagacaaaatgcatgtttagttaattgttacttgggtataatatgactatttattaaaataattatctgatgataattattcataatcaaataaaacaaattctttactactataatgaacttatcacttataaaaacactttcacaaacatttcatttgacttccataacaattctgtgatacaaaaaagaattatctcatgtagaaaataaagcatcttacctaaactcccatgtctagtaaatggaagagtaaaaccctaaagccagactttctagtgccaagttgcatgctctttcttctttgtcatatggaccatcagtatcagactataactaatgaaataaaaatctacatataatttaactttcttatttttcaatttctctttgaagaacctgagtccttgttttagagtccaaatctttggaaccatatggacaactcagactatctgccgagttgagaaatacaaaactaaacaacctttgtagctctagcttcagtttagtggttgggttgaaaaacaatttactactgctttcttctatagcctgctgctaatacaattatttgacaacccacctctcgtatcttcagaaatcgttttaccatcttgactttttgcatgagggaaaccacaacagacaaaattagagacacgtagtacatctgtgtttgttagcataaggcttttatcttttctaatcaataatcttctcattattatctccttggcttttgaagctagagctcctgttatttatacaccactgatatctcagcatcccttagcaaccctaatgtacacagaaataactacaaaactttgtatgagcacaaagttataaactcaaaccaaacagagcattttttaaagtaagcaatttaatgaggtttttaaaacaaagatataaaatgcttgtattgctcattacaacaacaaacatctcagttacaaaataaggaatatttatttggacagatattacttcaatatggctatattaaatcatctggtacagaatttattaaaagaatgtttttaatttttttctcttttttataaatttcaacttttattttggattcaggtacatgtgcaagttgtaacatgtgtatattatgtgatgctgaggattgggatacaaatgatcccatcacccaagtaatgagcatagtagccaacagtttttcaacccttgccctcctccatagtccccagttgtctattgttcccatctttatgaccatgagactctagtagtagactctagtagtccccagtgtctattgttcccatctttatgaccatgagcactcaatgtttagctccttcttataagtgagaacatgtggtatttggttctctgttcctgtgataatttgcttaagctaatggcctcccgctacatccattttgctgcaaaggacatgatttcattcttttttatggctgcatagtatcccatggggtgtgtgtgtgtgtgtgtgtgtgtgtgtgtgtgtgtgtgtatgtctcccatgttttctttatccaatctaccactgatggacacctaggctgaatccgtgtctttgttattgtgaatagtgctgccatgaatatatgagtgtgtgtgtctttttggtggaatgatttattttcttttggctatatccccagtgatgagactgctgggtcaaatggtagttccatttgaagttctttgagaaatctcaaaagttttttccacagtgactgaagtaatttacatttccaccaacagcataccttttctcaacagcatctgttgttttttgactttttcgtaatagccattctgattggtgtgagatggtatctcactgtggttttgatttgtatctctctgatgattagtgatgttgagcattttttcatatgtttgttggacacttgtatgtttattttgagaagcatctgttcatgtattttgcccactttataatgaggttatttgttttctgcatcttgaattgttaaaagaatgattttgaagatgcgtgggaaaacccccacttcctaaagtttgcctacatataaacaaaatagcatataggagcagttacataagtgacacaaaattccactcttggtatatacccaagagaagtgaaaatgtatgtccccacaaaaacatacacacaaatattcataacaggattatagataatagccaaaaggtggaaataacccaaatgtctatcaattgacaaatggataaactatggtatatccatacaatgaaatattgttcagccattaaaaggaatgaagtattaatatgtgctacaatgtgagtaaaccttaaaaacatatgctaagggaaagaagccagtcacaaaataccacatatggtcatacagaatgtctagaataggtacatctacagtgaaagaaaatagattagtggctgcttggggctaggggtgaggagatggggagagattgcgtggtagctaaagggtacagagttttgttttgagatgacaaaaatgtcctaaaacagactgcagtgatggttacattatctatgaatatactaaaaactactgaattgtagactttaaatggttggattgaatggtatattatattaataagaataaattattaattaactaataattaattaattaaattaataagaataacccacttaaagcaaagcattcctcctttgccctctcctcagaggcctctaagcacagacgtacttaaatgtacttacattttatattagcattagaccctgagaatgaaaggaagtgttcctcaaagcatgtgagccaatgaacatagtctcatgacagactttttaaaatgacagtggtatagctgaggaagctcctaccagacagatctgtccagggataataactataaactctggacaaaacacaaaaagacaactactgaagggcgctggagagggaggagaagcaggccaggtctggaagggtgttgactcttaagaagagagtggcagagacgagtttcaggacggtttactgtcttagcctgagagcaggccacagttgacaccacagagcaagaagcgactaaatctcccacagaaaaccctcagtcttcctgggctggggcactcgttctgtcttcctcttacttggtcaccctctgacctctggcatctgtgaaagccagcatttctgggttcctttccttctctgactattcttcctgtatctctttttccctcctgtttgtcttccccttaaacactagcatcctccagagcattgccctcagcttctgcttaatgcattttctcttcagagttcatcgactcctgctgcttcaactgccactgagactgccgcatgcatggcagacctcccttctcaacctccctcctggatcccctagcttcagtcctatgccaatgacttggaagttaaattttaaagtcagtgctgctctgtcacagaagccaaacatcatatttggtcacaatttctcttgaaactccttaggaaagcaacatgttggatttctcatttttctccatttcttgacctgctttcactgttgaattcaactatgattccattgtatttggttgtcccataagtatctctaatacacaaatcaaccttccaatctttatttcatctgcctgtatcagactcctgcacctttacttcctatgttaacaggtagtatcaaaactaacctggttagatacaggaggcagagcaagaggcctgatagaagtctatagcattggtcccccaccccaaaggaacagcaaattttaacaattaactacacacaaaaggcactaatacaagaatcaaaaatcaggtgagcaatcacaatacctggttttaacttcatatcactgaagaagacagtaaagagggcaagaaagatagtcttgaatgctgacaccatcctctcccatcccccagcagtagccatgcagcttggagaatgtgggcacttgggagagggagagtgcagcaattatgaggctttgcattgagctcagtgctgccctgtcacagcagaaagcagagggaacatttggacaggcccaggccaaagggtaattgcccatcccagtggtgagagcttgagttccagcgagcctcaccactgcaggctggaatgctctgggactttaaatgaacttgagggacagcctaggccacaaggactgcaattcctaggcaagccctagtgctgagctgggttcagagccggtggactgggagacacatgacctactgagacacaagctaggtggctaagggagtgcttgtgccacctctccttcatcctccagcagtgggtgtgtggcatggagaaatcggtgtgcttggtaaagggagagcacagcaactgggggactttacattgaactcagtgctgatctgtcacagcagagacctggcaggagtcagcacttgctgaccaaagagccccatggccctgaatacccaacagcaatacccagagccttgggctctgagatgtgctggcttcagatgtgacctcgcacattcctagctgtggtggctatggtgaaagactctttctattaaaagcaggggaaaaaagtaaaggggactctctctggcacctgaggtgactgcttggcctcggtggggtagggcaccaaccaggctcttagggtccctgagtctaggcctaggctcttggttagcatttctggacctgccctgggccagagaggagtccactgtcctgaagagtgagtcccaggcctggaagcatgcatcattaaccaactgaagggcctttgggctctaagtgaacatcagtggtggcctggcaaaagcccccatgggttggtggttgtggtggccacagggagagactccttggccaatggaaatgggagggaagagtgggaaggactttgtcttgtggttcgagtaccagcttagctgcagtagaatagaacaccagctaaagttctaaggttttttacttcaatccgtggctccaagacagcatctctggacccacctgaggcctgggggagctcactgccctgaagagagggacacaaacctggctggctttgccacctgctgattgtagactctaaagctttgagtgaacttaggtggtagccaagtagtggttatagcaggccttgggtaagactcagtgttgtgctggcttcaagtctcaactagcacagtcccagtggtagtggccatggggatgttgtgttcctgccccagttccagaaggctcagcacagggagagagagagactctgtttgtttgggagaaagtaaggaaaaagaacgagagtctcggcctggcaattcagagaattcttccagactttaaccaggaccaccaaggcagtacctttctctagaagtcttcaagaattgcagcattatagggtcgcaggcccaagtcccttagaagacctgaaacaccttcccaagaaaaatggacacaaatgggcccagactttaaattaatgtaactgaagtagtgaaagatctttataatgaaaactaaaaactgatgaaaaaaactgaagaggacaccaaaaaatggcaagatatttgatgttcatggattggaagaatcaatattgttaacatttccatagtactcaaagcaatctgcagattccatgcaatccctatccaaataccaaagacattcttcatagaaatagaaaaaacaattctaaaatttatatggaaccacaaaagacccagtatagcccaagctatcctatgcaaaaagaatgaaactggaagaatcacattacctgacttcaaataatactacagagctatagtaaacaaaacagcatgatactggcatacaaacagacacacagactgatggaacagaatagagaacccagaaacaaattcacacacctacatagacctcattttcaataaagatgccaagaacatacattgcggaaagaacagtctcttcaataaattgtgcttaaaaaactggatatccacatgcagaagaataaaactagactgctatctctcgctatattcaaaaatcaaatcaaaatggattaaagacttaaatataagacttcaaactatgaaaatgctaaaagaaaacattggggaaactttaggacattggtctgagcaaaaatttcttgagtcataccacacaagcacaggcaaccaaagcaaaaatgaacagctgggatcccatcaagttacaaagctcctgcacagcaaaggaaacagtcaacaaagtgaagagacaacccacagaatgagagaaaatattttcaaactacccatctgacaagagattcataatcagaatttataaggagctcaaacaactttcttttaaaaaatcgaataatcccacttaaaaatgggcaaaagatttgaatagacatttttcaaaataaggcatacaaatggcaaataagcatatgaaaaggggctcaacatcactgaccatcagagaaatgcaaatcaaaactacaatgagatattacctcaccccagctaaaatggtttatatccaaaagacaggcaataacaaatgctggtaaggatatggagaaaagggaagcattgtacactgttgatgggaatgtaaattagtacaaccactataaagaacagtttggacattcctcaaaaaaactaaaattgagctatcatataatccagcaatcccactgctgggtatatgcccaaaagaaaggaaatctgtacatcaaatagatatctgcatttccatgtttgttgcagcactgatcacactcgtcaatatttggaagcaacctaaatgtccatcaacagatgattggataaagaaaatatggtgcatatatacaatggagtactatgcagccataaaaaggattagatactgtcattttgcaacaaaatgaatggaactggaggttattatgttaaatgaaataagtcagacatagaaagacaaacttcacatgttctcacttattttaggggctaaaaatcaaaacaattgaactcatggagacagagaatagatggatggttatcagaggctgaggctgggaaggatggtggggggtggggagggggggggttgttaatgggtacaaaaattatgtatagttagaaagaatgaataagatattatttgattgcacaacaggatgactatagtaaatagaagtttaattgtacatttaaaaataatagagtataattggattataaaaatataagatttttgggaggccgagacgggtggatcacgcggtcaggagatcgagaccatcctgactaacacagtgaaaccctgtttctactaaaaatacaaaagaatagccgggcgtggtggcgggcgcctgtagtcccagctacttggtaggctgaggcaggagaatggcgtgaacccaggaggcagagcttgcagtgagccgagatcgcgccactgcactccagcctgggcaacacagcgagactccatctcaaaaaaaaaaaaaaataataataataataataataatagagtataattggattataaaaaaaatagagtataattggattattgtgacaaagtataaatgcttgaggggatggaaagcccatttttcatgatgtggttattgcttattacatgcctgtaggaaagtatgtaacatacctcataaatatatacacccactatgtacccacaaacattttttttaaaaaacctggttacccaagccagaaatccaggagtcagccttgactcctctctccctcacaccaaaatccaatcagtcttgatttctgttgattttaatgcatccaatgccttatttcaaacactcatcaccttttacttagaccagagtcagagccccgaactggtctccctctgccttcatttctttctgcctccagtactctgtagtgtatccagttctaccgccttttgcaaatgtaaaataatcagagttctcctttcttggaaagatcctccagtggtaatccaccacccatagcagtgttttgtaatcatttttatagcagatcaatgttattttcaaataaatatcataaaaagcctaatatctattaatagatatgagctgaattttattgtggttaacttactttataagatctaagtgtgtaacttctataaaccagtaagaaaataatagggaggtttggcaaaacttaaaaattcaaaatcattggcaatgcaattagatcagcatcgtcttgatatttatttctctgttttatttgattgcacatattttttgaaatcctgattcatatcattaggtagccaccagtgataatagtttattgctttttccaaaaagttcacttttcaaactttaagtatcattcacttagaaaaagatagcaagatgcaactaatgagctaactaatgagttaacctgtcagcacatattacttggtttctggtttttacttggttaaaaatgtggtatgtaatatttagtttgagtgtgtttttaagatttttttttttaatgaaagtcaaagcaaacatttgtgcaatccttaagtctcctccttagaaccttgttaccatggaatagagtttgaaaaccagtgatctaaaagctaaagcccaaattccttagtatttagtatgaaaatgtaagatgctgtttaatttggactttattgatctagctgcatttcccaccactgccaaattttcacccagttttctaaatctatgttcatctttcaaggggttatagttttgcagtagttattttctctgccaaatgtgactcctgaactactgtcttctaacctaaatttctattaacttaattccgaagttaacacattaactctccatgatgctttctttgaatgtgcccatgggaccttgtctatacacttctatcttaaacacgtgttgccttgtgtgataatcatcacttcctctcaactgtgagctcctaagaaaggactaatttaaccatcctggagttctcaggaactttcaaaatgcctgcaacctagtaatcattccttaaatgttttaaattcataaactcattcattaatattaataataataaccagtagagtggttacagtagctgaaactgcagatttgcataacgtcatcaaaagataatcctctcattgactgacactttgggttaaataagtactaagtagaaatcactcttctagatcatgctaattttcactttaacttcatttttatttaataatggcctcacccaccaacataggaaagcaggatcaccagcaagagaacgagagcacagatacatggaatcaggaccagcaataggaaccggaggaggttagcagtcgccagcttctgagagcagccattgcccatgttattgtcatcagctctcaagacctaaagtaaaagaggaaaatgcaacatggttttagttttacaatacatggtatgaaattttaggttacagctatccatttagaacagcacattccaaaaagattttacagtttgtggtttagggtatgaaatgagcttagtcaacaaatcatgccaataaaggaacagataactgtacatctacattcagggaagagcaaactatctatttctgaaacatttttcggaagtacataggcttttaacaatatcccattttgcttttttaaaacatatttgtcaatttggtatgattccaaagggctatgaatgaccatggcaaaaccttaccctggcccaaagctatgacagaagtgaaggctgcctaatacagtgataaaaaattggtaagtaggtgtagacagaatattatccagacttcattcttttttgtctcattagtctaaaccaaatgtgaatgaatctggataaaataagtttttggccattaataattcagccaggctcactgttactgaccatgcatttagtgacaagttgaaatataaggaggagcctgcctgattgccaattaaacgctaacaactctgaggacatcctcggctgcccatgctacccctgcagcccatcctgtgtgagaggatgtcaaagtgcaacaacgacggttcagataaagttcttgtcttcaaatgcttcaaattttgcttagttcaatctcttgccagaaatgatatctggaaattcatttattacagatggctagcttaaagcagtgacttcaaaaaaacatctgagatggtactaaaagggctttgaataactacaagaaactctccgagtctccttaatgaaggcatttctcatgattctctcttggacttctgactgcattttctcctctgacagtttcagaacttgaactataacctcagtgtaactacctcctgaatctctcttgcatcctgtactcctttcagagttacactacatatttccaatgcctggtgggtagcagcgtctctttttaacaagtccaaaattaagacgaaccttctctctctctatcttcaaactagttcttctcctgactttcatatttatgtttacagaaattcctccattccaatatggggagtggagtccaaagactccccatttcatcatccccctatgccgtacatcaccaggttttgttggttcttcctcttaataaataccaaactttttttaaaaaaatgaatgacctttgagaaagagccttataataatcaagaagttgttctaacacaatggccctgtaatattctcaggacttcctgacgagtatttgattatttcccgtggatgcaaaggcaattttgaagggttcttctgaattgcaaggcatatgtgattcccatttctgctttattctctctataagggaatataggttcactaacccatattgcaagcagtgttcactacataatatgatgacaccttctgtaattttaagaattctccatgagagacattatttgaagtaacttgtgttgttaacttgagaagaacttcatttcctaggttaatgtcttactgatccattgtacctggattaagctaccagccaatgtgttataatttatagttaatttacaactgatcttcaagaagacaattgatcttcaagaagataagtgtacaacacttacctacaaaaaaatcaatcaataaataaaagtgtgggactacaggccaacaaagttagtggcagaaacaagttgatacttgtttattttacttagttattgaatacctactaattataataatagtgatggatacgacaatgacttcaaaccactgtctctcaaaagctcacagtcttgtaggagagatgaaatgtacatgactatattgcaaggtagcaaatgataagcaccatgacacttatagctaaagtgatataagaattcaaaagatagaaatacgatttcttgctggaagatcacgtaagacattgtagagagagcaaccctgaatcagccataattctgagaaaagtacccctgaacaagtctgttacgagttaaaaaaagttgcaaagtatttaacttctacaacagtgaagaagcttccttgctaaggtgatcacagaagcattataggaataaccttggctcattgccatctggactcctggagccagatacatctcatttagcatttataagtaaagagtcagtggagaaaatgctagaggcccattttaatatgtcatctaagtagatatcaagtactggacctccaaaaacaatattcatgattagaccaaatattttcttcagtgacaagagaattgattgcttttttttttttttttttttttttttgagatagagtctcgttctgttgcccaggctggagtgcagtggcacaatcttggctcactgcaacctccgccttccaggttcatgcgattctcctacctcagcctcctgaatagctgagattataggcacacaccaccactcccggctaattttttgtgcatttttaatagagacagagtttcactatgttggccagactggtctcgaactcctgaccccgtgatccacccgcctcggcctcctaaagtgctgggatcacaggtgtaagccaccacgcccagccagagaattgattgcttttttcaaagggagaggaggaagaaataggtaggagaaattcaatacttcaacactttcttcttgaataacttgcataactttcctcttgcactcatggccacttaggactgttgcaaatgctacattatgcacaggcccttggaggttcctctgaacacaaggcaactctcagacttcactgttgagtaaatgccaggtgaaataaacaaccagaatcatccttaagctttgtttcaatggactctaaacaatcctcccttcaaatggcatccctcttccacaagcaccttcctcagccttgaaactaagctgagcacaggcacagcattccatggcaagggtagggaacgatgcatctgattggacctgcacatatttgtaaagcatgtcattcttttgtgttttgtttgttgttgtttttatttttggttttggttttgggcttttgtttgtttgtttgtttttggtgttttgttttgttttgagacagggtctcactctgtcgcccaggctggagtgcagtggcatgatctcggctcattgcaacctctgcctcctgggctcaagtgattctcctgcctcagtcttctgagtgactgggacaacaggtatgcaccaaacatcacgcccagctaatttttttgtagagacaggatttcaccatggtgctctggctgatctcaaacttctgggctcaagtgatccacccacctcaagcttccaaatgttcttatgttttactaatcttgttactgaaaatgtgtttcttctatcttaagaactacatttattttaaaaactgtcatgttgttttatataatgtacactggcacagtgtaccattgtaccacaagtgtatgctatcttggtatcatttgagaggtcaaaatttcagatagccagttcctccttcttgaagcactttcttcctttggcttctctttctcctacctctctggtcattccttctctttctgtaggctcaattctcacattcactcgctccccaggcaatgtcacccacacatttaacttcaattagcagccctccataggtgactcgcatctttaaataacaaccatagatctttcctctgatctccagaggaagattgcattatatgcaactgaccacttgacatctcctcattggaggttgtaaaagtagctcaaactcaacaagtctggaaccaaataaacaattttcatccccatatctggtattcttccagggtttgtgatctcaaaaaaggtaattgcacaactatcatgtgtcaggcattgtttgggcacttgggatatattaatatgcaaaacgaaactctctagtctcatagatgctacattatagtaaaaataaacatatctctcctgaaatactgcaaatacctcctcctatctggtttacctatatttatccatgcactccctaacctgttctccacactatagccagagtaagaaagaggctgtattatctttgcatgatgagaaaaaacaacgtgaaaaatgaccccaaagctgaactaattcaagaatgcagagcctggaaccagagctgatcatgagaaccatgcacccagaggttctggggagggctttggatttacattagggtgtacgaggttttgagtccattttatcaagtttgcaaaggtcaaggagattatagttgacatttcaagtacataagtctttaccctcttttaccttcaggcagcatttgactttgtcaacacatggtgcattcctgagggcacatccacatctgcgaatggcagacaatatttgagagcttgtttggaggttctagctggggggtgcacctacttgaatacccctgaccaaaggtgagtcctcatctatcagggatggttgtcctttcaaatattcctgcctcctaaagtgctgagatcacaggcttgagccaccgcgcccagccgaggattattttctaattggttggattaccttttgggataaattttacatcttaaatatatagaacagggatcagaaaactagtctatggaccaaactcagcacacctagtatttttgtacatacagttttattggatacagccatgttcatttgtttatattctgtctatactgctctgctgctactacaacaacattgagtagttgcaacagagatcatatggtactcaaagcctaaaatctttactatctgatactttatagaaaaagtatgtgagcccctgatgtagtgtatcagtgtatatctgcatatatgtgtatttttaaatttgcatgtttaatttgataatcaaactaaaatataaattcttttaagaaaattgtattttaatctcttcatcagggcttttaatgaaatatgatataattgtacagggggtaaattagcagacaaaactatttgttgctgtagtgcaaagttactccagaaaaggttgaaagataaaaataatcttcaaagtagaaaaaaaattatcaacactatatatgtggctgggcacaatggctcatacctataacaccagcactttgggaggctgaggcaggaggattatttgagcccaggagttcaaggtcaaactggacaatatagtgagacctcattctctacaaaaagaaaaaaaattaatgttagccaagcatggtggttgttgcctgtagtcccagctacttaggaagctgaggtgggaggactgcttgaacccatgagactgaggttgcagtgagccaagatcgtaccactgcactgcagcctgggagacagaacgagaccctgggtccaataaataaataaataaatactatatgcactacattaggagaaaggaaagcactagtttcagaaacattcaagctgaaagagtaccacaacatgcatcatagactataggaaccaacaaatactcataagattttagagctagaaagtacaaatttattcctgcttctttaaaaacacaatcatagcagaagtcataccaattcagtctatttcttgctatatatgcaaatattgcccttttctcatcagtgaatgctctgtatctagaacagtacctgaacacggtcaggagttagtggataaacacttactgaataaatgaattaattaaatttcctaaataaaaattactttgtacataattatgcaaataactacttcttacagagtctattcctaaatcatccaaaaatccttcaagtagaaaatgtatttggcaagaagtaaaaatataaataataaccacaattgcatactaatatgatgtgtacacctgttgactaccgcacaactccttacaccttggaatcagatcagacaccaccacccctcattgcctgctccacatggattctttcatagcacaacttttgcatagcaaccgccaagaacccagctttgtggagacaggacaatatcaaaaggaatatagcacaatctaatgttgaaactgtgagctacctcaagctagtatttcatgtgatgaccaataaatgtcaagtatcgctgcatttgcctcaaaaactaaaaatatccagcaaagtcccttgagtcactgcagcaacctggaatacaacagcacacagtttggaaaccatagtccaagtccttgcttatttatttctcccaatacctaatttaaaaacaaacaaaacaaaacctatcccttgaccattccaaggttttgccaaacatatgctgtctttagctctgaaagcaataatatgcactcagagaaattgtctacaaagagattaacatcagcctgctatttcttaaggtacagcatcagacatagagatatgttgatatttttattttaaacaagatttgtttaattgccatcaaagatcaggcaaacttgaggcagaatttaaactgtttctgataagcagaatattttgaaatgtgaagattaattctgtctgcctaatgtgacattataccatggattttattaaataccaaaattattcttaccaaaattaaataccaaaatgttcttaaataaactatgtagacttagttaatacatgatggttagtcaacacagtctgtgaactttatttagatgtacaaacagtacttgctagaggttatcctaattcatatgccaatctggtggatttagctaaaattctatttattgtttgaagtttctgatattaccaagccaaaatgtcaaactgttctcaaaccaaaatgagaatgttcattttaatagatgggattgtatgcaaaattatggcagaattcaatgaccatttgtcttatcacaaaatatttgcttacaatgttaaaaacaaacaactaaaaagaaaaaaatcatccaaaatcaacactatgtattggcttgagacaaatttagtaccttaattctttaggtaggaagatgataaactgcaaatatactcttccatttcagcaaagcaaggaccagcctcaaggataataaagtgactcctactggtgtgtcctaaacaggacacagaagctccctctaaacactgtgggggcattacagtgtcacatattaatatactcacgaatctaaagaaatgcagacactgagactctacttgcggctagatattcaacttggaactttgtcctgcacaatcattatgccaaaatgtgatttgtgttcttttttcagtcatagagatggagtttttccaacccatctccactctgtccgtagagcaaaaattagtcaattgttaccccctcatttaagatgaaaaatggacagtgctagatgcttcccactctgttcttaagaaattatgaaagtgaccttcacatgaattaaaagtagatttgttgagtaacagattaataatgtggatagttctcaagccaggcatctgcaattctctgcaataatagctctcactcaaccaacaagcaaaatgcctccaaaatcatcatgtcttttggtgtgatgtttgtttttaatatcccaggaagcataaagaacacgcatctggttttcagtaagtcttttcatcccattttctggcatgtagttgaagcatatgaagtttaaataactcatgcagtctctcaaaatgaaattactcagttcataccagaacacatggtactgcaagccaactctgcccacattttccctttgaaagttaacaaaataacagcaccagatagtcctctcccaaatttcagaatcacatatcccagaatgtagattcaatatggagactaaataccaacaaaatatgtatcctatcaaggagactagataataataacccagtacgcaggcaccatataacattagtgtttctgttttgaggatacattgtttagctgaagtctgaactgtgagagacgagattggaatgtttcaaaggcaacttgtacaatactttctcagccactgaaaatctacgtaaccttataaagtcatcttccattcttaaccgtatctccgtatctgcaaataaggcataaaaaggtctttctccaaccacaaataccccaaaagtaaagtgaaattagtaaagcaaaagaaaaatgaaaaaaaaatgtttctttcaagttcagaaagctcaagagtcctgatttttttttaacacatagttcagagcttgctcaatttagtttccctggaggaaagttattatctttatttaaatgaggagatatcttcagaggcaacaggagaatagtttagccttttaggtaaatcctattttcttcagagcactgtaggagggtcatatttctgtaatagttatagaagatgattttgggaagaaacagtaggctctcattatccagacaagatagataaataggatcctgtgtcctttttggagatgactttgccctcaatctcaaacttgccaatactatcattttatgaaagacacaaagtttaaagtaataaagtttccttttaggtatatacaatatcagaactctttctgcatatattggagagtcttaaaggtcagtttttcagcctatattttttaaaacaatagagaatacggggggaaagagagttgggttatccatttcttgggaaattaaatatttgatatttattgataaaaatgttctaaatttcacatcttgattattcgttactacatctctaagaaagctatggcaaaatccaaaggagtcaaacagttaacataaagccaaacccacatttcatttagcgctaaggaggctcctgaatttgtgcaaatcttagaaacttaattgactcactaatcctataacaatggaaatgttgtgacttttaaaaattgaaacagattgtcaaagtgagtagcgaattaaaagattgactttctacagctgaaaataatcagggaaagcatagaagacaaagtggattttatgctctacaacaattcatttcaggcatttcaatgcaaagtaaaacataaacagatgttgaaaacaattaacctactgaacctacctgctgaaaaggaatcctgcagtgaaaaaatacaagtaatgatgttatgcattagatgaagcagcaatttctttctgaatacctaaagcaaaagatgaattccaaacttaacattcatcatatgttttgctatagttccatgaatattctagttgaaaaatgagaaattctgtgttgaggtttccattacaaaacacgtctatgtgacatgttaaaatcccagtaatttggtttattccacaaatgcttatgtaacatctattctgtgttatagggctataaagatgaagaaaacatagtccctgtcctcaaggagttaacagcctacctccaagaagatatacagcttcacaggtgacttcaataccctatgactagggtaatgcagacatgtaaaaagtacaacaacaaatcaaccataggtgcagtgtgaacttttgcactgaaacaacagtatttcttgagcgtttattccaatgagcctcaaagcacatgtctgttggttgaaggaggaggggggccaaagagaagcaatgtaattgatattccgagaaggacaatttttcactgatggactctctcacatattgcaggatatttggcatccctggccaccacctaataaatgccagccatagcacaagcacacacacacgtgcacacacacacacacactcacacactcattgtgaccaacaaatagctcctactttatttccaaatgttctttagagtactgccttccctagttgagaaccacttgggccattcagcaatcatctattgagcaatacggtgtggtcagcttgactctctggatacaaggcacagccctaagtaagcaaactgttacccttcctataggcattaataaacactagctctttaggtaagtactaaatcttatgccttttttccacagaggtatgggacatttaaaaaataataatcattatgtctcttaattgtgtgtgatcatcaccctacctggaacacaaagaacacagaatttgaatgtcaacatcaatcgaatatcaatcaaaaagaagtggcagaatgtattaagtcctttaaaacatatactactaactatatatatataacaaaatatatatatatataatatataactaacatatactactcttgaaccaggagtcttgagagagtatggagtggtactagggtagaacaacacacatggagtgattatttcttgatctggcacagcatgaggctttaagccttggtggacccataccaaacatggtccatgtaggactttagactttggacagtctctgcagcctatgccagttcccagtgtttcagctgtggctgaggtaggatcaagtttttagcttctggaggtgaacaggacaaaaggtgctgcctggaaactacaaaacagctgagattctttggttctcaagaagtagatgtgagcttctagttttgactatttgtgccagtcttaaaataagtattaaactgaagaaaggctgccccaaattctattcctccttatgttgttttaagctacattcagggccatggaaagaaacagagaaggggagatctcaatccttaagatgcacagaatttgttcacaggttctagccaccctctatcacatgatcctaagttcactctggatttgttaaacaaataatctctgacccggtctctagatttcatagacctaattcatggattcagctgtagatttacccttctacagctggtagatttacccttctacagctggtagatttcatttgaaaacaaaaatatacaaggctttatcatcatgtattccttcttcttggggtgaagtaggaacacaactcaataaaacttttgcaaatgcaaaggctaaaaaggcaattcaaaggcctgtgcattaaacatcctgtctctacagaatgtttatctcaggaggtcaaaaaatatctggaatggtttgaaaaacatagttcagtcttactttcagaaaaagtgttgactaaactactaaattagaggaagacataagtttccttaagagaagggttgagttttgagcaggtaggctgagcagataagaaggaaaaagtgagactctgaaggtctgtgtggatagatatagacgagcaaggagttgcacccaggtctaatacgcttaaagagtttattggaaagagagagatgcttctgataactactagacaataaagtatggctggaacccaaagaaatcaaacagaggaagaaagacaagttctcagaaaacaaatgaattgtctgtccccaaaaggtcaaggatgtgataaattactaaaaggcagttttttaaaagctgcagatagacatttgattgtaaaaacaactgaggaaccatgcctaaaagattggacaactggtcagacaaggtggctcacacctgtaatcccagcactttgggaggccaaggaatgtggatcacttgagctcaggagttttcaagactaccctgggcaacatggcaaaaactcgtctctaacaaaaatgcaaaaattagccagacgtggtggtgcactcctgtggtcccagctacctgggaggctgaggtgggaggatcactggagcccaggaagtcaaggctgcagtgaaatgtaatcataccactgcactccagcctaagtgacagagaaagattctgtcaaaaacagaaaaaaaaaaaaaaaaaagattggacaactatgccaagcagcttttgaaaatctggatatattgaacagggtaagatctggaaaatcaacataaaattatccaataattcttacgtatcaagtttcagcctgacacagttattataggtgagtacataagtactgtgtgtgtaatataatagaaaatttatggaattaggaaaaagagaagacatagcaaaaatgaaaaatatttaaaagggagctgggcaacccataatagattgagtccaagcctaggttagatgcggatttgagaggagaacaccttctgggtaggaattagccaactcaggaggataatggtagacaagatttacttgaacatgaaagcattcagcagacccaaaatctactcatatttctcactatgggagacttcacaaaggaagtctagaagagcaagttggcaaagatcatggccagaagacaaagagaaactaaaagcaaactgagcaaaaattactgaacctacagaaaatatagataggaaatgactaaattaagaaggaagttaaactcttgcaaactcaacagggccttcctagaggaagaggggacagagacaaaaatagccagggaaagacaatctctttacgaggagtaataaaggctaatatgaggaaccaaccattcctatgcaaaaaagcaggagacagaagcagcgagagacatgaagggaatcagagtctcccaaaaatgggaaggataacgggagaggagaaatgatcccattagccttaactggataagggtttcacaagatcctgattcagaatcagagatcagaggcatcctgcatctcatctgtgtaccttgatgcccataattccattaattcccaccagccttctacctccaaattctacctccaaattctagtccctgctttcctgcccttaggatctgtgagacatcaaataagccaaagataaaatccccttcgtcagtttagccagttctaagaggttttcataacctataatcatcagaatgctaccaaatacagaatgctcccaataattttatagaccatccagggggatcctaattgaaactgctattacaatcctgaagccagacaagcagccccatctcccagggtttgggaaatgtccggagtataaaagtgcctgactccggaaagtgtcactttcctcccctcccgacacattcttctttcaaatggaaccatccatggtttcaactattgttcatgccagtttaaatacatagtggcagtcaaaagaaagagagaggaatttctaggagcaagaaaagaaagggaaactgaaagccagaacagtaaaagttgaggctaagacatcctggaaattagggttagagggaaataatgagggtgaggggagaaattttcttggacgtcagactaggagcttgggtctggggtttgaatgccaagaaagagacctgagaaaaggcctaggttaggagctggaaatgagaacctcaaataaatccaggactttcacaatgctacactgtcagtgaaaaggaagttagaaagctccacttagcccaaggaaaggactaaaaaagagcatccctgtaaaagtgaaaacaataaaaagctcttatgagaaatgaaaaatttgctgtacaaatttacattgtacagcaagtgtagaattcccaagctgtgaaattaatataaaagtagatctcagactggtaattctactagggtgcctatcagaagcaaaccaaaaccactctgcacttccgaaactgccccctgcccgaaaaatgagctcacaataaaaaatgtaaaacacatgagaaagtgatctgataaactgtgctaagaggtagaaatagaatatagacaagtcagtagtccctgtccttatggaatacacgaactatcaagggaaaaatagagtcaattgttacacaaatattcatttaattactattgtgattaatgctatagattgagtcatactttttatgattaaaaaatgctatagaaagtacagcataaataatttatggcaatgtgaaaaatgaactcatggctgggtgtggtggctcacgcctgtcatcccagctctttgggaggatgaggcaggcggatcatgaggttaggagttcaagcccagcctggccaatatggtgaaatcccgtctctgctaaaaatacaaaaattagccagatgtggtgacgtgtgcttgtagtaccagctgctcgggaggctgaggcagaagaatcgcttgaacccgggaggcagaggtttcagtgagccaagatcatgccactgcactccagcctagacgacagagcgagaccccatctcaaaaaaaaaacaaaatgaacttacaaactgacctcaacctttttattaaaatatgttcaatttaactacaacagagagcagtctcatgttgaaaatacttcaatgattaggaatattaattaatatttattataggtacttatatatatataatattagaattattatttcagtcataatcaaataatttaccttccccgcttctttccactgatggttttaaatattttaaataatatgttaatacatacttataaaaaaaactgtctgaatgtttaatatttatgatcggagttcaaggtattaagaattatgtaacattttctaaaattataagaagttgataaaaagaaaagaaggcttttgagagtgtagatcccattgttccatccatcacatttttaaattttgttttgacgtctttccacagttggtattcccaagcaagaaaatattttttaaatgattgtctcatttcttcccagcgctaaagttatctgtactttgagacaaaaccaaacatagaaatgataaatgttttaaactatgtatattatagatgcacctaatttgcttatgaaaagacaaacctccagatccaaatgagaacagactaaactaatttaaaagagttctataaatgtttaatacttgcctagctttcatgtatcaacttttatccttttcaaaggaaacacaattaagaattgtggatgtgaattaagggattataaataatcctattttcaattgaagaagttaggggaaagatatttcatttaagattaagttgtatattaacagtatactaaattgttcactactttcaaaaagaaaaaatgtccatgactacaaataaagtttgtcttagggtagattttttaaaaatgcaaaagtgaaatatctcctgaaattattaaacaaaatgtatttacttttttcctttttaaaaaatttaaaacacacatgtttacagaagagttgaaggtacagtataaggaactgacccattttcttctgacttttcttctgacccgtttgatactcagttgctaaccagatgcctcactgctccagaatatattaatggatatttcctataaacaaggacattctcctgcctaaacacaacacagccattaaaatgagaagattacattgatatattgcaaccacctaattctcagaccccactggtttttccattagtctcaataataccccttctaccaaaaggatctaatttagaatcacaattacatttggttttcacgtctctttagtcttcttcagtcttctcttatcttttatgactttcacagttttgtaaattacaggccagttgttttgtagaatgttcctcagttgtggtttaggattaaattcagacatctttgggagaaataacacaaaagtgatgttgcatttttctcattgaatcctatcaatttgtccttttattgatgacagtcatatccaacacatgatactgttgggatgggtcaagcctccccattgtaacattattttgtggagaggtactttgaaaccatgttaatataccatctcttcaaactttccatttcttttttttttttttgagagggagtctcgctctgatgccaggctggagtgcagtggtgcgatatcggctcactgcaacctccacctcccgggttcaagcgattctcctgtctcagcctcccaagtacctgggactacaggcgcgtgccaacatgcccggctaatttctgtatttttagtagagacgggcttcaccatattggccaggatggtctcaatctcttgacctcatgatctgtccgcctcggcctcccaaagtgctgggattacaggcgtgagccaccgtacccggccccatttctttttttattcgcttacataagcatggactactgttttcctatttcattcaatggtttataatttgttactatcataatttacttagatcctcaatttgccctccatttggccaatggaagttcattaaagctggctgctgtgtccttgtgacatgccccatcattctttgagcacttccttgctttttggaacaagatgctttgaattcatctgctactagccttgcatcacccttggaatcagccatttctccaaggatcctggttcctttttgtagaaaatgacatttaaaaaacaagatctgagggccccttggtatgcatatgatgtgctcattgttcctggggtggtgttgttcccagtttctctcagcagaaagagctatatggaaaaatgtatttatattgtgtgtgcattcacatatgtacacatacacataggcctctgtatttatttctatatctatctttacacattgaaaaccagatatttatacacatatctccagtttcaatcccatatcacagaggtccagatctactatactttctatacttttaaccccttttccaacagggagaaagctggtttattgttaatacatttaattgcttgatcaatcccccagtctgtaactaatttcccatgtcccagccccagctgccatgtgggcgccatgctcaccctgtcccagacgccgtgctcattctgccctggctctcctatgcatggacaccttcctcctcctactcagaccctgaaccccatcttaggttgacctccacacacaccatccttaccctgcttaggcaccaacatactctgctggccacctgtccttgttgatgtggctgacgtgctgctgtccctccccacactttagaacccaccttactctgtccactgaaccattcaggactcagttgttcaccaaggagcaaggaataggaaaatccaaagttttgaaatctatggaaagcaatcaatgctattccttttttttttttttttactccttttttctcctaaagcatatataaaggagaataacaatacaagagcatttttaggagtggctgacatgaaatgatttgagaatattgttaggaatatatgtttcttattcaaagagcatttttgttcctcttatttgcattcagttaatagaggtagtgttaaacaacaacagaaaaaaaaaaaaaaaaatacacacacagtgctaccaggaggccaaacaggtaagctgagcttgtcataaaacaactcggaccactgaccaaggcacacccaggtgagatcttgcaggtcctttgttggggccacttcacgttctcaccaggatgccttaggaaaagcttttctttctttctttttttgctttgtagagacagagtctcagtatgttgcccaggctggtcttaaactcctggcctcaagcaatcctctcccttcagcctcccaaagtgctgggattacagccatgagccaccatgccccaggttcaccttctttgttttaatttcaaacaggatggaaactcaattctattgttatgattctattgttctgcagaagagggcagaataaaaagcaccacaggccagattagagctgtgtatccaagtctagattttgaattcaaaaaaccacaaaggccaaggggaaagagaacgctaaactctcaagtttgtcctaacctctttagggaatgaaactggacacagccagacagtccttcagtcattcctagcttgaaagatccctccccactctgccttgcttacccaacgtgggcagctgagtgtgacagctttgaggggcctccccagggctatttttaacctggtgttatctgcttacagactttccaccagggcagccgcaggtccagggagtcactccacctgggaaatgtgagcacaccgctggcctgtggcaaatgaggtatttttaactgagacttgagaagctcagaattgtcatctgcttcaggcctcagggtgcgagacacaaaacagagccaagcaagagaggctgtgtgcggactctccagttccttagcaaccaattgctgggcttgttgctggaggagggctctgtaagtgtccggatcagcgatggaaagccagcctcagagtctttcctggcaattatgtggccccctccccatagaagtgaggcctgggagtcccccttgcaggcgaggtattctgccgggctttcccacaccacacctatctgcggctaattagcatcacctgggacttgttagacacatgaattcttgggtctcaacccagacctgttaaattagaaactgacaatgggacccagcgatccatgttggatcagaccctccaggtaattctcatgcacactaaagttctaggatcactggcctaatcacacattcgctaacattcatagataaagacgtaagagtaacacttgaatcccaccaagcccacattgcagtaattcttttaaatgaataacttttagaacatttttacacttaccagaaaaaaaaagtgagcagatagtaaaaatcaccagtaactttttcaaaccactgcttttttttttttttttttttttagatggagtctcactctgtcacccaggctggagtgcagtggcgtgatctcggctcactgcaacctctgcctcccaggctcaaatgattctgctgcctcagcctgccaactagcttactagattacaggtgcccaccaccatgtctggtcaatttttgtatttttagtagagacagggattcaccgtgttgtccggactggtctcgaactcctgacctcagcaatctgccagcctcatcctcccaaagtgctaggattacaggtgtgagccactgaatccagccaaccattgcttttttctgctgctcactgtaccctaataagaaaacctccttcctctgttcgtccttaaaggcagtgataagacaccaactgagtttttgccatcaaaggcggcaattgggtcagagaaagaaatagaccccagcgctaagggaagatagcagtaatgcacaaaaaccctaggaatgactgcaaatgcctaccccagcacaagctgagatgaacaactgtgattgtctaagactctgcagccagggcaacaccttcacaaaacacgcttggaaatgatgtgaatatttgtgtatcagttatatagttgtttcttcttgctgctgtaacaaattaccatacacttagtagtttaaagcaacacaaatttattgtctcacagttctggaggttggaagtctgaaatcagtttcactggactaaagtcaaggtgttatcaaggctgcttccttctgaaggctctcaggggaaaatctgtgtctttttcagcttatagtggctgtgtctattccctggcttgtggccccttcctgtatcttcaaagcacatttctcctcccatctctacatccaccatcactaattgtcacatgtgattctgacctttctgcctctctaagggctttgtgatcacatcaggacctcccacataattcaagataatctccccatctcaaaatcctttatttaattacatttgcaaagtcccttttgacatagaaaataatattcacaggtctcaggcattagtatgtgggtttatctagggggtcattgttcggaacatctcgctccataaagccctgtaccctctaatgccatagacactcgctatgtgttgtcattgagcacctgcaatgcagctcatttgaactgagaaatgctataagggtagtgaaatttaaagacttgttatgaaaaaaaggtaaaagatttcattaataatttttatgttgattacatattaaaattataaaatcttggatatattgagttaaataagctatcttattaagattaaattcatctgtttctttttgctttttcaagtgcagctactagacaattttaaattacatctgtggctaacattatatttctattggagcagtcctactacagaccataaaggaggcagggtgacattaactttcagttgttttatttttgccttacttataagagagcccagactttggaagcaacatttcttctttctctagagagagccactaaattcctgcaattaagatgtcaattcaagagagatattttattagggatatgcacaactagataagcgtaacaataaaaaaaatacatttatccagcaacatgcattctaataaagcattttcattaatacattctttcattaagtcctcattacagccttgtaagagatgtattattccaacttttcagagaagaaaatggagcctaagggaaattaacttgctggaggagcacccagtcagtaagtgataagctagaacttgagcccatgtctatgcacctctgcacccaaggctgcctgactgatttcctggtttgggtttagtggtttaatcaggctcactctacttcctgagtggttttactttccaccctcctaaatttcagagatctcaggattttccctttctaccttaaagttctgctcttttgctattctgagcacatttttattatgtttttttaaaaattatttcttaactttgaaggcataggggcatatttcccacccagttatttaaagaagattttctcctgtgtcacacttcctcagcacccagaggcacacctggcacccagcttgatcctgggccatctggtggaagagccctgataccaatgactgtctctcctcgttctgttcaccacccatagctgcatacataggtaagatgttcggatctgacctctagccagagtagataccctcagagaaaccagagctatggtagtttaaactgcctcccagctttcctctgatcagtcttttggggttgaacaggcaatttttcactttggcagagggtcactgtaagaagaattagcaaatgcccactaagagggaagtggacactaaggtcatgtaggatgccccttacccaggcagcactcctatggcataatcagaagtatgtgtttgttttttttcccaattcctgacacaggactccttaaatcccttggaatatcctgagtgataagagtgataagagcaccttttgttctaacttttgttctaacgaggtgattcttggattcttgaaaactcctagctagcttcaggataggggctggtctccagaaaaaccaaactttgattagaagcctagagttttcagccctactccccaacctcctgggaggagagagggctagacattgaattaataaccacatactcatgcctgtgtgatgaacaaaatctccataaaaacccctaagtgtcagggcttagagtttctgaattggtgaacacatctacattctgggagcactccaactccatggggacagaagctcctgcactttctaagggcattgtgatcacatcaggacctcccagataatccaagataatctccccatctcaaaatccttaatttaattacatttgcaaagtcccttttgacaattttgacatataaaataatattcacaggtctcagggattaagatgtgggtttattccaggggtcattgttcagaccatctcacaccatataaccctgtattctctcataccgcagacatttgctacatgtcgttattgagcatgtgcagtgtagctcatttgaatggagaaatgctgtaagggtagtgaaatttaaagacttgttatgaaaaaaaaaggtaggcccggcgcggtggctcatgcctgtaatctcagcactttgggaggccgaggcggacggatcacgaggtcaggagatcgagaccatcttggctaacacggtgaaaccccgtctccactaaaaatacaaaaaattagccgggcatggtggtgggcgcctgtagtcccagctactcaggaggctgaggcaggagaatagcgtgaacccgggaggcggagcttgcagtgagccgagatcgcgccactgcactccagcctgggtgacagggcgagactccgtctcaaaaaaaaaaaaaaaaaaaaaaaaaaaaggtgaaatatttcattaatttttatgttgattacatattaaaattatgaaatcttggatacattgagttaagctatcttattaagttcaaatttatctgtttctttttgctttttcagtgcagctactagacaatctaaaattacatctgtggctaacattatatttctactggggcaggacccttctggaccttctggaccttctggaccttggcctaggcacctcttcatctggctgttcattcgtatcctttatcataaaccagtgaatgtgagttaagtgttgtcctgagttctgtgagccatcagggcaaattatcaaacctgaagagggagggagttatgggaacccctgattcatggccaatcagtcagaagtgcaggtggcccagaacttgcaactgtcatctaaagtgggggcagtcttgtgggatctggcactaactccaggtagatagtgtcagaattgagttgaattattggacacccagttggtgtcagagagttgcagcagtggtgtcaggaaagataccatgcatctggtgtcaggaaggaaaaaacacaccacttgtcagctatcagaaagggaagagagaaacaataaagtaaaatgggacagtgtcctgctcattttctgctgccacataaaaattatagcctttagattgaaaaaggccctgaaagagtaaatagtccaactacctcattttacacaagtaaaccaggatctaaaaggttaactgacttctgtaaaatctcagcaacctaataccaacttcttattgaactcccctttctgatgatgcttgacttggacaaaactgttttaaaggatgacagagaaatagtaaataaaacaatatagctttgatttccaaaccacactacagagaagtagcatcttgctcccagaataaggctctaaaataggcacatgaagatgaaaatcatgtactgtcaaactaatccctgaaaagccttaagagagtgtcacattggagaccaatgtaacttccaacaataaatcccacatggtgtttgttttttttttgtttcagagctggaacaggctcatcggttgagtaccagattaattaattggcttgaggttagggaataaaatggcacaatctttaaacccaggatcacacgtggaactgcaaaaaggatacacataaaaggcaccaggttctgaaactaatggcagattcctttctctcatcttttgctcttactccaggacactgaatagaatgactcatattaattaaacattcatctctcctccctgcactcatggtttagggtttattgcttagttagaaaccaagcttcacaagtgcatgaatccctgttttgttcatagatgtctcctaagtgcctaataatatacctgtcacataaatgtttgttaaataaggagatgaatgtattctttttgtccagcctgtatagttgaattctcatacattaaagctatttaggtctagctatggctttcacttcttgggaagttgtggtgctattaccagaaaaattcaaacagaactatgcataaaaagatttttcaccattcaggaggttcttggagtctcagattaagatttcctggtactgtcaatctctatctatgacacttcagcagaatgacacttttgtggcttcagagacactgacacctactttcatagctgcataggactttaaaactcccccaaagtgctacaaacaaaaagtactcttcaagtgctgtcaacctaaaggttaacaggttgaagggaccctgggctaaggaagcacaagctggagacaccaaaatggtcttcgcaactcgcctctatattttctgccctgctcctaagccagcctgttggccgactggcccttctccacagatgtcatcttgagcctcttacagagtttcagcactgacattaatgacaagatggatcacctacaggacaaccttggatcctcaaccagcctgattaagcattgacactgcatttgtcaccaccagctctgatggtttggacatgtagaaatgtattgcaggagaatatgcaaacagctgctgtaaggtgagctgatcgggacaactgccagcaggcagaagggaaggcataattaatgggcacccttcagcagagctcagagcagaccaaacgccaatgcagaaggctcaagaaagaggcaaacagactagccactgctccaggatgactgtggctctttatgagtgaagagaaagggtggagactgaagacagaactggggacagtgacaggcttggggaagaacagctgattcagcagtcccaaggtgagtcatcccatgtgttccacacccaggtagaaagcgctcattagcagaacataatctcccaacctgcatgatgatcgtctgtccatgagaataataaacattacagattgtgcttgcactaaagcagatttagtaaagcctcaggaacagaatatacttcatggggtaagaaatccagctagggaaaagactgacctatctatgcatctgtaatgggttgaatagtgtctccaaaatatatgttcaccgagaacctcaaaatgtgtccttcctttgcatatagggtctttgcagttgaagttagttaggacaaggtcatactggattagggtgaagcctaaatccaatatgactgatgttcttataataagagaacacacagaaacacacaccaggaaggccatggaagtaaaatatatagtttgtcaaatgaggatgagttcaagaaggggtcctacgtagtgaggtggagtattagtttttaagcctgattaaattaaacacttggtggatctttcccccaaacattgtacttagtattatagtgctttcattcttgtaaaaaatggtacaacatgtaggagtacatatggagggagaagagcctccttctgttgtattagtttctgctgtaaaaccaggaaaatcatcggccataaagctcatagggagggaaaagaacaatacataagcaaaatcatcaaggctgaaggggagaactcagaggattatgtgactaatactcacttgtcagtgatttatacatcaatctggccatttactattcaacaaatgcctaggccacgtaagagacctcaacaaacggaagtgattctgctataggaaaccacttcttaaaagaaaaagaagcaaatagaggtgctttacaggaaaactttttcttttcttttctttctttctttcttttcttttctttttttttttttttttgagatggagtctcgctctatcacccaggccggagtgcactgggatgatctcggctcactgcagcctctgcctcccggatttaagcaattctcttgcctcagcctcccaagtagctgggactacaggcaggtgccatcacgccctggtaatttttttgtatttttagtagagatggtgttttgccatgttggccaagctggtctcgaactcctgacctcaggtgatccatctggctcagcctccagtaatcccagtgagccactgtgccttggcctaggaaaatttttatcatcctaaaatcttatatcatcactcaagcaaaagaaagctctagaactgcctgagagaacagcctgcaacgaaggagatcatgtatctgtgctgcccaatacagttgccaccagctttataaaataactgagcacttaaaatgtgcccaaggagactgaagaaataaatttttaatttgatttaatgttgattaaatttaaacaaccacaattggctaagagctactccattgcatcacatggctctagagtcacagaaagctgcctgtggaaaaagtcttgagacatttctcaccaagtctaggatgagactggatcctcaagtaaaaacagattaggaaacaaatcaccaaagcaattacgagcaagaaaaaaaaaagctagaggtatcatacgtcatgatttcaaaatatattacaaagctacactaatcaaaacagtatggtactcatatgaaaacagccatatggccaaacagaagagagatcccagaaataaactcatacatacatagttgacaaggatgccaagaatatacaatggaggaaagatatgtcttcaacaaatggtgctgggaaaactggctacacatatgcaaaagaataacattggaactttatctcatgccatgcacaaaaatcaagttaaaatggattaaagacttaaccataagacctgaaactgtaaaatttctgaaagaaaacataaaggaaaatcttgacattgatctcggcgataatttcttggatacgacaccaaaagcataggcaaaaaaaaaaaaaaaaaagcaataataaccaaataagattatgctaaactaaaaagcttctgcatagcaaacgatatgatcaacaaaatgaaaaggcaatctataaagtgggagaaaatatttgcgaatcatatatctgataaaggattaatatccaacatatataaggaactccttcaattcagtagccaaaaagctaatagcctgattttaaaatgggaaaaagacctaaatagacattactccaaagaagacataaaaatggccagtaagtatatgaaagatgctcaacatcaccaatcaacagagaattacaaatcaaaaccacaaagagatttcagccctttgccactgttaatgtgatcaaaaaacaaaagataacaagtgttggatgccaagaaaatgcatctcttgtatatggttcatgggaatgtaaattggtgcaaccattatgggaaagagtatggaagttcctcaaaaaaattaaaaatagaactatcatatgatccagcatatgataccagcatacagtatagaactaacatatgatcccatttctagatatgtaaccaaagaatttaaaattgggatcttgaaaagacatctgcattcccatgtgcattgcagcattattcacaatagcaaaaacataggagcagcctaatgtccactgatagatgaatggataaagaaaaatggggtatatataaacagtatgtatatatacatacagtacaatattactcagccttaacaaagaaacaaatcctaccatttctgacagcagagatgaacctagaggacactatgctaagtgaaataagccagacacagaaggacaaatactacatgatcccacttaattgaggaatcttaaaacagtcaaactcatagaagcagagagtggaatggtggtttcccagaggaggaggaaatggggaggtattggaccaagggtataaagtttcagtaatgcaagataaataagtcctagaaatctactacacagcatggcttctgtagttaagaatactatattctatacttaaaaatttgctaggtgggtagatcttatgttaagtgtccttataacaaaataataataacaataataaagatggcagaagggaacttttgaagatgatggataggtttgtgacattaattgtggtgacggttttatagatgtatacttgtttccaaacctatcacattgtttacattaaatatatacaggtttttgctcgccaatacttcaataaagtagttttttaaaaaaaggttagggaaccttcaccagaatataccactattacataaagtacttctagtacgtattccacagtctgcagtgtccttaccagtggtcagtagtaccatctacattttctgaccaaggaaactgaggcccagcaagattatttgacttgcccagagccttgcggttcttaaggggcagagtcagaggtctgacaccaaagctcctactcttcccaccaaggcaggtcatctacagcaccttctactcttaaggggtctgccatttccaccctctctgaacagacataaaacaaacaagtgtattatgtctgtgtgtgtctttatgtgagtgtgtagactctgaggaacaggtaagtcttggaatcccttgagtgtttagtgtgaacctagtatgtttagccagccagtatcaggtcagtaccctttagccagccagcctcattttccatttggtccagcaaaatggaatgccaagaatagtgatggggctaacaggatgcatgaatccatacttgttgaataacttattaggtagaagtagcaggtcaaacaaacctttccccctcagatacgctcagcaacaattcagtgttgcggctctcctgctcctcagagagctcttattaccccagcagtggggacactcagaaaccctaagaccacaagtctttgtgttgaaagaggctacaagtgcggaaaagaggaaaaataaggaaaggagtacctcattaacagtatggagatttgaaagtacaggcttttgaaagtgactctctgaagctcctgggccactcagcttctcctctaacttcctgtctgcccccaacagtgggggaggtcaacagaggggctggccagtcaatagaactagcaactgctgaaatccacatgaagctatggtggagaatgtgacccttccaaaaggaaaccacagctggttgtggaatgcaagatgcggaagcactgatgcctgccttctatgctgttgctattgtgatttctgcagcattatgaggaaggtttctgatggaatgaattttgcatcttttaagaaagtgtctctgtacctggatatgtgcttgataaggttaatagagcaattcttggtgtgtctttttaacccacaggaaggttaacagaggctttcatcgttggtcctgtaagcctaccctgaaaggaactttctggaaagagtcccctcccccttaaaaaatgccttatagaatcttggggttttgaggttgatgtgtttccacacccaaataaccccaaaatagttcatcctattgaaattcttggtgtcctggaaagcattctatggaaaacctgcctggtcagccaagcccacacgtgagtctatgcagacatctcctctaacctcgcaagccccaggaacctcctctaacctctcaagtcccaggatctgaggaccaatttttagcacaatctcacacaacaaacctattgggcacctaataatagaaacaagctaatgaatgttttgactgtgacaaaaaaaaatggtttaataactttttataaatgcattgtttcttctcattgtctcagggttatgccaaaattaatttcaaaactatctgcttaaatgtgtccttggacaataatcaccagtaagtcctgacttcaccccctttctggtagcggtctgacgttcctttgcagagtttcgcttccatcgataagttactttaaataaaaagttaaaataaaaactagaagccacaattgtgcctatgtcagtcatcgaagtcttgtacaggagtccgtcttcgcagcgcatcgttctcagaagtttcccgcgggaggaaagctccactttatgaattactcgaacagcttccctgggaatgcccagccccgaagcttccctgctgaattcaaagtcagagctcccagggctcggtcccaggaaccgggagccgtgcaaaaagcgcgtacactgccatccactggccccgagcaggtagtagcaggagtgaggcgcctgccacgggagctcaggaactgggtcccagtaagatccgacaagacaccacctcccttccgcccgcacagcctgccctctctgcctgcagctagcgtcaccggtcggtccccgattcggagcagctgggaccctcgcggtagcaagcggattccggggccctaatgacaccgaaggagaggggcagccgcaaattagaccttcttcctgggggctcaggccagtagggactgtccgtggtgcccttccctttctttctcctcctgaacgagagccaacgctgccccttcccaggactggatctgagccaaccaaatcctacagcgcagagcctgcgcccccggcggccagccctcctgtgcctaggcaggttcacgccggagaaagtttgcacgcagggacctacaagttcccagcactctgcaagagggccagttctgggatgccagcacttaggacgggcgagtgatccccaggcaccaactgggggccggggaaccaagcgcgagcccgggctgtggagggaccgacacccaggcgctcgcagctggggaagggggcttacgtctggggcaggcaagactgctgcacagtccctccagccacccggcgcccgagacgccggcgcagacaggaagctgtagatccccgaggggctggctccgacagctccacctgcagcctcccctgccgccagtgtgcagccaagtccactagatgcttggagggcaccgtgcggaggagggactctgcaggaaaggtggcatcacccccggcatggagaccggggtctccggatcgagccgactcgaacactgaaggaaaccctgcccatgaccctgggagggtctcggacgccgggcgaccggggtggtggtcgggaccagggccgtgcgcctgggaactgggtgcagggcgctgagcgcggaactgtcagagcgggagctcaccggcggctggggaaggaggtggcatcgggcggaggagaggacgggggcgggaggggctgaccctgaattcaccgggactaagaggccatcacacctggctgcggtaggacagcgaatcatcgatcttaccggctttggggacccggctctgcggcagcgctcttccggagcgagggcaggagactgtttcatggataaaaagtctcgcttattcttctgtccacttttatcttggtcgcttttctctcctctacgtgtcccccggggaggcactacggatgattt

SEQ ID NO: 529 - DNA, 30948 bp, Homo sapiens
atgcgcagcggcgggggttgttccggctgcctttcactgaggggacccgccagtttctaactcagtggcgtttgccctgattcccggggcctggctttcagcgtagcaattctgccggcgaagaaggtgagcgcagtgctgtgtggcagcagagctccttaggacgaggagcagcgggacgaggaagggcagactggtgaaatcgcaaactgggcgtctgttccggcgccggacccctatttgcaaaggtgggtggcccgtccggagcgggaaaacattccggaagtggagggccgggccagcgtgattgacaagcgggaacccctgtgtggggacgggtaggcctaggaaggttgtgcctgcggtggaactgggcggtgcgcagaagtgggcattaacagcagccgcgtgtctgggtcttagatttggcccagctgtgttgagcttttcatggattatcttacgtagataagacactgcaacagtgagtgagcgcttgtaacccacctgtctcttacggaaactgagccccagcgatgctaactttagcaaggatacagctgggatcctaaacttggcaatcagagcccagagccgataaagttagctgcatgagtctagcttcccccagggcgggaatcgaggcggagcagggtacagtacggaggccaggaatgagtgcacttgaccagattgttgacggaagtgtcataaaaatggacttaaatgctgataagcagctgtttgggttccacacagggtgcgagctcaggatgcacgttggaggggacacagggccagagcaaggtgggaatgcgggtattatgggccaggccatcctccagctggtggagcaccgcagtactgcagtgtgtggccctggcttaacagcagtgcggaaaagcttttttcttggggctgtggtgctttccaggtgtgtgaagttaaaacattttagggccatacggtagatagtacctgccacatagttgtcttggtcagccccggctgccatgacaaaataccataaactgggtggcttagacacagaaatgtgttttctcacagtcccagaggcttgggatgtccaagatcaatgtggggaggacacaactgagcccacaacaatagtctgtactcagtaatgagtgataattggggactgaagaaaatgaacacgttaagaactaatatgttcctgaagtgctttcacaactctaacctcgttttatgagcgtgagctttgctgtcctggtgtgtgccttggcactgggaggtgatggttgtcctccacacagccaacctgaagagggctgaacaagtcactgcaaatgtttttaatagggcttagtgaatccgttatactcagatttatctaaacctctatgatttagcctgtgctgcttctggaataatgagatccataattaccactgatggggaagtgaaataatacttacgtttcttctgtattgtttagtgttgtcattctagagtttggtaaccaagtctgtcttttttatcccacttatcctggtgggaggaaaagtgaggagatagaaagtttcaggtggcttgggggtctggcagatgtggttcaaatcctgagttcaagcacttgctgagtgaccttgggcaagtcatataagtttactgagtctcagtttctttctctataaaatagagcttataaaaataccacacagggtttttgtggggttatctgaaaacggtttgaaaccattaaagaactggccatttaactaataggtattcaagtcatgggacctccgttacccagcctcggaagagaaaccttcacttacagccccgatgtctggctggctactcattcgttcatcagatttttgttgaatgcctatgaggtgtcgaagcacctagttctgagtcctggagccagagaagagcaagacagacaaggttcctctatttatggaacgtatattccagtgaggaagaataaataggttcagatggtgctaagagctatgaataaattaaatacagagtaatgtgattttttaaaagtgacttagagcaagctagggggtgaggagtgggggtggtgtttgaccactgtccagcggccagacagccggagaggcttctctgaggaggtgagccaaagcctggatattgaggaggactccttctccaggccaaggggagcagcaagtgcaaggcccgagctgagtagatgaggctgggagcctgaccagtctcaggctgaccagtgctctgtcttgagaggagctgctggtcagctttttgtcttgggattcagaacgaggagacatgaagactttttacttggcagtgggagctgaagctgaaaggtccaggggctgatgaggccacgtgtaagcgaaagtttgggataagcagaaaccgagtgcgctgagggagtgagattgtggctgtatccggcacctggctgagcaggagagtgaaccccgtgggtgtgtgtttgctggtgacgttcctggagctgtcttgaagtccgagctgccttgcagcttgtagtctgcctctgtttttggctttcccagatagtttcaattcttactctcagtttgtgaacctcccttcagtgaacctcccttcacttatgctggatatctcttgcaaccggatgagcttcactaaagcagagtcatttggacctggattcgaatccctggttttccactttttagctgtgactttgagcaattatttaatttctgtaagcatcagtatccagtagctgtatccttatagtgttgtacagattaaatgagataataaaagcaaaagaccactgtagagtgtttaacacataggaggtactcaaaaatttgttaggtacctttcttcccctttccttcatgtgttaaagctttttcagtacatacccctctctcaggattgaattgtaaatcatgttttttgattacccttcttgtaataattcctctacctctgtagtcatgtttttcttttttcattttttcttgtccccagaatgtctaacaaaacagccaaatatacctctgtgaagacagagggtaaaataatgctagttctgtgagttctctcttcttgtgcaaatccataaactgccaccaatctgtagtcattttaattgcccctaaaccgaagagcatcgtggcaactacctttcccctcgtaaatagagtgacactatcactagtcttattgaggccaaagttataaagatgggctctcgatctactaatattagtaaaatgggtttgggacttactaacatttgtgcttagaagagacagacctggcaaagagcttggagaagtgagttccaaagagagaggtgtgggaaccaggatggaagagtcaggcctccagatagcgtttacttctcctttcttccttgaatcactgtctcagagataattaggttcaggagaggagaaaaaaaaagatgacgtcaacgtggagcagagtttttcttagaccttagcctagcaaggaaagagaaatgcctggtctcagtactgggaagctgttccagccagagccccgtggctgtgaagagagctctcctgtctggaaccaaacagaaagctcataggtctagaggccagaaaagttagtaggtggtggctctgttcggtgctggaaatggaggccaggatgaactaagaagcaaactaaagatacttgtaagataaggacgtgtaggccgggtgcggtggctcacgcctgtaatcccagcacttcgggaggccaaggcgggcggatcacgaggtcaggagatcgagaccatcctggctaacacggtgaaaccccgtctctaccaaaaaaaaaaattagctgggcgtggtggcgggcacctgtagtcccagctactcgggaggctgaggcaggagaatggtgtgaacccgggaggcggagcgtgcagtgagccgagattgcgccactgcactccagcctgggcgacagagtgagactctgtctcgaaaaaaaaaaaaaaaaagatagggacgtgtatgttaacttgcgctatccaaacaacaagctgtgcttatggtcctctgcctgtgcgtcatgattttccaggacttcacaacgggataaagtgaagtagcttcggcttgtgaatgtgcattgcagagacgtgggagaagaaagctgcaaaagtcattataagcaacacccttgatcttaggggtgctggtctgtgagaagagagctctaagccttttgtagaggcattagaaaggtatcggagccacggtgaaatgcaggggagattgggtttaggggctttcctggtctgcattctgctacagccgttaaatgccgctagatggagtgcgtgattctggtatggcctcacgtggacctgctgcgaaggatggagagaacatggtctctgcttcccagaaaaaaggagaaatttggtaataagtgtggagactgctcttaaataatgctccagatttcaagccacttcttcctggaccatgagagagctccctaatgttgtatttatttttcctaggtccatggctaatgaaacacagaaggttggtgccatccattttccttttcccttcacaccctattccatccaggaagacttcatggcagagctgtaccgggttttggaggctggcaagattgggatatttgagagtccaactggcactgtgagtatgaacagtgagagatactgaaaaggacaacttaacagcagccgtactagcttttcctgtttgcctatccagagattttcatagtttgaagttgggcagagtagtctctgtttatctgagtaatagtcacttcctctattaaagtcttttttttttttttttgagacggagtctcgctgtgtcgcccaggccagagtgcagtgggacgatctcggctcactgcaagctccgcctcccgggttcacgccattctcctgcctcagcctcttgagttgctgggactacaggtgcccgccgccacgcccggctaattttttgtagttttaatagagacagggtttcaccgtgttagccaggatgatctcagtcttctgacctcgtgatccgcccgcttcggcctcccaaagtgctaggattacaggcatgagtcaccgtgcccggcctaaagtcttaaacatagctctgtggtctgagaaaaattaggctgaagtcattggtgcctacctattacggtagatgagacggctttcttaccaactcttttccctcccgttccccatccttcaaatataattctaagttttagtctctgctgagtgaaccagtgtgttatgattatgttttgaacataattttgtcttgaacaatatgtcttaatattctgttttttctagttaataattgcccttttaaagttagtttagtttttaatatacctatgccagttcctcccacatcatccagtggcctctcaatatgattttccatacagataactcctgtcttagtcggccaggactgccatagtaaaataccatagactgggtgacttaacaggaatttattttctcaccattctggaggctggaaagttgaagatccagattctggcagggttctggttctggggagggggtctcttcctggcttgcagatggctgcgttcttactgtggagcaagaaaagacgaggaggagaaaaacaaatctttggtgtctctttctcttttatgaggacaagggctgctcccttatggctgctccgttatgacctcctttacccttgaaggccagatctgtagtagagtcacatggcggggttaggatttcaacatatgtttgtttgttaagatgggcagtctcactatgtggcccaggctggtctcgaactcaagcgatcctcccctctcagcctcccaagtacctggtggctggcaagatccaagattactggtgcacaccaccatacacagcttcttttgttttgtttttgttctttaaaaacatttttttaacatgcattttggtggggatacaattcagtccacagcagtgaccaattccatttttaccttggagccctcctggaatcctccatcctttccctgtcatttgaattagttgctcctcagactgacttgacagatttcagcatgagtgttaatggggacagacggccgcacccacaccacatcagggtatacgtccgtttggaggctttcctcaaacgtctggcagccctggactgcctgtgtatgctgaagaacagggcacagaaaggctgagtctgcagggcactggctgtggctgccaggctgggctcctttgttgggggcctccagttgccagcacatctgtgggattttccctagagtcttcagtctctccagagcaggtgcctctgagccctggcccagcaggtacagacgctgaagcccaatagccggtcttccgggaggtggtctggggaaggggatccaggtggagagtccccctcagtgcctgctttcagcctggccctcctccccctccctcttgcctcctcaatctgccggttgcctccagggctctcctagctcagcttccacttagagcccacttcctgtcttctgcaaggagcaggagcagggattgcaacctgagaatctaattgttcttaaaaagaatttcaacccgtccctttgttttcagtggcctgctgtgttcctaccacttcctgagtctttctgagaatgagtgggggagatctctggggacacttgggcttgagtgtctctgccgaaatcacttccatgtctctgccttctttccctctctcctaaaacatattactccttccactttctttttgtgggtgtaagcctccatattactttggttaattttagtgtgctttggaacacagatgagtgcatgttcattctgccttgtttaattttagagacagggtgttgctctgttgcccagggccgagtgcagtgttaagatcatggtttactgcagcctcaaccttctggcaacaagtgatcttcccacgtcagcctcctgagcagctgggactacaggtgtgcaccatcacacctagctaattttttaatttgtagaaatgagatctcactatgctgctcaggccggtggtcttaaacccctaggctcaagcaatcctccctccttggcctcccatagtgctgagattacaggcatgagccactgtacctgacccctttcaccttgtttagcctgacaacccatcttctccctctcaggtctttccatctcagtcttctgcactccaggcttctgcgtcttcttcctctgctcagcctttaattgtcgatgtttctggttctatagcttcatcttcttgtgtgcagtctctgtgaatgtaccctgtggctttattacctttgacattcttctgtcttctaaatcatctcctgaatagagtgttttctcctgtcctgggtgtcccgcagcccatagaagcagccatgctgtgggacaccctgagtggggtttgtgttacctgttgtgcctaccatgcccttccccgccgtggatgcacaggtgccccaccttagctgccccagatgctgtttatccttgatagtcaccttttaagccttatacaggtctatcaagttgagtcaccattaccacttggtgtgtgctgtgccttgtgtaatactgcagttccgggagtcatccaacctggaatgcatgctttgcggggatctatgatgccctcgaattgtatgttacatgtgaacctgtgagcattttctaggggctctgcacctttgtgtcctcagctctgagccccatgcttgctgcaaccagcaggtgttcagagtgaatgaatttgcttatcttggcataaatcatgtaactgttgatgataccccaggaaggtgagcctttggttataaatccttttaacattttccagtctaaaagttttgtggtcttattacacgatgtagaaaacagtgggcctcagttattcttttgctgttgtgccggagtataccacggttgtttttgaaagataactttgaccatacccttaggaacttcctcagctcactttcaaatggagggcactggctttctaaccattgtgtctcccagcccagtgacagctgaagctgactgcttccgatatcacagacagcacagaagagccgccctccaggtgctgctgggaaatgctgcctggaactctttgccatttactttctatcaaaagctgagggaaatggtacatatggggctttcctaaaaatatgggatccatccatttgtcaacaatgtcattctatcctatcccagggcctttcaagattttgatgaaaactaatagatcccatattccagaataatgctattaataattttattattattacttaatgatagcaaaaagttagctaactccaaccgctcacttgttatttgccaggtaatcctctaatccagaggatttggccttttgtgtgtgttaatgtcctgcttgcaccagctctatgaggaaggtgccgctgttgtcatttccatttctgcactcgtggaaacaagcgtagtgaggccagcctgagccacagagctgcaggtgggggagacagctggaaccctggcacctggctgtggagtttgagactctgactcctgcgccgcgctgctgccccaaccgtagtcatacgaggtgtttcaccccgccctggatactctgagatcccctctgggttcagcaggctcagagagctgactgcctggagcagaaggcatggggtcctccagagactcccctgagctgagttcccctgtggacaccagggccgcctccttgtggcgctccctgaagggtcctctctggaagaactgtattggttccctggggctgctagaggaaagcttcacaaactggggcttaaacaacagaaactgacatcccacagcgctggaggctggagtccgagatcaaggtgtcagcatgcttggtcccttctgagggtcgtgagggaaagatctcttcaggcccctttccttggcttataggtggcgtgttctccttgggtatcatcacatcgcctgccttctgtgcatgtctgcatccacgtgtcccctttccaataaggatattagccctttaggctgggtcccgtcctagtagtctcatcttaactaattacatttgcgacagtcctatttccagatcaggccacattctgagatgctgggggttaggatttcaacacaggaatttggaggaatacaactcaatcaggcttatggaaaattctggtcttaagtcaagggtagtgttctccagtctgtatatggaggcgcacacctatggtcccagccacttgggaggctgaggccagagaactgtgtgagcccaggagttccataccagcctgggcaacatagcaagacctcctctcaaaaacagacagagtggtgtcttccagagtgattagtttgcttaaaaaaaaaaaaacaaaacaaaacacaaaccgtaagcactggcgctcatgactgatcatcctgtatccacgcacgagctgcacgaaggccgcgcggtcactctggctccctgttggcgagtacctgggatttcttgctcagcattttggggccttaattcttttaggggactttttgtctaatgtctccccttcttctaattatgtgcgatatttacatagaatctgataaactgcttcaaatttgttttcagaacagtgagctggataattaaagaagctttttcctgcttcttgggcccagtttccatttctttcttttttctgtttttcctggctattctagtgctaatttccttcctttcctttcctaggctggtcttagagcatcctctcctatgtacagccagaccttctttcaagcttttattaaaatggggaaaggtcatttgggaggctttgttgttttcctgtttctaaagatcatttttcttcctgcaggggaagtccttaagtcttatttgtggggccctctcttggctccgtgactttgaacagaagaagcgtgaagaagaggcacgactccttgaaactggaactggccccttacatgatgagaaagatgaatccctgtgtctgtcttcttcctgcgaaggggctgcaggcaccccgaggcctgctggagaaccggcctgggttactcagtttgtgcagaagaaagaagagagggacctggtggaccgactaaaggtgagacctggggtatccggaagtgggagtactggaggaaacagggcttcagcgattgttctggggcgattccgagactcaggcagtgcatgctcccctgccgttgccgtgcctctcagctcttccctcagctccttgggtctatggtgctgccgctgtgctgtcttttttgagctggaggtcagcaggccttctccacataaggaactgttggtgcccatttattactcacctgggaaaggacctgatcattgccattggcagcatggttcaatggctgcaaatggatctgatggagagcgtgtggctttgggaggagtgtgccgccttccgcagtgagcagcgaggctgggaccggcagggatgaggtcccgggaggggatgcggcagcccttgagtgctggccggggaaggagagatgcccccagtgaggaggcgccgggctgagtggcccagactccttaggagaggcctggttttgggcttccttggtgattttccttcatgtctgcctcctgtaggcggagcaggccaggaggaagcagcgagaagaacgcctgcagcagctgcagcacagggtgcagctcaagtatgcagccaagcgcctggtgagcctcatttcttggggggcaggattatgtccaggcagggttgctctgcttggaggctcatgggtgcgtggtcagggccttggtctcccctccgtgaccctcactggctatgtgctcccgtacagaagctgggctgtgagtggttgaggcgtggatcctaggagtcgacctctctccagccaggcagccaggcctatgtgaatggggcgtggtgtgctttgtctctggcatgtggggaggtgggtactggtgctgagacttcttcctccctcaccacctccactacccctgtccagaggcaggaagaagaagaaagagagaatctcctccgcctcagcagggagatgctagagacaggcccggaggctgagcggctggagcagctggagtctggggaggaggagctggtcctcgccgaatacgagagtgatgaggagaaaaaggtggcgagcaggtgagacagaggcggtagcactaccctgccccaggccaggggacacccttgaagacagctctttccctcatgccacagatgccatgaagcacctggcaagaggcatggtggcctctgccctctgctctaagccgggtccttcctagggtccatgagtgccagtggcagtgaggacagtcaccggcctggcctgtgtcctctcagctgtcctcacggcagctcaggcagggcaggaacatttgtgtctgcgccttatacacaaggaggctgcagccccacaaggagagactccttggctgaggccacaagcctcggcagtggagagctgggctagaactcagctggcctggctctagatctcaggctctgaggcagctgactgcactgggtaacctgtgaggtgccaaccatcaaggcgtccttagcctgagctttccttctcccataaagcctctgttggtccagactcaaggtttccacttgatgagccatgagctgctgggtgacttagccctgagcaggccacccaggccatttcgggcccacaggatccctggtcacagccctgttcccattcacactggaacctcaccaccatccctgagtgtctgctctgagtatggcactgtccagatgctgtggacatagaagggaagaagacatggaggggacagttaatagacatgaaaacaaatagcacctatgtgaagtcagcatgtttgcctacaaggaaaacaaaatggtgatgtggatggggtggggggctgcacctgatgatgagtcccgtgtgtcctgtgacatcctggccaccacatctgtcggagggtaactgcaagaccagagaccctccatggatattcctgaaggttcatccccggccttcacagtctgtctgcagggcgccttctgatgccacctccagccgccatccaccagacgccagcttccccgctgccctgaacttcctccagcgcaccaggccttcctctgtcctgtctgaggatttgctcatgcaacgtgctgtggccaaacaccctgccctcctcccttggcagatgtcttcctctcctttaaggcctggctcaggtgtcgtcttggtggcttcgggtgtcagctgctctgttttgctcatgcacctgcttgtgcttctgttgttgcctcctctccctggctgggctcgagctgcttcagggcaggaaccacgtctttatagtttgatgttcccagagctgacccagtgtttggcataggggtgtgctcaataaaatcgagttgacatgaatgagcagatgctgcctcgttgcagtctggtagtgtaattccaggctgcgcatgtgaacttcgacttctgcccctgcccagggcagagaccaccgtgttgctttatgcctcgctggtgagagggggtcataaacagtttgtgctccatgaacccttcctgcccgcctccgaggtcatgtttctgctccctctcttctcccttagagcccgtggggacaaggcagagaacttgagtggagatggaggtggtgaatattaaaggaacaaagtgctccttcaggtctgggcaagagccatggatcctgtaggtcagcttctggggcttcccatgccctcacgtttcaggagataacgtgagcctcggaggacctgagttctgaatagaaaatttttgctcttcatttcttcacacacccagcctctcagtgagctcctgctggctttgtccagcatgcgacataagattgaatccaagccttttaagatagagccgcctgctctttagtgaccatgaagccaagcctgtaataattactcttctgatagcccaagacaattgtattctgttttgttagaaaggaatttcgaggtgaacaaaaatgttttctttttatgtgatgttgccataggtagcgtgtgcctgtcagatggttttgtgttttctgaggagcatagactagtagagctagctcagcttcaggccatgggatgcagggctggcttccctgccaacgcctggcgctgatggattcttcccgcattgctgggaagggcagactgaggcactgacacaagaagagttgtagctggtcataagtgacagcatcctctgttcactcgattggtcagttgtagcttcatccaggagatggtcatggggttcctgctgcataccaagctctaggtgaggccacggggactcagcagaaacaaggccgacctgggtcctcccttgtggacatgacagtctggggagatagaccgagaggaagcgattttgaatgagatgggtgtgaagagcaggggccatgaatctgtgtcagagcagccaggcctaccagggaaggtcaaagaaggcttcctggaggaggtgatgtttctgctgctatctcagagttgactgggagctggtgaggggagacaacattccaggcacagaacatccgaaggcctgagatgatgaagagcaaatatccgccctggggcctcagaggggtccagcttgctggagggagggcagagaggagagcagcctgccatgagtcccgaggcttccgactcaagacttgggttgggggtgctgagcccctttctcctttttacatttccctacccacagacctgagcggccatgggaggttggggttggcatttgcctgggggagtttctgagcgagcagcacctgctaccttggtggaacccattgctgggaatggccagggctcagcaccagcgctcagcagatgctcagtgcgttttgctgagtttgctgagggaagactgttttctgttctctctcacacacacagagtggatgaggatgaggatgacctggaggaagaacacataactaaggtaacacaagtgtcctcagctggtgctgtgctgggggtataggctgggctgtgcacccctggggaggaggctggagtcacttggctacttctcaccctcctctccacaaaggaggagcttccagcacttggactccgttgcttcttgcacacaaccctggtcctaagttgctcccttggccagctgcagtggaccctggagtcctctcctggggtcagggcctggggagtcctctcctggggagacctttcctgggaacagggacctgaggagacctctcttgagtttggggcctggggagacatctcctgggttcggggcctggggagacctctcctgggggcagggccatgcttgccaccccagggcatcgaggaacagctgttctgggctgaaatctgggtgttttctgtccctgctgggtggtacgggtaggacagacatgagtcccctgccctttgggtctctcatggtgtgcttctccctttgtctgtgttcccatttgcatggagggctatgggttgtgtatggtctgacatttcccatttggtttcattgatttatgacttgttttctgtcggaagtaggtattttctttgtattttctttttttctcccttcactcttgccttagaggagtagagagagggtattctggtcagccttcctttttccctttggggatgtgtgtgacacactccctcccctcccaccaacaacccaccctccccaagtggggaccctttgccacgggagatggtcacccatgtccaaagattggccaaccccccaaaagcggttgattagaggctggatatgactcgtggaaggagctgcctttggggcattcccttgaacttctggagctgtgggtgacttgggaatccctgggtccctcgatagatgcctgacatgggacattgctgtcctgcctcggctttgtgcattgggagccactccctttccctcagcctctcaggccctggcgtgccttgatgttagagaatgctgtgggatgttttggttctctctttgaagcgcctttctttctctctgctagatttattactgtagtcggacacactcccagctggcccagtttgtgcatgaggtgaagaagagcccctttggcaaggatgttcggctggtctcccttggctcccggcaggtaaacagtagccagtatttccaccaggggccatcctgctcctttcgccacaactttgtcctgctcgtccaggccttgggagacgctgggtctgtgacaggctgaaccgtgtgaggagcagccccctccctgacctggccggcccagcactggaaggcaaaggagaggtggcggggcaggtccacgtgtgttggtaggatgtcatttagctggcaccatctttttgcctctttctttctcctttgctgcagaacctttgtgtaaatgaagacgtgaaaagcctaggttctgtgcagcttatcaacgaccgctgtgtggacatgcagagaagcaggcacggtagccactgggaccatggtgtagccgcaggtggtctggagagagtgaggcaggggtggcagtgactgaagaccattaagtgtctttcatagaaagaatggcagaggagaccccagttccttcctgagtcccctctccttgggaaaaagtgttcctactctctgggtcagtgtctggtccgaatccttggcttggagatgattttacgggctctttctggagaacagaagtaaaaccttacagtgttccgatgagaccacagtaggcagtacttgggagggtcttatagaccctaccccatggaagtgggtctcaacattacacaaccccctcttgggcccgtggacagttgctgtcctctctgttttctctctttgtgcctgtgccaccctcagagaagaagaaaggagctgaggaggagaagccaaagaggaggaggcaggagaagcaggcagcctgccccttctacaaccacgagcagatgggccttctccgggatgaggccctggcagaggtgaaggacatggagcagctgctggcccttgggaaggaggcccgggcctgtccctattacgggagccgccttgccatccctgcagcccaggtgagggccctgcagggccagaaagccgctcttgactctcactgtggtctaggccatgaggggggtcctcatcacactgtagtttgggggatgccccccaccgtggtcaggttgatggcaccttaacccattctctcctgatgtgtgagttggaggaggcgcgtgggatcccttggggtctccaggcagcagggccagttggcattactggggatggtatttaggagccaggaaagccggtgcattcctagtgaaaccacagggagaggggggatgccaggagctgagaagagtgtgctgcatacatctatttacaaatggctttccaagtgatgctcccaacttccatgcctatgatgtgatggaggatgtcagtgatagaaccattcagttttccagtttttcctttttgtaatatcagtactcttaactggaaagctttccctaacttacacctacctgcagcacgtgagaatactgtcttctctgcctcaacttctcttgatttttaaacagaaggaagaactgctaatgtagcagatcaaaagtagtatctcactgttatttggtgggtgcagtttcactatttccttgctacttctttaatttgagtgactttggaaacgggatatcactagtggaaaattctgtataatccagaaaaaaatgtaaggttttaaaagattcagggaactaagtaaccatttgcacagcagctaaatgctcaccagcatacctgctgagctgtgtgggcactggcagagaaactgaggaaagctgccaggccccatggtgtcccaggccttccctcccgtctgtttgcctttagagcaagattagtgctataggcatttatacacaaataccataatatggcccaaaatctttacaatttttgaatttttaaagtactttgaccatattttgcttttatgttaatagtattccagtgaaattctgtgcatggggacactggagcccagaaaagttaagtgactcatattttctcaccaagcgtgggtgatggagccattcagttttccgatattttattttttatatgagtattcctttaactggaaactttcctaacaacaaacacctaaagatgtgcagagttgcttttatttttgttaccccagctccacgccttaaccctcactttgaaataggatgtatcaaccctattttgcagatgaggaaagcaagagtcagagaggttagacaactcttccagagtcacacagctggggagtagcagctccaggagtagaagctggggccgcttcctggtgcaccgatggtctgcaggtgtttgtggaaactcgggggcctccggggcgaccttgaggacatggacaaggctaagcaggggttcccttcacccagccctgcccttggtttactcaggagtcagaccagccctagtttcctgtgtttcatgtattggcttttcatgtgaaactcgaggagagcttgtccgttgccacaagctgtttttcgaatgtctctacacagtccaggcaggaaatagaagcactcacatcaggagctcagtgtcaggcaggcaaggctcctgcaggggagccccgccctgctcaggtggcctcatctcccctcccagctggtggtgctgccctatcagatgctgctgcatgcggccactcggcaggccgcgggcatccggctgcaggaccaggtggtgatcatcgacgaggcgcacaacctgatcgacaccatcacgggcatgcacagcgtggaggtcagcggctcccaggtgtgtgggcctcccctccccgggccagggcctgctgtgacgtaaagggacttggatggttcctccagacacctgggccaagagttcctccggaggtggggcttgatagagggtgcacgagtcaaggcggtgacctcatcggaggctgaccatggctttccagtgcatcgggggaccccgctatgacagagtgcctcatttccctgcacctcatctgcccccatgctcctgagtccctccagccctggatgccagcagccagttctgtaagccagggagatggcatgtgtgaggcagaagtcccctcaggattggattttgtcattactgaagttgtctggaggggactgaattgaggaatgctcaagatcagcgcaggctcctcctgctgccctatcatgcgccatgcatggcaccaggtgtctctggtcttcacgctgactctgccatgggtgtggtgttcctgttttacattggaaacttggagattcaaagatggtcaagctctgtcctgaggtcatgcagctcatgagtgtggagctggggtgtgcccactggtttctgactgtgaaaacccccacgacatcccaccagctctactgacctgtgcctgggctgaattgaggctgggatgtgatggtggccttgaaccatcactctttgtagactccaggtcttttcccaacccggtggaaacttagcagggagattccatacttgaggaattcagcctcttgctttttctctgacccacagtggacactggaggaaaacttcccttccttcccttttctcttagctcccaccagcctaagggctgtggaaacccgtaccttttgtctgcagccagccccctctcctccctttggtggcttcctgtgtgtccagggccagcatcttctaggtgaatctaagatgtcagtaccttagccctcagctgcttgctcagagcctggtttgtgttctttccccagctctgccaggcccattcccagctgctgcagtacgtggagcgatacgggtgagatgtgaccctctgaggtagtgggacagtcccttggtggccccctgcgtgggcctctgagaggcaggcagcactttggttcccacctctggcccgggctgtggcggggtggagctgcatgccattcatgtcctaggcacatcatggtgtgtgctgcacacagacctggaaggctggggactgaccgctggctctgaggcctggggccgtggccagcctgctctctgggaaaggatttgtagcttgtgacccagtttgagaggcaccgggcagcaaggcttccactggggtgggcggggcgagtcgccatcagggcaccaccacttaatgtccgttggcttcttctcaggaagcgtttgaaggccaagaacctgatgtacctgaagcagatcctgtatttgctggagaaattcgtggctgtgctagggggtgagagcctcgtccccctgctgaccccgggcctgcaaaactcgctgggctgctttttccttggatgcccatcaggacacctcagttctctgtgtttttaagaagggtcggccgggtgcggtggctcacgcctgtaatcccagcacttgggaggccgaggcaggtggttcacctgaggttaggagttttgagaccagcctggccaacatggtgaaatcccatctctactaaaaatacaaaaaaattagctgggagtgttgccgtggcctgtagtcccagctgctccagaggctgagacaagagaattgcttgctcaaacccgggaggcggaggttgcagtgagccgagattgtgccactgcagtccagtctgggcgacagagtgagaatcagtctcaaaaaaaaaaaaaaaaaaaaaaaagaagggtcttggtcattgatttagaaaattcttgttctttgtagcttagttgagttgtctgacttgagctttatttagacccatgggttctttgcccatgttctgaggactttttatttcaggccctgctctggggggatattaaggatacagcatcacatagacacacggtgtttccgtgataggcatagttctgtgggttgttcgaagcacttgcatatgcggttttgtgtgccctgtgagaacgcagtgctggtatttgaatccttgttgatagacgcataaactagagctcggagcaagggctgctcccagcacgggagcctgggatcttctgactccagctcccacgcctctttgcatgaccctgtcacgtccccttcttttatgatggggcacccccttggaaggcgtctgtggaagtggaagctgcagaaagcctgtgggagctcctggcgggagctggtctcgtgttgctgctctgagccaccagctctgctttgcctcaggctcaccagtggcctgggcagctcctctgtgctccggtgccctgcataccttggtctggctgctgtgtcccggcctcctggagaaggggtgaaaaacatgaacttacagggctttgggttccacgtgcaagcacgtgagtcagacatgggaggctcctggacccacctgccctctcagtgggtccgttgcatgctataaacagtgaaaagcaaaacaaagccatttaaatacagatgctcttcttacttgatgtgcagtgtggagggagagaagatagggaagggttgggggtcctgagaaccagcattgtgacctatttccattctcttttttagggaacattaagcaaaatcccaatacacagagtctgtcacagacaggtaagagagttgccctcagagggcccagagctgatctgagccacttccgagcttaaccctgggactgaaacctgaggcttagggtgaagctcccaaggcccttcatgtgtttgttctcagggacggagctgaagaccatcaacgactttctcttccagagccagatcgacaacatcaacctgttcaaggtagaggtttccacctttccacattccacatccaatttccttcctgtcaccacctgtgggtaaagtactatgttaagactgtagaaggaagaaaaagcaaaacagatgtgtaattacttaacccttaacgcaacatgcctgtgagacaaaagtcatcttcttttagagtgaaggccacagggatgagggatgggtgagaaagggacctttcttggtgccccatagaacagatagagactccaggtccttgctctctcactccgtcttctggcacagtctccctcaggcttatggacaggaataggacgttgatttgttctgtgcaacccctgtcacgtcttcccacttgggccttgggtctggttgcagcctcagacctctgctcactccaggtctgtgtacccagcgctccccagatgaaacacggccactgccgcctgaaccccaagctcgtaactcaaatcagcaacagtgactgcccccgggtacagggttctgcctctgttgtaggcggcatgccatgtgctgtgctctgagctaggatatccttttgccccagcaaggaaagcaaacaggcccgtggaggtgacttcaggagggtggcgagcacaggcttcccacaagtgagccaatagcaagtggcagagacagcgtccaaacctggctgcactgacttggggccccacattcttcccatcctgcctgccttttttttcttaaaaccagcttttcccctgaattacacatttgggtcactgtcactgccgccatccctgccagacaggctggatccaggtcatccttgatgcctttctccccttgtctcccacatgcctgtgacagccgccaggcctgacagcctgagacagtcctgccgtccctgcgcttctcccacagctgggacatgggtgcaggcactccttctctcgccttccctttgccctccttgctttccttctcccctcttcttcccatgggtctcgggtctcatcactcaccattgagggaatcctcatcgaaggacgtcgctctttttagaaaccggtttaaaggctccaaactcctcatctctgcatcccaagctaagatctggcaccaaaccacacacattggatgcaccgactgagtggcactgccccagcccctgagcaggtcccagccatcatctcctctgtggctttgctcatagaagttccttttttttttttaactctttgtcacctggaaggaaagccaaggggaactggattttactgagcactcttagacttgagagagacatttggaaagagggtctccaccctgaggaggacactgcgttgtgggcaggggcagtagaggagggggtggcctcggagaggagatgacaaggttggtggcaaggaggctccaggtgcctcagaaggtagcactgcgttgtgctgcctgggtggtagaagtggtgttttttgttttgtttttaagattatagcttgctcagtttgcactcatgcctacagctgggcttggtttttgcaggtgcagcgatactgtgagaagagcatgatcagcagaaaggtaactgctcccatcttgtggtcctgaacaagacccagctgtgccccaaccccctgcccttgccatgctttcctcccctgccctcagggaactccagagtccccttcgtctccactctccttggtgcagtgggccttgctggggtggtgggatgtgtgctgcaggtgtcttgggcctggcagagcctccgatccacccagcctctctctcatggctgtacctcgttcctctccactgctctctctcatcccacccagctctttggattcactgaacggtacggagcagtgttctcatcccgggagcagcccaaactggctgggtttcagcaattcctgcagagcctgcagcccaggacgactgaaggtgaggcaggagggtgggcaggcagagccggctgcacgcatgggcaaggacttctgttcctcatgtgtggacctgaccagagggaggcctcctccccgttctgctctgtgcagctcttgcagcccctgcagacgagagtcaggccagcaccctgcgaccagcttctccactgatgcacatccaaggcttcctggcagctctcactacggccaaccaggacggcagggtcatcctgagccgccaaggtaatcaggtggttcttggccaggttcagttcccaggaaggagccaagctgagcccgggagccgcagcgtgaaaggattctttccttccatcctgggaacttcctgggttaggaggaagcagtgcagtgggcactggcctgctgtgacctgggcaagcagtggaggtggatgggaggagatcgaagggctgggatgggggtcccgtgaccagggtaagcagtggaggtggacgggaggagatcgaggagctgggatgggggtcctctagggcaggggtcctagggaaacttctactgtggggtaggtgggctttggtttgggtcatgattttgtcatctatgagccttgtgatttggactattttctttctcaacttcagtttcttcatatgaaaatggagaggataggccgggcgcggtggctcacgcctataatcccagcactttgggaggctgagggggggcggatcgtgagttcaggagatcgagaccatcctggctaacacagtgaaaccccgtctctactaaaaatacaaaaaattagcagggtgtggtggtgggtgcctgtagtcccagctactcgggaggctgaggcaggaaaattgcttgaacccaggaggcggaggttgcagggagccgagattgagccactgcactccagcctgggcaacagatcgagactccatctcaaaaaaaaaaaaaaaaaaggatggagaggacagtgtggtccacctctgtgggctggttgtcctagagattaaatggtgtttaatttaaagagaaagcactagcacttgtgcctcagacctggactcacctgggggaccccctttgctgggacgacagaagtgtctgttgggcttgcactcacctcccaccgatctgtttttccaggcagcctcagtcagagcaccctgaagtttttgctcctgaatccagctgtgcactttgcccaagtggtgaaggaatgccgggcagtggtcattgcggggggtaccatgcagccggtaaggacacctttcccagcccctcgtgccccaggtgttgggatgagatgggggcttgggagagatgcattatcagtcctgttctctcctggggccccaagccagaaagggtcagctcgagcaggcccagtggtgtccgctgggtgacactgctattctctcactgctgtgccttttaggctgcaggagcagtggagactcctctgctgctccattctgtagccccaggatcacatgtctcccagagaaagctgttctgtggtttcaaactcaaggaaaaaaatcatgattccacttttaaaaggttcattttgatgtatatgaatataatagtctttgtaggcgtaatttttacttatgtgcatagctgttttaaaaacaaaagtacggctccctccatgtgctgtcactggaacttgctcttttcactcagcagccagagggtcataaaccctgtctccttgtcagcaagcatgcacgtatttcagtatcccagctgtgctggattccagttacacagatatatagcatttcatgtagctgcttctctcttgttaggtgtgcaagctatttgcagttttctgttttgagcatgactgtgataaatataaccgcatttctgcacagtggtgactcctacctagcgaagggcctcctggacaaaaagctgctgggaatcctgaagcagtgcttcccagccccagctgccttagcttttgatttttatatttttgtatggatagattcatagttttattcattcggcatattaaaagttgtttacagtaattattgtttctgacgttcacattgtgagagccccttcctgctagctcaggtcctccccgtggcccggtcagtctcgcctccagcacagcagaatgtcatgggatcaccatgggtgtcctttccccacactggattgattcatttctccaagctgctctggtttcttgtaatggggaatgacatttagaagtcaagctgtgggtgctagggtgtttgtcgtgctcctggggcgttttggtagacagatctaggaaatgttttcagaatgaatccatactggtatttctttctttctttctttttttttttttttttttttgagacacagtctcgctctgtctcccaggctggagcgcagtgacctgatcacggctctctgcaacctctgcctccggggttcaagcgattctcatgcctcaacctcctgagtagctgtgattacaggcatgtgccaccacacccagctaatttttgtattttagtagagatggggttttaccatgttggccaggctggtcttgaaatcaggtgatccgccagccttggcatcccaaagagctgggattacaggcatgagccaccacgcctggcccatattggtgtttctaagtaaaaatcaaaggatttgtttacttgaccttttattgtacctctttttctcttaagcctgaacatgtgtgctacattaacatacttatctgctctatcctataatatacttaaaagttttgaaatcatagtaccaatattacttctaacaatagatctgattgaaattgcctttcctctttgcctttagagtgtaacccactaaggatgcctggtcactaggctctaaagtcacgtggaaccaggcttctctccgtgtgcttctgttgtcagtttcatagataactaggctgtttttgtttcattttcttttcaattttagaatttgcttttttcttttctgacttgtagtttttaaatatgtaaatatttgtatggctcaaaagtcaaagcaatataaaaagatctattcaggaaagcctcactctcatccctttccagcccattccccacccccatagggaatccgttttactagcttatcctttcagtctttctttttcccctaaataagcaaaaacgtgtcttcatttttccctttcctgttttatttacacagaaggcatcttagtcagttgtctgaccatcgctcctctagtgggctgcgtggttctctgttggacagatgtagggagcttatccaaccagtaccctctggataggcaggcgcatgattacagggaaaggtccgggggcacatgctgtttggtatttgtgggctgtatcttctcactggactcctaaatatgggattcctgggttaaaaagtataaatatgtttaatttgttaactactgtgaaatttcatgagaattgtaccattctgtatcccaccagtactgtctaggaatgcctgtttctccagagtggttacttttggatttttgccagtctaacaggtgaaagcctggagattcttattcagtagtttgggctggggcctggccatgtgtatttttgaaaattttcgctggtgattttgctgcatggccagggttgataatgactgtgccagatttgctggatttcctttgctgttcctgcacatagtttaaacgagactgccagcactgggtatcagtcaccatttttctttttgttagtttgccatcagccttttctttgacctcttctttcagtttgtgtgtacttgctgtctcttagcccagacttctcgcttcctttctgctgggcctctgaggggtcatggggccgtgacgctgtggccttggtctacaggtgtctgacttccggcagcagctgctggcctgtgccggggtggaagctgagcgcgtggtggagttttcctgtggtgagaagctgtgcccagggtggggcaggctagaggtcaggttctggcccccgttttctgtgggtaatacctcatactgcgaccaggcacaggggcggaggagaccccggggtgggagcctcacccttcgtgcgctcgcccaggctctcctgctttgctccctgctgcctgctgcccagtgtgactggtgatggtgggcgggtgagcgctgtcagtcgctgttcctgtgctggatgatggggcagggaaatgccctctctgcagtgtcttgcagcacacctgcatctccagttttcggcccctccctggctcttaccaggtcacgtgatccctccagacaacatcctgcccctcgtcatctgcagcgggatctccaaccagccgctggaattcacgttccagaaaagagagctgcctcagatggtcagtcccagccagctcgccgcaccacagcctggcctcaggcagcaaagggttttctggggcaggggcgctctggcccaccctgagtgttttcagtgttggggaaattgcacagggacacccgcttagagccacacagaatgagcggcgtcgatctagatgcttatggaggaaggtctgagcttccccgcccctcacgccttaggctgcgaaatatgtattcataaaacctccaggcatcctctgaggacgcctcacacaggagaaagctgctagttccctttggctctcttgccctttggttatatctgcccctgccgggggtagggatgtggggcttgggggcatctcctgtggtgtgcctggggtgtgcagcccctgattgtcgttgtggtgcccatcaggaccctggacagaagaagggaggactcagtgccagggcaatagggaggccccctagggacgctagtgctgtgacatgtgtcagaaaggcgcagtcagcagcagcggctgggtgtgtttggtgggaggtggcacctaccaccccgtggttcccacccaggggagccaagtcctcttccttggctgtagtcctgccgagggtctctcctcagttttgagtctcaaggtgaagacgcggtttgtgggtggctgaggggttgctccatgggggctccctccctccctcctttccttccttagatggacgaggtgggtcgcattctctgtaacctgtgcggtgtggttcctggaggggtggtctgtttcttcccctcctacgagtacctgcgccaggtccatgcccactgggagaagggtggcctgctgggccgtctggctgccaggaagaaggtgagtggcctgtcggcagccttcccacttgtgaggacagtgccactgagtcctcctgggagctctcgtgctcatcgggtcaggacaggcttctggctcctcatccccaccgctcccagtccctgactacagaggatttcccccaaagtccctggctgtgaggttctccagtcccctggccagaaaacacaaggccacgagcagactcgagacctggcaccctgaacctgtctctgggaaatgtcctctgtctttctcagatattccaggaacctaagagcgcacaccaggtggagcaggtgctgctggcatattccaggtgcatccaggtgcgggcgtcatgctgggcttgggtctgagatcgtgtgggggtggcagctggaaacgttgtgggtgtcatccaagttttggctcagcaactcagcgtctgggtttctcctacaggcctgtggccaggagagaggccaggtgacaggggccctgctcctctctgtggttggaggaaagatgagtgaagggatcaacttctctgacaacctaggccggtaagtagtggttctgctcgtctcctgggccgtgatacatggccggccctcactcccagcagctgggcccctgcctgctctctgctgccattagagcccacagctgggctgcgactgctcagaccagccagctggagggaggggctcagcagctctgggtttggtcctgggagagcagttggattttaggctacccattgctgtatcaggacccagtcaattggcctagacgggatctctcagccgaacaagccctctccaggtggtaggtacagagtggagagaggctgagttttgatcacagtcggagaggctgagggaaggggtagaacggagcagctggtgacgtgggtgatgacccgggaggtcctgacgtccacctgctgggctcttgtctcccccgcccaggtgtgtggtgatggtgggcatgcccttccccaacatcaggtctgcagagctgcaggagaagatggcctacttggatcaaaccctcgtgagtgaccccagtgtcacagagggtgacaggagagtaggcagtgggtgggagtggcatcacccccagggctgatacagccaggccttccccgctgcgctggcgtctcctgccccctccggaagcttggatgcccctccacaccctcttgatcttccctgtgatgtcacctggacccctgctgctggcattggccacgaagcctcctggtctggctccaaagcctggcagggtcttttcccagggggagctgcaggcagggaacagtcctgatgggtcttccccttcactcccagcccagagcccccggccaggcacccccagggaaggctctggtggagaacctgtgcatgaaggccgtcaaccagtccataggtgagcctggctgcctccagctgggtggacagatgggggctggagaaagggagaacaggaaagaggggttgcctgccctgtttcctatataagtctgaggaaggggagggggtcgccgtgggaatgtgctgtaggggggaggcaggtgttgctcggagccccagcctctgttcctatgcaggcagggccatcaggcaccagaaggattttgccagcgtagtgctcctggaccagcgatatgcccggccccctgtcctggccaagctgccggcctggatccgagcccgtgtggaggtcaaagctacctttggccccgccattgctgctgtgcagaaggtcagtcctacctttttctttctgagagcctccccaccccgagatcacatttctcactgccttctgtctgcccagtttcaccgggagaagtcggcctcttcctgatgggcaaccacaccactgcctggcgccgtgcccttcctttgtcctgcccgctggagacagtgtttgtcgtgggcgtggtctgcggggatcctgttacaaaggtgaaacccaggaggagagtgtggagtccagagtgctgccaggacccaggcacaggcgttagctcccgtaggagaaaatgggggaatcctgaatgaacagtgggtcctggctgtccttggggcgttccagggcagctcccctcctggaatagaatctttctttccatcctgcatggctgagagccaggcttccttcctggtctccgcaggaggctgtggcagctgtggcatccactgtggcatctccgtcctgcccaccttcttaagaggcgagatggagcaggcccatctgcctctgccctttctagccaaggttatagctgccctggactgctcactctctggtctcaatttaaaatgatccatggccacagggctcctgcccaggggcttgtcaccttcccctcctccttcctgagtcactccttcagtagaaggccctgctccctatcctgtcccacagccctgcctggatttgtatccttggcttcgtgccagttcctccaagtctatggcacctccctccctctcaaccacttgagcaaactccaagacaccttctaccccaacaccagcaattatgccaagggccgttaggctctcaacatgactatagagaccccgtgtcatcacggagacctttgttcctgtgggaaaatatccctcccacctgcaacagctgcccctgctgactgcgcctgtcttctccctctgaccccagagaaaggggctgtggtcagctgggatcttctgccaccatcagggacaaacgggggcaggaggaaagtcactgatgcccagatgtttgcatcctgcacagctataggtccttaaataaaagtgtgctgttggtt

SEQ ID NO: 530 - DNA, 30948 bp, Homo sapiens; identical to SEQ ID NO: 529

SEQ ID NO: 531 - DNA, 30948 bp, Homo sapiens; identical to SEQ ID NO: 529

SEQ ID NO: 532 - DNA, 30948 bp, Homo sapiens; identical to SEQ ID NO: 529

SEQ ID NO: 533 - DNA, 30948 bp, Homo sapiens; identical to SEQ ID NO: 529

SEQ ID NO: 534 - DNA, 53086 bp, Homo sapiens
taaaggcttaaacacaatggaagtttatttctcaataacggaaagtccaaatccatgatgctttaagtcagggacccaggttcctcccatcgatgcctcccaatctgccattgctaacctggggcttccacgatggtcacactccttggaagtgagaagagcagacagaggacatgtgggaggtttgagggacaggcctggaagcagcatgtgtcactccagtgcagagtccattggcctgcgccggctccaatggctacctctcactgcaggggcagcggggaaatacagcctggctgtctacccaggaggaagagtagccagtttctgccacagtgataaggttagaaaatgttcagtcgggtgtggagtgattatttctcctgtgtacacagcaggtggagaggggaaggtgccctagatattggacaagaaaactaaagtcattggaagtttgtcttttgctctaaacttaaggccttggctctctcatttgtaaatcaggctcttggtgaatttggttagcatgaattcattctccagcaccaacttattccaaagtgagctagacttgatgagcttctccagactaagcacgagatcttcagctcatgagtctatcacgtgcagtcttctgagtcccagctgcatcccccagctcaccttcttcatttcttggtatgaaaataaatctgattagagagtccactgaaaacaacgtcctccacagtagcagcttcagttggaagagatctttgtacacatctagtctgatccctgccccattagaggtcccataagtgatgatctaagccagcagtgagcttatcacctcaaaatttattctctttgggatagatctaattgtgaaaatctgtttttctttatatactgagctgaaatttttcagtttgtaagttcatttctctagagctacacagggtaaatgtacttcagccacaggaaaaccttttgaaacattacacttgcaggaattataaacaaaatgtaaacattccttacaatgaatttctccttttcttaaccatgtaaggactgttcaatttaagacaagaatatgattgagtgacttttgtattgtaggcagaggaatgaggctgactggaacaagagctgagcttgtcttttaatcttctattacacggtgactatcaggagctgtgaaggttctgaaatttgaccttatttgcaaagttaacaagtgagtctgccatagtttcaggatgctggcagaagatgtgagattcctgggttagagataaagggtggttaattactcatagcaatagcagtagcctgagcaccatcattttcttgtgctggttccccaagtcccaattcatgggagacaagcagagccaggtgacaactccatatacagggtgtgttacaggagaggagccctgagtttaggaaaccccaatcttttattatgggccataagtaaacctgctgagctttgcctaggggaaaacatgatctttattgtaccgaacagcaaacaaaccagtcatttcctccggagggagacactacctctgttttccaaggctgatctcatgcaaacatccttgaaaagattatccagagcaaagacagccagctctgctgcttgtaatatgtgcagaaacaagaggcccctggagaaatgtctcccattagcattcacgtttgacttcatttcaactctttcataaaatatgcaaatcacctaaacctgtgcacttatttttctaaacctcccaccaaaccaaaattccatgctaaaagatacaggagctattacagaaaaaggaaaagggaaggtgggagctacattatctcattatttccctactcaattttatttacaagtttctctattcttttcattcacatccaagagagtgcttttcctccaaataatgcagatagaagaaactgattggtagcaatgcatgaattcaactgaaactttatatagattatataaaaactggaagctttggtggagggatcatgacagacgagaggcaggactagattgcagctccaaacagagcagcatgcgaaggcttgcattgtgaattttagctccagattgactgcaagaacagactagcaatcctgagaggacccacagaccctctgaaagaagcagactgctcctgtaggacccaggagaccctcaaatactgtgagtgccccaatgtggaagtgggaaagggagaccctcctctcccgaacacacacccctcactggagaagtttctgactttacctggaggtgagtcaagttagagagctgagccaagcaaaatacaagggtagaggaagcagcagaaaggcgctgggagctcgctggatacccaagcagcccattcctgcctggtaccacagggatccatcaggagggtggcagaggagcaggagataaaactccataggaaggaggacttctctagctgaactttgttacaatttgcacggggcaagaagcctcctggccagaactcggggaagggcgtgaatccggcttgcagacttcacagacgggggaagaactaaagcccttttctttggcagctgggaggtggaaagcctggggcaagttttcaagtccgacttgccctccacccggaaacagactcagggctgttcgtggtggggcatggtgggagtgagaccaacccttcagtttgttctagggcccctgcccaccactggtcccttgccacactagtacagctgatgctttctggaaaatgccacctcttggcagaaggccaaccatcacaaaaatagagtattaaatccccaaagctaaggtccttcacagagtccactgcaccctccgccacctccactgaaacaggcgctggtatccacggctgagaaacccatacatggttcacatcacaggactctgtgcagacaacccccagtgccagcccggagctgggtagactcactgagtggctagacccagaagagaggaaacaatcactgcagttcagctcacaggaagccacatccacaggaaaagagggagagtactacatcaagggaacaccctgtgggacaaaaaagtctgaacaataaccatcagccctagactttccctctgacacaggctacccaaatgagaaggaaccagaaaaacaaccctggtaatatgaaaaaacaaggctgatcaacccccctccaaaattcccactagttcagcagcaatggatccaaaccaagaagaaatccctgatttacctgaaaaagaattcaggaagttagttattaagctaatcaaggagagaccagagaaaggcgaaggccaatgtaaggaaatccaaaaaatgatacaagaagtgaagggagaaatattcaaggaaatagatagcttaaagaaaaaacaataaaaaaaattcaggaaactttggacacacttttagaaatgcaaaatgctctggaacatctcagcaatagaattgaacaagtagaagaaagaaattcagagctcgaagacaaggtatttaaattaacccaatccatcaaagacaaagaaatagaataagtaaatatgaacaaagcctccaagaccgcctggtattatgttaaatgaccaaacctaagaataatcagtgttcctgaggaagaagacaattttaaatgcttgggaaacatatttgagggaataattgaggaaaacttccctggcctttctagagacctagacatgcaaatacaagaagcacaaatttgggaaattcattgcaaaaagatcttcacctaaccacattgtcatcaggttacccaaagttaagatgaaggaaagaatcttaagagctatgagacagaagcaccaggtaacctaatctataaaggaaagcctatcagattaacagcagatttttcagcagaaaccctataagctaaaagggattgaggccctatcttcagcctccccaaacaattatcagccaagaattttgtatccagtgaaactaagcatcatacgtcaaggaaagatacagtcgttttcagacaaacaaatgctgagagaatttgtccttaccaagccatcactacaagaactgctaaaaggagctctaaatcttgaaacaaatcctggaaacacatcaaaacagaacctctttaaagcataaatcacaaaggccctataaaacaaaaatacaagttaaaaagcaaaaacaaaaaaacaaaaataaacaaagtaggcaggcaacaaagagcacgatgaatgcaacagtacctcacatttcaatactaacattgaatggaaatggcctaaatgctccacttaaaagatacagaaccacagaatgcataaaaactcaccaaccaactacctgctgccttcaggagactcatctaacacgaggactcacataaacttaaagtaaaggcgtggaaaaatgcatttcatgcaaatggacaccaaaagcaagcaggggttgctattcttatatcagacaaaacaaactttaaagcaacagcagttaaaggagacaaagagggacattatataatggtaaaaggccttgtccaataggaaaatatcacaatcctaaacatatatgaacctaacactggagctcccaaatttattaaacaattacaaacagacctaagaaatgagataaacagcaacacaataatagtgggggacttcaatactccactgacagcagtagacaggtcatcaagacagaaaatcaacaaagaaacaatggatttaaactgtatcttggaacaaatggacttaacagatctatacataacatttcatccaacgaccacagaatacacattctattcaacagcaatggaactttttccaagatagaccatatgataggtcataaaatgagcctcaataaatttaagaaaattgaaattatatcaagcactctctcagatcacagtggaataaaactggaaatcaaccccaaaaggtacctttgaaaccacgtaaatacatggcaattaaataacctactcctcaatgaacattgggtcaaaaatgaaaacaagatggaaatttaaaaattcttcgaactaaataacaataatgacacaacctatcaaaagctctgggatacagctaaggcggtgctaagaggaaagttcacagccctaaatgcctacatcaaaaagcccgaaagagcacaaacagacgatctaaggttacacgtcaaggaactagagaaacaaggacaaaccaaacccaaacccagaagaagaaaggaaataaccaagatcataccagaactaaatgaaattgaaataaacaacaacaacaaaaaatatctctactttgatgattttttttttttttttctgagatggagtcttgctctgtcacccaggctggggtgcagtggtgcgatctcggctcactgcaagctccgcctcccgggttcacgccattctcctgactcagcctcctgagtagctgggactacaggcgcccgccaccacgcctggcctcctttgatgattttaggtcgtatccctgggctatggattcctgttaatctgcccgaggcttgggctgccacacctgctttgcattttgtgaaacttcttctaacttagcttactcatcacgtccatagagccttaggcatgataatttttgctactgtttccttggtcacactaatgtcttctgttgtgatgtcctatgtagctttgcatattgctattcaaacagctcagtatgtggagaactggacacacacagccaaccaagcgtggctacttcagaatggaattaacactgagctacaaactgaagtggcagtgttgaaatccatggttctatggttaagggaacaagcacaaagcttgcagttgcagcagcaattgcattgtccttttaatcacactcatatttgtgtaaccaacttagaatacaaccgaagtgagtatccgtgggaccttgtgaaagcccatttgcagggagctttcacatccaacgtcacctttgatattggtgaattacaaaacaacattattaatttaaatgggcaaacataagactttcagccttctttagaagactggaccgaattccagcaaggcctggagagcctcaacccttggacctatctaaggcaccacattaacatcttatatgtaggtcctggaataatgttttgtctctgtcttctgttcatagtctgtaaaatcagatggaccatcaatcggaaaatgagagctgcccagtctggccttacattctttcaattaatacataaacacaaaggtgagatgttgggagccaaaaaggccaaagtgattgtgaccaactcaccattccactggaggctatatgatcaaacagcaaactgtttatcatgaatgcaggatgtgagcaaactcacattgtgcccgctgccaaaaggtttgctgagggcctcactccctggtgccgggctccttgaagttatctactgggaaatctagcacctattgttcaaagaatgcagtcttgcaagcctgctgtgaatctaaccgccagctgaaaaccagcccccgacttctcgctatctcttttgtctaataaatatggagggctgtgtaaagctcagggctcttgtccactagaggcaaggtgccccctgactccttcttctaaacatattctttcgtctttgtcttttattcctgcattcgcccccatttgttcagttcccccaaggtctgggcaggttacaaatcgccactaaagaacttactcatgtaaccaaataccacctgtaccccaataacttatggtaaaataaaataaaataataaaaattgaaaaaaaaactagaagttttatatgacaaaagataaaatgaaggactgcattagaagtcaggtgagagacttggataaaacatttgcgactttttaaatagaccaaagattaatatccaggctattgctcctaactgtcccccatctgcaaaaaaataccgacaagcccatagaaaaaggacagagaatctgaattagtaattcctaaaaagggaaatggaatgggctgataatctttgaagacgtgtttaacctcaagcattcagcaggtagaagcacatttagggaatgagatagcctcaatatattggtaaaaatgtaaaaggctgataatagctggccttggtgaggttagaaataagcactttcaatgtgagggatggtaatataaattgacacaacctttttggaggtcagcttcttagttgaatctcatgagaatgctactttaatatttctggtaatagtaaaatattggaaataatgtaagtagccatcaataggtagatagttaaatagactatgatatgtccatattataaaatatagctatacagctatttttctttttttcttacatttcctctgaccagctttaaaatatatatgtaaattccctttataatttattttattacaatttatttttttttttagagacaaggtctcgctctgttgcccagactgaagtacagtgacctaatcatagctcactgtcacctcaaactcctggtctcaaactgccttcccacctcagcctctaaaatagctgggattacaggtgctcaccaccatgtctggataatatttttatttttttgtagagttgggggagtctcacaatgttgcccaggctggtttcaaactcctggcttcaaacaattctctcacctcagcctcccaaagcactgagattatattaaataggtgtgagccaccacacctagcctatgcagctttaaaaagaatggagagtctatttatagattttaaaatatccccaagaaatgatactaattaataaaatgaagttgccaagcaatacttgtagtatgatcttattttttcttaagaaatccaaaacatattttttttttgagagactctgtcgcccaggctggagtacagtggcacaatctcggctcactgcaagctccgcctcccaggttcatgccattctcctgcctcagtctcctgagtagctgggactacaggcgcccaccaccatgcctggctaattttttgtatttttagtagagacggggtttcactgtgttagccaggatggcctcgatctcctgacctcgtgatctgcccgcctcggcctcccaaagtgctgggattacaggcgtgagccaccgtgcccggcctaagaaatccaaaacatatttctacatgtaaatgccaaggtatgtacacacatataacaggcacagaagattacacaccagccgccaatgttcactagctctgaggaggagtgtaacaagcccctcagggaccagcggtgtaactccagatgaagaaacaggtagaattttagaacaaccacatgggagagaaaagtaggattttcatgaaatcctcccatttttgcacagcacagaactaactggctttctgagactagggcttcctaatgacaaagagagagaaacatactgaaatcaagaaagagatcaaagatgattaagagaacacagtaattctggagattgaagaagccagcatacatattatagagatgctctagattctcggtgacctgggaattaaggtgtcacaaaacacctgctcaaggaagacttaccagaggttcccaaagtatggtcctggacaggtggtgtcatcgccaggaaagttagaaatgttataatgcaaattcacagaccctgacccagacttattgaatcagaaacttgggtgtggggcccagcaaggttttaacgagccttgcagggatttgatgttcacttaggtttgacaaacacaacttcagacgggtgcttctaaagttaaacacatgcgaatcacctgggagagtgtgaaacagcgcgttccgattcagcaggaaagccggggagcctgaggttccgcattctcacaaactcccaggtgatcctgctgctgctgcttctcagccgcacgctgagtcacttttgaaagaagatggagtgagcatttaatgactggaaggcttcacaaggaaatagtccaggaaaacacaaatagcagcatcagtttatctccactggcatttcgaagaataggagcaaaaaaaatgccgctctctttcagtggcgtgttgcctggtgttctgtggatgctttcaccaacagcaatatctgtgcatgtctataactgaaagctgcaagcattacttgctacccctaatttttgttaaccacttctctttgcagatgcagaagctgaggctagcacacagacctatttttgttccaatgtcacagaggccttggacagactgagttggcaagtctcctgactgcgtggctggagcgcttctgcagggcccttgaggctgttttcgtcaagccacagtgggaagtagtgacagagcacatgagattgacattgctgtggctcagtcatcaaaactggaccagctcagtctccaggctcactggtgaataataggaatctttgtcgtcctttccatcagaaagcatattacttaaaaccccttgctaactcacagggtgagctgtcctgtcacacatcatcatatggaatggaaactagcaactgaatatagcaacactcagactgataacttgctccacggataacttgtttgtttaccgactctggggatggagaaagacacattactcaaataacaaatgccatttcccctgcacaccctggaaagagtgctgcacctgcagcctgtggtttaactgtagcaatgcaggtgagcaactcaagtgcatttctgtgatggcaaacagcaaggtgggcatagtgagtagtgagtttcctggcttatggggagcaatcagaattatggcctgaatgcaacactcagcaaactcagactgagatgtttacaggccagcccagcccaggaggaggaaggggcttttattcctaaatcaagaagtgtccagaaaaagggaaataaggcttaggtgtgttatgctgaattttgggcacctgtccccaccaataacttggcatcctgaaaatgctacagcaggactccaagggccaagaatgcctgttctctacacagctgagggatggccagtggcctcattgcagagctgccactcaaaaactgaaagatgccaaaagggaagagcttgctccatggataacttgtttgtttaccgactctggggatggagagagacacattactcaaataacaaatgccatttcccctgcacaccctggaaagagtgctgcacctgcagcctgtggtttaactgtagcaatgcaggtgagcaactcaagtgcatttctgtgatggcaaacagcaaggtgggcatagtgagtagtgagtttcctggcttatggggagcaatcagaattatggcctgaatgcattggcacaactctgcctgcagtccaggaagcttttctgttgtaaaggtctcctttctagaccacctttgaagtcataaattagctgaagtggagttggtgtgcacttgctggatctggtggtgtgtgcttggatgcctaaacaagaggagttgccactactcattttagccaaagactcagccagaatcctatgctttagtgggactgggaatgtgatggtgagagggaggtaagaggatgagtcttgcacaagctagactcattagtcacatctttcccaacctttgatgtgcctggtaaatgatgtccgcccaagtgctgtgagggcttgtcttcaacaggagcccagatctgctgctgcaggaggggagatgaggagccttgcagccctaagggaaggtgctgaataccactctctctctctctctctctctctctctctctctctctctctctgtgtgtgtgtgtgtgtgtgtgtgtgtgtgtgtgtgtgaaagcacccactgttcagattcagataaacacgtttcagctctagcacacccacgagtacctgttctcctcccttgcacaacagcagcttacagaacagagaacaaaacttgaactgtcataaactgtgctctgaggggaggaaaaggctggctgacagtgggagctactcctgctcagaaatgaaggggagggactctgttttcttctgaatataaaaccctagtgaatttccaataatgctgggtgatgacaggaaggcatcaaagccctaaaggctggtaaccgagctgccaagccaggctctccacatgccgacattaagagcagtggcaaggcattagcatctatcctgcccctgccaggccctgtctttatctccactttcctcccttccctttttctgctgcttcctcttctctcttgtttcctctcccctttctagacctaaaagcaaagagtgtcaccctccagatgtcccttggctacaccgtggccctgggttaaggaggtaactggttctccacagctcacaagaaatgggccagggccaacacgcatgtggccttgagcctaatgccagcctgaccactgtgcgggttgttgtctattttcagtgcctggattctcctctaaagatgaggataatggtccctccctcccacaccttcacaaggatgattccaaggacaagcaagattgttcttcagagcacgcctcagaggaagggcatggtgtgagtgctgggcattgttaggattgttcgtttaccttccagggtccctcgctggaagtgacaggggtgtgcacttacaaaatcattcttgacccaaagtacctcttttaaagatgcttgcctttaaaagaagacaagtagtttttgctcccatgatatctcaagtggcacttagattgccgggggcctgttgtccagtaagtaatgtcacctagcgggattatgactggtttggagtctgggtctgagaactggggtaaaccacttcttcatgtcttagtcccctcatgcataaaacagagggatcgcacagggtgatcactaaaggaccttccaatgttaagatttaaagggtaaacggctctttgataaagacagatcatagaaaagtaagaaccacacagcttaaccttccaggggacaattaagatgctttaatgtgaagtgaatgacgatgtggtagagtatgatgtgaatgtaatagcataggaaggccggagggcatgggggcctctcaacctcatactctgtactagatgcggcatctggagcatctcaagaggggctaagagattcagtcctcaccccagctctgaagatgtctcaactgtgaaaaagagacagggagtccctgactctctgtctgctccttcactggttactcccatgttggaaggcaggggaggaggaaggccccagcatcttccatcactgctgcagacaccaaccaaccctccttcctcccactcctctgcttcaactctcacctgagtccccaccccaaacagccctctgctagccattaggtgttagctgcacttcacctgcaaaaggccttcctttgccagtttttgtcaaaaatgttagcatagtgtttgcataaatttgcaggtttgattcaagaagccctgattccaatagtgtaggagaaaatacactgactgcacctggagtcaaggaggctttcaggagggcacacttgattcaccacacagggctcgaagaggcactcagtatgtgaggctgggatgcccagacagaagcttcccccacgatccaggaaatcaaaacgttttcaatgttggcttgaaatcatggctaataggaataaaaaagctcttctcaccctggggaagactggggaggtagggaggggaagagttcccaactattccatccaagagggggcaaggaaggacagtggcaagcccaagtctggagctatttcctcccaatagtgaatgtctggtaactttacccagaagttctgatttttctcgttagtcaaacaggactctgacttccaagattaggctaaatccagagcagtttggggaatgaaggaatctggctgaacaatggaagttggaatcattgccctaccatcagcaactccttaacagaaacaaactcctctgcccactcgtcatatccacaaactattttcatagaagagaatgtcccagctagaaatgcaagtggacgagtgccaacccaatgaggctaatgatttgcaagtggagacctctgagcaacttggtaaagaaagcagggcttggccttcgcccgggaggcttgggacccctgaccaccccctaccccatcaccaataaacctctcagaaggaggaattctgtgacagccctcagaagagagtggctatccactggccacagcgatgactaaagcgaggttcatgccacagaagaacacaaaggtcaccaaagctgtctaaagcagacactgaatttattattcgccgaagaaggggagacactcatttcgttaagaaaggtcagaacagctctccaaactgaaggtgaataggacagatacactgtggaaaagaggacattttgttcaaaggtctgattggctcaaaaagcaagttgtaaactctcttctgggactgactgcttttctgactttgtgtcacagaggcatgagaacagctcgtgggagattctggatggatctgacctgtggtgcacggccctggcagcctggtgtctgtgcctcctctcgaggtgagatttttctctggcacccacttgggttaaggtgaggaaccctggagcccatgggcctgctgcatggctctgcacccatcacccggctctctgatcctcactgcctaggatggagagatatgcagccctcctggctgcaggtatgaggaaaccacatgaaagctgttccagaaatttgttggcatgtggccatcatatcttctaaccaggaaaactgagtcacagagctccaagccccagtaagttggaggatacattactaaaatgctcctgaataggcaaaaaataaaaaaaaattaaaaaaataaagaaaagaaaaagaaaaaaaaaggcaaactggaaagagctaaccccaaattaatcatgtctaaatcccagtggtaggtttgcaggagatttctaacttctcttctgtattgattttctgtattaatcttttctgtgttggtgttctgtattctccaaattctttactatgtgtggttttgaaatcatatttttttaaaatttgatttttaaaggatgagctccaggtcaaggttgctattaagtcaaaggtatgcatagttctggcacagtgactcaagcctgcaatctcagaactttgggaagctgaggcaggcagatcgctggaggccaggagtttgagaccagcctgggcaacatagagagactccatttctactaaaaacttaaaaagttagctgggcatggtggcatgcatgtgcagccctagctactcaggagactgaggcaggaggattgctggagcctgggagtttgaggttacagtgaactatgatccctctactgtattccagcctgggtgacagagggagatcttgtctctattgaaaaatgataataaaaaaaaagatctgtgctcagcaaagtcaggatattatcccagaatcggagttgagaattcagagctggtggctacgtctggcagccctatgctggctagagcccagggctccatctccagcatcccagtccaattaccctcttcctccttagcaatgagtaatacaccacctcttgaagccgcaggctggtgtctcctccttgacaatttcttgtgcttgctgttctccgccttgttacccagtggccctgtgccacatcaaggacttaggctttctatttcctcctaggaccctccctgagtcccctcagcctcttcacttgcttctccatggcccatcccatcagttacttcagcaatccctcatccccttgacctcaccgtctgcccctggggacaatcacaggaggactccccttgactcagtccagctgccaccttctctgtcctgtgtggggcggctgagcgctgctgagaccacatggcctcatggatctagacgggtatgagctcctggcctctgcttcgtccttggtgctgcccgtaagtcctgtggtctctggccagctttatgtcctactcccccaatggctatgacagaccctcgccggtctcctgaagctttctttcctactgactcgcccctcgccagccccagctcccagcgaccttgccctctgcttcaaggaagatgaaaagtttcttatgtgggaggaatgtttgcactttctagactccctctgcagagaccctcttcctggcaacctctccttctacagccatgggcggtgctgaccaggagaggagccactgggagtcctgcagaaggcctcctggcagccacggcctccccactgtccccagcagcagcagtgcatcttcaggcagctctgactgctggaccctgcagactcagacccccacccctctgcagcaggaagtttactgcttctgggaacccacaggatgtgagagaaaacaactccatggggctgggagccttgggtttgaaagttggacctggcacccactggcttcactttcttgagagtagagtggaaggcaatcccgcccaacctcccacacaccatgacaagtgcccgtgggtaataaatggaaaagtgctttgtaaaatgctccccctatgtgaaggatttatgctataaatccttagaatgactcatctgagctcttaacctactttcttagcccttaaatgtttgcttttcaacagggattcctgagccctggcttgttcttgaatttgcaggagccacagacccttcaccccatgccaactgaccagaggcctgatgctcctgccctcttctctccctgccactccaaccagaagacctctggccagttgccatccagggacctggcatgacctccccagcctttgaggcagtgatctggatgcccagagagtcaaatacagagaaccagggactggcaccccagctgtgggttctcagagtgggctcatgtgaaggagtgagaaacaaggagcacaggaacctctctctggcagcccacccctctgtgcccacggaacccgctactgagggctcagcatgaggactgtgtgcagcctctcctgagaccctcactcaccaggtacttgcagatttcctccaggacctacatgcatgtggtcgctgagcgtggcacgcagcaatggctggatgagtgaggaccagccaatcatgtcagcccacaccgccagagcctttccccaggcctatgggatggagagaagggaggcctcaacctcactcctgtgactctccagccaaggggctgagtggaagcccttccgtcataaagagagggcagatatgttcagagccacccagaggacaatgtcaaagaggtgaatgtagagcctacaggcaaggctgggctcatggaaatggccacagggaaggggccctgctctcaaggaaaggggacacatatcaggcctggcagtggccagacaagtgacagccagtgtacctggagcacttccatgttattttcctgaatgctgagcaccaatgatatcagaagtgtgaaaaaattttggggggtgatgcctccaggcttacatgtttttagttgctgcagcatgtggcccacagcagaggtggctgagatcctcaccttctcctgctcctgccaggaagcgcaaagtggagatgagaggcagtggcttccctggccctgcctggcctggcttccgtccttccacatcttggtctctgtgtgcaaggggccccagctgtactgtgcttagctgatgcatagacaacatgatgtgtgtatgtgaggggttctctctagagaccaagagctaagaagcccgttgatgaaggcacagtgctaggaaataaggtcatcgtttcagttctaccgtggactatatccgcagcttgtgacattgtttccaaagtgttcaagcaattctcctggctcagcctcctgagtagctgggattataggcacctgccaccacacctggctaatttttgtatttttagtggagacagggtttcaccatgttggtcaggcttgtctcaaacccctgacctcaagtgatctgcctcccaaagtgttctgattacaggtatgagccacagcgcccagccctgcacacctttagaccaagtattcatgtcatctacctgcctgtccatccacacacttgggtacttaccttcctgacactggcttaatctgctattttattttcttggctacctactacctatgagtaggtttccttgccttcccttggcacgcatgtcttctgacctagacctctgaggtaccagggaatttccaaagttgcttccacaacttcttcccaccttcctgatggtttactcacagcttcagaagaagctctgtgctccagaaactggtccccaccctcaccctgacatataagccagagacttcacagactaagaacaggtcccttcctcttctcctcttgtcctcttgcaccctctagagagctctttccctccatcactgggaaggtgtatgttggacggggtgggaggttgaggtaagtgagtccctgccctcctgataggagagaatcacttaatgaccaaagctcattcgcagatgcctggggacttttcttggggatgagccttggaaccttctctttccaaaagccacaaggagaactggaggagatttgtaccttggtcctaatgactgtgaggtagaacaacccacaaagggtcatcaggaagctgtgggttaaatcacatctctacaaactgcctccaaggagcttccaggtggcagtggagaaacatatcacctgccagggtacagatgcctgagatggaagcattagtttgatcagagaacaagggcagcagtgggtgggagtgctctatggattcttcattctcctaattcttctcactggacagcaccacttatgggcctggtgtggtggctcacgcctgtaatcatagcactttgggaggctgaggtgggaggatcacttgagccagggaggtctatgctgcagtgagccatgattgcgccactgcactgcagcctgggggacagagtgagaccctgtctcaaaaataaaaaggagattatgcagagggtctgaaacgaaaaagtttagctctagaggtagacaatagagcatggcaattggaagactgaatgtgctgagccaccctgtacacaagtccctataaaaatcagaagatgtcatggcaggtgtgcccaaggacgtgtagttttctcctcacgaaaagaatgtcttaagcactgtaaagaggtcagtgcaggggtgaacaacaccaatttaagcattgacatgtgttggggtttgtgacggctgtgagagatgcaaccatgactggaattcctcactattcccagaaagctagtgtgtagaaggagaggatacagctgagatttggaatgacatgtggtagggagaagggggatgtatgcacgggtacaggaggtcagtggggaggggcttgggttagaggtgaggcaagggacaagggaggcttcttgagaaagggatgtctgcactgcattttgaagaatgagtgggaatttggagactgagtgtgagaggcactgcaggcagtgaagaacctgcataacatcctctgccatatgcagggcagggacaccaagccactcttctgcagtattgccaggcagctgcatccactgattaatgatgtatgtgcccaggtccctaggatcagttggacacaatatgggcttagcttaggatactgggttagggcaaggcaccgtggtgcgaggcctaggtcaccaagggacagaagaaaggagacttggctacttgaagctgagcataggacatgtcccaaatgcattacttactccatgcaatggagcacacactcctccactgactcaccagaattttctggaggagccactggtacccaaataagaaaccaactgactgatatgaagatggttctgactcgaaggatcttattctgcagactccactcatggagtgaagcggggagagaacaagtggctctacccccctcccaaatcatacagaagccttaggatcccagggtcctcatggcaagagaaacgtaagactcagaaagttgaactgaccagacctgtcccactccttctcacatctcatcttccttgcaggtgacacaagtttagagctgggaaggacctgacatccctgagacacaggtttatgggactccagctctggcatctataactctctcaacttgtgagccttggatttcaactatttttgtattggtctcatctcctctatgactttggacacctgctggtggcaaggccaatgtcagactcacctatctttctgttatgtttaaaatttaccatgtgtactatacttgacttaactaagtctgaagataatatctttttccttcctccaaatgatacaatccatggatctttgaatgcttgaattctgatcacagcctcccacatgatatactaatgttgcccagtattaaaatactgggctaaagctccacctttgtatttaacctgtaaatttgctctttatgtcatcatcttcatgactgtcatgattttgtacagttaatactggtttagatctacccatatgcttacaaatttcttggcttatatttctttcttccagctctttcctcccttttagatttattttgtttttccttcctttgtggttccttcagtgagggtctcttagtagtaaacatttttagtctttgaaaatgtctttatttggccttatatttgtctctgctttcagcagtctgtgatgtttctaggcatacatttccttggttttagtctgtttgaggttcactgagcaactttaatctctaaattgatacctttcaccaaacttggaaagtttttactattatttctagaattgttgttcagccccaccatgctctttctcttcttttaggactctcacgacacaaatgttacaccttttgttatggtctcaggtcacaagatacttttggttttgaatcatttttctctctgttcagagtggataatttttattgatctgttttcaagttcactgattctttcctttggcatctccattttactatggagcctacccaagcttatatttttcagttctaaagctttccacggtttttctgtatgtcttctatttctttgctgagactatttctgttatttcaagagtgttcaccgtggctttttggaacactttgcacagtaaccgctttaaagtttttattacataattccaatctctttccccttgacttcagggcatgttcattttcttcccatgtgagttgaaatgttcctggtcctttgcatgctgagtgattatggattgaatcatagacattatgaatatgatattatgtgactgtgggtcttccaagagtgtcctggtaattttagcaggcaattgacctatttaccttcaggctgccaatcctgtcagccgtccgcgggttgtgattccaatgccagttcttggttcgaagcctctgctattgtgcatttgggccaccagccagcctgggacctggatagtagtccatcctgtagttcagttctcattgtctatgacgtgctggtcagggtcagacctgggtatgtaatgagctcgggagttcataaacacctttataggatcactttcctcctctctgccacctccctggtactttacagttccctggggctccccttcttcagtggccagaaagctggggcttttgttgctccacagtgccaggcacttctgtgactgtccccacatctggtgctaagtggcaagcggcagagaagaaataaagcaatgggaattttcctcatcctcttgggcccacagtgactgcaaatggagaggagggcttccctccctcagttttgttttctgcaggttcccatggggcctgcttggaggctgaggcttgagagaccgagagaaaaagaaacgagggatttcttcacttcctttgagcattgtgaagtgtttctggctccttgggtgttacctagagggattctctcagagctctctctgtatcccggtgcatacacctccgtttctggttgtgtggcttgcaggctgtggatcccaggagatattacaacccatgccctggggggttattgggaccagtgatgccctccaacccctagtaggtggagtgtcagcaaactttttgtttttggtccctagagatttctcttactctcctgcaagctcagctatgcatatatataatattttatctagtatatcaaggtgtttagagtaagaaggttgttatcttccatattgctgaatttggaagtcaggagctatagtccaagtgagaagtactaagtggccatcacctacacagaggccacctggggaaatggtaagagctgcaccacagggcccctcagatgtgggtgctgggtgctgctttgccattcacccagtcatgtggagggaggcagggcactgaggcaaagcttactggtctcatcatctgtgaaactttcttctactattttggttcacatgccctcttttctcttctgtctgttccatttttggaatttacttggatttattctctatgtttcttaatttctcttccatatttcccatttctttgtctactttggaagaatttctgggctgattcacttttaacgaattcaccctttagttgtggttattctgctattcaacccacctattgaattttcatttaactttttgtttttctaatgcagaaggtactctatatttttctcttctggatgatgttgtggtatcttgatagttatttcattattctgtggcgatattgcctgaccagtgcctgtattgatttatttattgatttatatataacttcaaattttgaatttctaagcactttaggaactgaactcaatatcttttaagaaaaagtttctggggattcaatagtactttctctaaagttttgttcagattttattgttaactccatccttggatggtgggttttcttttggttttgcttgcttgaaacagggtctggatctgtcacccaggctggactgcagtggcaggatcatgactcacggcggccttaacctcccaggctcgtgatcctcccacctcagcctcccagctggtactacaggcacatgtcaccatgcctggctaattttgcatttttttgtagagatggggatcaccatgttgcacagtctggtcttgaactcctgggctcaagcaatactgtgcctctgcctccaaaagtgctgggataataggtgtgagccactgtgcccggctggatgctgggtgttgtgtttcttgaacgtttcctttcatctgtagtgctggttttcctaaatgtatatcgatccttggtagtgacttctggcatttttatactagaatttcttggctggccctgtgtgaaagcaacacccgtgactgcagatgaatctttaggattcacagtcaaatgggtgaacatccaccagatccacgatgaggatatgcagctgatatgggatggtgagtctgggccttgcacctgggttctgggtgacactagggggcggggtgagagagaatgggggatgaagacatttcttaagaacatggttcatcattttatttttaccattatcaatgtcatatagaaaagtggaaaatggagaaaagtatttggaacgaataaattatacattgtcccactagtgagataaaaagactgctaatattttggggatctccccttccagtccatgaacatttataatgtgctataggtgcttacagtgaaatggtgttcaagacagacacatccctgctcttcataaacttgcagttttttgttttttattgcactgaactcttctaacattaatttatatttacagaagaaaatgcacaaatacagtgtctttacaaaagagtagaaatgtgaccaacaagggtaaagttgcactcaccccactccacctcgctcctctgccctcctcccctgcctgtttgctgtagagtcctgtgttctttgtctttatatacattctataaatacacatatacaaatataatttttatttattagtagtatttcaatagttttgggggaacaggctgtttgcttagatggatacattctttagtggtgatttctgagattttggtgcactcatcacccaagcagtgtacactgcattgaatgtatagtcttttatccctcaccaccctcccaccccttcccaagtctccagagttcagtgtatctttcttatgcctttgcatcctcatagcttagctcccacttataagtgagaacatatggtgtttggttttccattcctgagttacttcacttagaataatggtctccaactgcatccaggttgctgcaaatgccattattttgttacttttttatggctgagtagtattttatgttgtgtgtgtgtatatatatatatacaccacaattcctttactcactcgttggttgatggacatttaggctggttccatatttttgcaattgtgaattgtgctgctataaacacatgtgtgcaagtgtctttttcatataatgacttcttttgggaaggcagatacccagtagtgggattgctgggtcaaacggtaattctacttttagttctttaaggaacctccgtaaggttttccatcatggttgtactagtttacatttccaccggcagtgtaaaagtgtttcctttccaccacatccacaccaacatctattgttttttgatttttaaattttggacattcttgcagaaggaaggtggtatctgtggttttgatttgcatttccctgatagtgatattgagcattttctcacatgtttgatggccatttgtacatcttcttttgagaattgtctattcatgtccttagccctctttttgatggaattgtttttttcttgctggtttgagttcctggtagattctacatattagtcctttgttggatgcatagtttgcaaatattttcttccactctgtgggttgtttactctgctgattatttctttttctgtgcagaaggttttttagtttaattaagtctcatctatttatatttgtttttgttgtatttgcttttaagtttttggtgatgaaccctttgcctaggccaatgtctggaagaattcttctgttagcttccagaatttttatggtttcaggtcttagatataagtctttgatccatcttgagttgatttttgtgtaaggtgagagatgaggatccagtttcattcttctacatgcggcttgccaattatctcagcaccatttattggttagggtgtcctttccccactttatgttgttgtttactttgttgaagatcagttggctgtatttggctttatttctgggttttattctgttccattggtctatgcacctgtttttatactagtatcatgcttttttggtaactatagccttatagtatagtttgatgttgggtaatgtgatatttccagatttgttgtttttgtttagtcttgctttgactatgcaggctctttttttgttccatatgaactttaggattgttttctctagttctgtgaagaatgatgctggtatttggatggagaaaataatttggatggagcattgaatttatagattgcttttggaagtatggtcattttcacaatatttattctacctatgcatgagcatgggatgcgtttccatttgtttgtgtcatctatgatttttttcaggggtgttttgtagtttgcattgcagagatctttcacctctttgattaggtatattcctaagttttttttttaagctgttgtaaaaggggttgagttcttgatttgattctcagcttagtcactgttggtgtatagcagtgctactgatttgtgtacattgatcttgtattctgaaacttcactgaattcatttatcagataaaggagctttttggatgagtctttagggttttctaggtatacgatcatatcatcaacaaacagcaacagtttgacttcctctttaccaattgggatgccctttatttcattctcttgtctcattgctctggctaggacttccagtactaagctgaatagaagtggtaaaagtgggcatccttatattgctccagttctcaaaggaaatgctttccacttttccctgttcagtataatgttggctatgggtctgtcatagatggcttctattaccttaagatttgtcccttccatgctaattttgctgagggtcttaataataaagaaatgctggatttgtatcaaatgctttttctgtgtctattgagatgatcacatgatttttgcttttacttctgtttatgtggtgtatcacatttattaactcatatatttttcaggggttggggacagagtcttgctctgtcacccagtctggagtataatggcatgatcttggctcattgcaacctccacctcccgggttcaaaggatattcatacctcagcctcacaagtagcagggatttcaggtgtgtgtcaccatgcccaactaatttatttgtattttttagtagagtcagggttttgccatgttggccaggctggtctcaaactcctggccttaagtgatccaaccaccatggcttcccaatgtgctagattacaggtgtaagccactgtgcccggcctgacttgtgtatgttaaaccaaccctgaatccctggtatggagcccacttgatcacggtgtattatctttttgatacgctgttgaatttggttagctagtattttgttgaggatttttgcattgatgttcataagggatatttataaatatgtgtatgaaaagtttcagacacttgtttgtttcccactgaaatgttggttccaacagatctactgcattcccagtagtgttccgtggtattgatattctagagtttagaaatcatttcccatgtagatgaacactgaagttgttcccaggatgttactattcaagcaatactagcatgaacttttttttattgttatattaaattctggggcgcatgtgcaggatgtgtaagtttgttaaataggtaaatgtgtgccatggtggtttgctgcacctatcaacccatcatctaggtattaagcccagcatgcattagttatttttcctgatgctgttcctcccactgtccccagaacgtttttaaatatgcctccttatacacaattgtgaagggttctccgggctaggtaccaaaaagtagacttttatcatgcattctaaacttaacagagtgtgaagtaaaaccacattataaccttctgtcctgtcttgacactcattccaatcactgtccttcccaattacaggcttttgatggccattattttagttctatctagcccagaaattagaggctgtattagttcgttctcacacggctatgaagagactgggtaatttattcaggaaagaggtttaattgactcacagttctgcatggctggggaggcaggaaacttacaatcatgatggaaggtgaagaggaagcaaggcgccttcttcgcaaggcagcaggtggaagaattgctagcaagagcagggaaatctcccttataaaaccttgagacctcgtgagaactcactatcatgaggacggcatggaggaaaccacccccatgatccaattacctccacctgatctctcccttgacacctggcattagggggattacaattcaagatgagattttgggtggggacacagccaaaccattatcagaggctatgactgccatcattttatacaaactgtttagatttacatacattcttacatttcttttgcatgtctgaccttcctttgaggcccatccacttctcttcattgcagagtcagcttttaaaagtttctttagtgctcttaagtgagctcccttagtttttgtttgaaatgttatttactgtcattcttgaaagaccactgtactgatgactcaattctagagtgacaattgttttcccttggcactttgaagatattatatagtatagttttctggctttctttgtcggtgtgaagaagcctggggtcattctaatttttgttcctttgtaggtgatcttttttctctaggtggtttaagattttccttttttttcgtttatttattcacttttattttaagttcattggtgcatgtgtaagcttgttatctaggtgaacatgtgtcatgggggttggttgtacagattatttcatcacccaggtactaagcctactactcaatagttattcttcctggtcctctttctccttccaccctccaccacttgataggccccagtgtgtgttgttcccctctatgtgtccatgtgttctcattatttagctcccacttataagtgagatcaagcagtatttggttttctgttcctgtgttagtttgctaaatataatcgacactagttccatccatgtccctgaaaaatacatgatcttgtttttttattttatggctgcaaagattttcagttgtgttttcagtgctctacagaagtatagagaatggtatcacaaactcccatgtgcccattccccagccacagcaactcacgccacccgtgtttttctgtctccttacttacactgtctccctgccaggattattgtgaatcagatcccagacttcttattgtttcatctataactattttggtgcatatttctaaaatcatattattttaaaattgaaacatttttaaaaattgtagtgggcaaattatagagtaaagtgcaagctaggcacaaatttctaagataaaagagatcccaagattgtgtagaatagagaggccctgagcaattcatccagacaccagagattgccagctcactctcatttacccatcctgacatccaaccctacccattacagaggctaagccatttgtccaaggtcacatagagaatgactgggagaatcagtagaattccaattcagggctcttcccacagcccgtgttccctacattgttcttgaatcttcccaaagtcctgagaaagaaaagaggtagggagtgggagttgtggctacggagaaagaggagttgatatttccaatgtatatcagaagcaaacttgaactcacctttcacagccttccttagcaccaacagccaaacacaaatacctgtgttttatacagaatgcacttctgccaactcccacccttgctgtttacacaaatttgtttcttaattattgaaaacctcctgtgtgccaggtgattctctaagccctggggatgctgcactgaattaagctgatgtccctggcttcatgcaacttacattctagtcaaggagaggaagcaagccctcaacaagggcatacatgtcagggaagcaccatggagaaaataaagcaaggggaggggctgagcagtgtatgagggtgaggtgacagaaatgtcctctccaataaggaggcacttcaccagagacccctgttaaactaaaggacgcaagaaggtcagaatttaccttaaatagagttgatttaggcacaaacgttgaggacaggcctgtgtgggaagcccagattccacagaatggaagtctgtattccaaagtgaagtttgggatcctttatacagaggaagcttgggaaagcctagcagaatttcaacatctttctgtgtaaggtttaatgcatcatttaaatgatctaattagtccaggtggtctttttctttgtggaaaggtagatttaacattcctcactgaagatttaacagtcttggcatctcgggtgtcatctggtcttagcaaggtacacgacaataaaggagtcagttaacctataacaaagatctgggttcggtagtgggcaaggcctggtctctggtctctcctactcattcacagaagaggaacaatggggaagagagttctcctttaatctgagaagcagaattggaaaccggtggtgcgactcagtcttgggtcttaatatccttctgggtgtaataaacttggagggtgctgaaacagtattttctttgacaccttgaaggaagggagaaagggagctctatggctctctaagggaagagtccttggcatgttcaaggatcaagaagccagtatgatgatcatggagggagcagaaggaagagcaggagatgagatgagagaagagtagtggggccagaatcctcttgggtcttctaggcacagtcaagattgagggttttactttgagtgggatgggagctcactgaagcacagtttttaacttctctaagaaggaagagaggggtgaacagtgcttgtgatagggtgtgaggatagtcagtccattctaggaccaagcagaaataggttataaattacttgttcctgttttccatgtaacaatttccttcctttgatgtggagacaaaacagaaagaatgtttgctttggtagatcatcttcagcatccctctgtgcttaaggaggcgtatgcacattggaatgtcctgacatgagtgtccagggtgctgttgttgccttttttgttgcaaactcttgtccttgaggtgtttgccttctgatttgaacctaatcagggtattgaatactgtggctgctaagagatcatattttgcataagctgcttttgagagaacggtgaatgattgactcctcagagaaaatgcctagcagacctctgcagatggagaattccttatttcccatatgtgtcattcccagttctttgtctagagagtcaagtattgaactaaacgatatttcagggtcctctctctcctcctagtcagtggtgaaatggaaaagcaggggctccagaaccagccagatcagtttccataccagctctatgagtcaggaccctgcagacttgggcacgtgacttcatctctaggcctttcttcatctgtgtcatgagagtaacagcgctgatcttgaacatcgttgtcattattgaataaaaatgcacataatgtgctgagctttgctgggcacatagatgtcccacaagacaatttcattgccttgattcgggtgtctaggtgcgggcgggggatgatatggagggtggcaggtagggagcgtccttatagctgtagtcagggaaaactgaaatagtcagttgcttctccgagagcagccgtgccacctctgaagcacgagtaactggcagggctgtctgtcccctttgggctgcaacctggcttcaattctgaccctgacattgtgtgcttctgaagccttctcctcttgttttgacacctgaagtccccctgtatatcctagacttctcagtctaccagagcattcaccttactttcttcatcccaccctgcctttgatgatgcctaagtccccgagacaggaggaagtcttccccagaaaggtactatagcagcacttatacccatgtttaatgtcccagaaaccttgtgttcaagtaatgctttctcaagggtcttatgtcttttctgttagagcttcagccccgttcttgtgttctgttctaagtgaatgaaacgaacattatgctgtagacattgatgggtttgaaggcctaaaatgaacaagttttgttgaacaaagattctttctcgtctttatccttttcatgctaaggaatttcctgtctccatttcttttgttcccaccctactctacaccctcatgattccctaacgggaccactttaacagcctcccaacaccctcttcctcttctctatacgattctgctcttagcagccagattctctttagaacatgcatgctggaacatgccactccttgctttaaacccctcagcagctccctactgctcttagggtctcagtctgctcccatattctcactcacccgactcagaatgtcctgacctctgaggcctctcacccttagcctacaccacttcctgcccctctgggaactgcagtcacactggtactttctatgacacaaagagaccccccacacacaccacgtggaagtcttctgcccttgccctgtgtgttcgtaggctggctttcaacttcgggtctgagctggagcatcaccttctcagagaaacatcccctgatgggcctaagggctcctcccccgtcatttggtctcagaactcccctcagcttcctcccttttacttaatttgcatttaactgctgatttgtctttcccccaccagaatgctaacttctcaagggtgggaatctgtttttcttgtcctcccctggatccccagcccctagcagtgcctggtaatagtaagtcctcaatatatagttgctgaatgaatttatgattactttttataacactgaaagattgcaaagaatctaattattcagaaatagggtattcaccaaaaaaattatgatagaattagtcagatgtggtggctcacacctatagtcccaatgactcaggaggctgaggtaggaggatcacctgagcccagaaggttgaggctgcagtgagatatgatcacgccattatactttagcctgggtgactggttgaggccctgtttttttttttttaaaaaagttatggtagaatcatgtgattgcctgttatgctgtatagaggaatatattatggaatgaaaaaaattactagtcctattttgtgaaaaaaaaatctatcaacattcggttgttttttgttgttgtttgtttgtttgtttttttggttgctgttttaaaaaaagactgcaaggacagctaccaaatattagcagtgttatctctggggtgagtgatttttcttcttttccttaaaaaaaattgtgtattaagtatttcctacagtgaaacaagtattgcttttatagtggaaacatgattctaagcagagctgtgcaatgctgacctggcatggggtgggaagaagggggttagggaggcggtgcttagggtccagagtctgagttggcctcattctggtttcagctctggaaggagtgaagaatgagtcactggagcccatccagtccctcatggatgacatactgagggctcaggaagatgcccccttgcaacctgcctcagcttccaggctgagtcacctaagcagcttctttcagaaagcctttcacaggcacactcaggaagaagtacatcttcaattgaacaagaaataatatgaataaaaaatgtaaagaataaaaaatgcactgccacactggtggggcaggagggtgaaagtcgtgcccctcacaataggtaatgtctataaaaggacaaccgaggccatcaccaagtccacctacagaaggcgggtctgtctcaaccccagctgtcagtcactgtgaacctttagaactggggctgaagcttcttccagttgcttgctcagatgtcagtgagaccgctccacaacagataaggggagctgtgtgtcaggaaagtcccagccaccaggacaagctgcactccaggcagacgtttctgttcttgtgcaaagaacagcgcaatccattcaagttcacaggggcaggtggcacttgaaaatctcagggtcaacttgcagggcagaagttagcagggaagtcttcctgggggagtgggagagcccagcagagtttaggaggagggaagggcgatatcggggcaatcctctgagtctctctttcctcttcaggaactgttcaggaagaccctgcagtctctctgctggctcatgggagctcccagaactgaagcaacatacagatccaggccactctaagctctgcctgcattttcacagggcacattcttgtgtatatgtgtgtgtgtgtgtgtttggtgcatgtgtgtctgtgtgtgtgttctcttcttaataaaaccagcaatcactggactaggtagggcccactctaatccactgagctccccttaccttggtaacatctgcaaagaccctattttcaaacaaggtcacattccgggttctgagtggacatgaactttttcaacccagtacatctgggaacaggcagtcaagggtagaagagatcaacctgaggatgaggtttggatgcagagttttgagagaagggtgatcagagctagggtctaagcaacattggtctgctcccttggaggagaattttccctttttccttctgccctttagccagtgctgcagccacctcctctctcatagctggcatttaaaagccaaatggatgccacaaccttctaaggcatctagatatgcaactaaaatattaaaaaaattccagcaaggtcaaaataatctcaggcctagatttgccaccagtgccctcttctgggcagctttattttacagtagtgtcacgaaacacttgtttgtcaatatatgtatttgtgcactaagtgtcaccagaaaatacatttatgtctgttggttacagcctaaaaagtttaagaaaccatgtttagatgttttcccagtcaggaaaggccaaactaaaaagggctgtgtgtgtgtgtgcgtgtgcgcgtgtgtgtgtgtgtgaaaaagagagatgggggcccccattccactaagaagatgacagaggctgtgcaggttttttctctgtgatctcccctcctcctacaaatcatgcccagaggagggatcttgaggacctgcccctgcctccccagacccatctccacacccaggccatcctgggcagaggacagcagagctcacatctctgtggagagcagactgggctcactgcaggcctctgtgtcattgttcatcttcacttcataagtctcattctgagacctctcctgacacaccatggctatctggctctcctgggaaaagcacttacaacattcaagatagagaaaatcatcagcagctgccaaccctcctcctcttccctcagcaagtaaggcatcacgcatgcacatatgcacacgtgcacaaacacatgaacttgtgtacacacacacaggcacacacacacatgaacatgcatgcaatttctgtggcctcattttcttgtgatggctgatgaagccatgacgccatggaagtgttaagattagggagagggttccatgtgggaggatgtctggtgtggatccaaggagatctgagtcctgactccaattcacttaccctctggcccaagtcacttagcccaccccatgcctcagtttctctttctatgaaataggagtgacatatgccctgcctgactcagaggcctgttgtgagttacaaataaagcaacagataagacggcgctttgagactgggaaaagtcagctttgacctaagggtcctgggctgtgccataaagggcagggtgggcctgtgaggaggcctacctgtgagggcctgccctcccacccctacctgcaatagctgagcctttgggcattagtttggcacagctgagatgtctgtggcatcctattttgatggtgcccttgattctgacacaagctccctgcagtaaaggcacagaaaggaaacctcacctaggagggtttgctctcccaagcagagggcagtgagccggagtccctactgagcctgaatccttcctgaactccagacctgcctgtaccagaacatgtctttccctatggggacacagtcctctgctcactgggtcctgtcttcttcagctctgagccatgagctcttccttttcctgtttgtgctcagctcagtgcctctctccatctttatcctcagaccccagaaggcattaagggaagatcccagtccatcttcttggagctgagagctggatcagtgcccctggctttgaggcagggtaggggcagttctctctcagggaggcctgcagatcgccacctgccccacggtgggaaggaaagatgacaggtgggagctccaggtggattgggaggggagggagatggagtgggctttggcaaggcatggggggataagcttgagatgcagagtggcagcaggcaggcaacaacatttctggagaccaccaggcacaggacatgctggcctgtcctcaggacaagcaatgccagggcctgagctgcccttacccttcaggacgaggcctgggaactggaatgtgggctatgcttttcttcaccaaactgaagcttggcaccctgagtgttgtttgtaccaactgcagtaggcagacggggaaccaacacttcatgagcactgactgtgtgctgtgcactgtattgcgtgctttctgtttgtttgtttcatggagagatgtatctctggggagagggaaatcccctgagaatcccccctctcctctaaagcccccgccaccccaggttctctaaaaatccctctccccttatgtcacagagaataaagcttcacaggaaaatgcccttagaaagggggatttaattcactctgagatgctaaagatggccacggagacctccttaagcagaggctttcaggagaccgacagagaagaaggcagtgcagggacccagcgtgtcctcaactttggctaaataaacctgtaatcgattgaaacatgtcgcagtcactttttggttaacaaggtcaacggaggcacaagcaccaaagtccacctgaagaagttgggtctatctacgaaccacttgtgagtcactgtgaatatttagaaccgggggctaaagcttattccagttgtctgtctggatgtcagtgaggccactccatagtagattctcccacctttggtttaatgggatggacaactttggattaggactaaggaggtagatttgatcttggaagataccttaggcttcttgtctcttatctccctaggaaactgttggctgtcagtatctatactaggggtaagcccaagtgacagaacagttctggaagcatctccttgagttttcaggaaaggtttcactgacacaagaagagagtagggtggcagagcagcatcgggtttggttttcaattcccttttctatctccacacgtgttgggtgaaattcacagggttgccacactctcgtgggtatatttggattacggatgagagcataggaaggtgggctgtgggatacatacagtggagtgctgctgactatagcccccgtcatgtaagaaagcacgtcagattgccatagaacaagttatgctattgttggaataactgaagttcattctaatttagtttttaaaatcattctgaaactttgtcccccctaccgcatagtagttgaagggtactccgttttccctttttctgtcctaaccaagaaacagagcgtgcctcaactgttctgtgaccccatcagctgcacaatttgcccggcaggctggaacccaaggttacgctttgaacactcccaggcacctacaaaggtgtttaggttgttgccccaaacactgagaggaactggccaggccctgagccaaatgccttaatctctcaccaactccattccctgatcctcatgctgcagacctcactaggtagagcacctctttccctaactgcctatctggaggaaatggtgaaacccagtttctacctaagttctcataataaatgctttgatctgatcaccctggcgtctagtgcttctttctttgggattccaactggtcccatcttgggatggcttggggtactcccttgtgggaactcccctgatgccagcagtggcaccccagatgccactgctgaggtgactccagctgtgaattcactggaaaagaacacaggtattcctgattagttctttatgctccctcaaaggtcagagctcaatttccttgcacctgatttctcatccacaaaatggtatttataacacctctgtggaactgtcctccaatacccttcttcctttttaaaaaaccatgcatttggccacctggaatggagaacatgttttccaccccccttgcagctaggtgtggccacgtaactaagttctgaccaagcagtggaaggtagagtcccatatggcactttcaagaagtattcttaaagagcaagggcacatgcatttctatcctgcctgtcttcttcgtgactagaatgaaacacgatgcctggggctaaacagtgatcttaaaccatcaggaggaagtgatatattaaaaggcggaagagccaaaagatagaaagaacctagatcacttatgctagcagagctattcatcattttgcacagtttaccttcagactttgttcataagggggcaagggagtgtgagttttctatcacaggcaaacccaatcctgagggattgacttaatctatcaacattgctgtgaggatttaaggagataatataaaatccttagcagtttttctggcatgaagtcagagggcaactttttcttttttctcaaaagtaatgaaatattaaggctattgaaacttggttctgagaacactgaaagatatggaaagaccatagaacctgtttccacattggccagaatggactgacattacatctttgaagtcggtcataatcagaatgtttttcactgcttctaaattgtatgcactattggataaaactggaacagtacatggccaggcacagtggctcatgcctgtaatcccagcactctgggaggccaaggcaggcggatcacgaggtcaggagatcgagaccatcctggctaacacagtgaaaccctgtttctactaaaaatacaaaaaaaaaatgagccgggcatgatggcgggtgcctgtagtcccagctactcgggaggctgaggtaaaagaatggcgtgaacccaggaggcagagcttgcagtgagcagagatcacgccactgcactccagcctgggcaacagagagagactctgaatcaaaaaaaaaaaaaaaaccaaaaaaacaaaaaactataacagtactgactccatgttagagaaaagcttgtttgcttgaatacagttattgcttttcctgagactgtagattattcattaaaaacagcctcagaaatacaggatcttcagcagacataaaagaaaaaacactgacaaacaactctgggaatgggctaagtggcttgataagaatagcctgatggtacctgcagaaggtcatacaacattgaccaagaaaacagtgattgcctgcctgcctgcctgagacttcacatgtttcataagaatgctctgatcagccaggtacagtggttcagactggtattcctagcacttcacgaagctgaggtaggaggattgctggaggccaggaggatgaaaccagcctgtgcagaaaagcgagaccctgcctatacacaaacaaaaataataataataataaataataataatagctaggtatggtggtgcatgcctgtcatcttatctactcaggaggatcacttgagtccaggaggtcaaggctgcactgagccaagataacatcactgcactccagcctgggtgacaaagtgagaccctgtgtctaaaaagagagagagaaaaaaagctaaggctattttcaggttaggtcaggcttagtaacaaaaactttttgtgaaatgcttcgatcattgtttgccctgctcctaatttcccttaaaacctcccggatcagacaggtggtctttgaagatgagttcacagcctccctcgagtttttggcttcctgaatgtagctaactttccctttcaccaacatttgtctctagacttttggctttcaagcaacaagtggcctagatctgggtttggttacaaattttggcaagcccagccagaagccgtgtgctctgggctgtttgcaccctgtcagctcccaacagacaaagcaattggtcacagcttcataccaggactaactcatccatattgttgggaggacttcttggttcccaagaggtggagcaattgatggcggcagcaggtcagggctaactcattcacattaccagaggttagcggcaaatgctctgtggcactggctactcatggcagaagggaactgcagagacagccccaaagtctgccaaagagaggctgccaaaactctttctacttcagggaaacttcctcctttcccccattcagtactgactgcctacttttgcttttagttggtgaaaggaaactagctttattttttttattttaattttttttgagatggagtctcgctctgtcacccaagctggtgtgcaggggcgcaatctcggctcactgcaagctctgcctcctgggttcatgccattctcctgcctcagcatcctaggagtagctgggactacaggcgcccgccaccatgcccggctaatttttgtattttcagtagagacggggtttcaccttgttagccaggatggtctccatctcctgacctcgtgatccgcccgccttggcctcccaaagtgctgggaaactagctttttggatgagctgatgagctgtacaaccaggtaagtctactggggtgcaaagtagtagtccactttctttaccatttgggcctttggaccatttgtggtaccactggtagaagaaatgactcatagtgactccataccagtctcttcctttgtgaaagcctgggttggaaaagtgcttcatttgttttggttgtgttttgtttgtgtccaccatgggaagtttttttcatcagtcccctctcagagcccactgtggttcatattggctgactggtaagcctacagtgataaccctacgacaaaaaagataatctactgcaataaggtgtggtcaatgtacgtgatacatgaggaagataggtggccattacatggttctttgaatttaatgttatacagcttgaacatttcaatctgagatcaggaaattgggactgcataccttatattcaagcttttatgttggtacataataagcacgcttcccagaaaggttgctggctgatggtgcaaacaggaccatatcaggtaaaatctcctcactctccattacctgaggaggaaaagaaggagataggataatcttgtcaactataaaccctccacaggcaaatgatgctgaggctttgcaggtgcctgtcccattgcagcctgctctggcacctgtgcaggctcccatggaggccccagctgcagtaccagcacagtaccctgagttgccccatctctgccccctccaccagaggattatccagataatacagacttacagggtgtggtggcccctcctcattttaaaggtagccaagaaataggctccccttttaagacctgacaaggcaactaaatttgaccacagcgtacaccctcatgcggcagaacaatttctgttatgcaaattccccgctggaggattaaatgcacagggccatactcctgggctattttggttattcaccattttctatctttgactaagtaaatggaaaaatattcaagtccatcctatagggatgatccataggagatgactgaaatattcaccagtattttttctattcatcattccacaatagcaggtgtacaagcattattaaattttatgatgaaagggggttatttttagacaagactaatgatggagccagaaggctataccaggaagaccctgctgggtcctccaacatcccagaggcaatttccttagtgaaacgcaaatgaaaccttaataatgaggttatatcttgactgtaggattactcctaagaaagggagtacctaagcagcaaagcctcaataaaaaacatccatgacctctggtaggaggccagtgaaaacccagcagcttggttgaaacaagtgtaacaggcttacagaaaatattcagatattgatccagaggctctggaacatgtttgggtcataaatataactttcatcagccaaagtgcttctgacattaacagaaaattagaaaagcaggaagggactgttggaatgaacccttcccagtttacagatattgcttacaaagacttcaatgctagagaaacaagaaaagctagacaggcaaccattttcatggagactgttcaaaaaggtggaagaatgaggggtgaaatagaaaggaatccctagacaaggaccagtgtgcctacagtggggaaatctggacatgagaagtatgcccccctaagctacagagaaaagatggtaataaaaaagacaagggagaggaaaagggaaatatacgccaaagaaggagatggtggagcaggattgtgactctgatgaagactgatggggcacagggactccgcctgatttaacagagcaacagtaatttccctacaggagccctgggtacaagcgacagtggggaacaaaatgactggcttattggttgatactgtagcaatgtttccagccaaggctggagtcactgggaagttacaacagagactctttcttaagccctaagaatataaattgagggatataagattgaggtatagctttctgtatatgccacattgccctattccattgttgggccaagatttgttatgtaaattaaatgcccaagtcacttttgctcctgagaaacaacatctaagaatccaggtatcacccaaacatgtcctatgcctacaggcactggtgattcagccagagaaaagaactcaagaaccattcctgctggaagtctacaacagagggagttgcactgtttgggaagacaagggaacctgaactagcagtcaaagctcagcctgtgcacgttgaatttaaaaaagcattaattccacataaaaacaacactgcttaaaaggtaaagaattagaagtcatacagggggattacacaggtttctaaagcacagacttattcaatcatgacagtctcaatacaataccactatcttgccagtgaagaaaccaaactccaattagtatcaatttgtgcaaatttgagagctattaatgacatcgttcaagatacccacccaatcgtggctaacccatataccccacttacagctaccccaggggattatggctggttctcagcataggaattaaaggatgcttttgttcagtgtctactaattgaggagaaagcccagttgtttttgcacttgaatggcaagatctggagactagggcaaacttccaaaactgctagactgtactgcccaaatatttaagtattcctttaccatttttgaaaaaaatcttactaaaagatttgagaagcttgcaattaaacaggggaatactattacaatgcatgggtaatttactcattgctagccccacttatgaagactgtttataccagtttttgtttgattgttttgaaacaaggtctcactctgccacccatgctagagtgcagtggtgtgatcatgggtcactgcagccttgccctcctaggctcaagcgagcttcccaccttagcctcccaagtagctgggactgcatgtgtgtgccactgcacatggctaatttttaaaatttatttgttgtagagatggagtctcacagtgttgtccaggctggccttgaacttttgtgcttaagcgatccttcaactgtggcctcccaaagtgtctggattacaggcgtgagccaccgcacctggccaatactagttttaaacagcctggtggaattggatcataaagtatctctttgcaaatatgcaaagagcaggtagtctattcaggggtttgcctgcaataaggtaagcagagtctgatgcctgacaggtaacaagcaatagccactatcaaggctctcaaaaatcagataactaaaaggagtcttaggtatagttggcttttgtcacctttgatccctaattttggtctcctagtaaaggacttatctgaggcatttaaaatgtcagagtcagaacctttatattagacagtggaatgccaacagtcattcaataacattaaagaaaaactaaggaaattctttatgggcccccaagatgtttaccctaagatagttacgttgaatttcaccctgaccatgtaaattgatggcttatcttcacaggcatggaacaagagacataagtcatccctcttctcacctgagacaaatgcatatctgattgctccccctgcctgtttatcttatgtaaaaatgcaggttcattgaactagatgaatgtttaagtgactgttcccctaccctcttacatgtgaaggctaatcaaagactcaaaagaatgcaactgcttgcctcttatctacccatacccttttaaaaatgtatcttcctctttcaatacctggccttttccctttaaatattgggatcccaagaccctctttggaaaaagcatgaaacacaatgtttcctgtggatctacgttctttcctggacatgtcctcaacctcagcaaataaacctaaaatgatcaggactcaccttggtcatttttctttagtttacatttcctaagctacagacctgtgcagcacatgactatactgaatactgtgggcaacttcaacatgatggtatctgtgtctccaaatgtctcaacaaagaaaaggtacagtaaacatatggtttgaaagataaaagtggtatgcctctaaagggcactaaagggcactatagcattatagtatttatatgtctttgtccagggttcctggctcataacttctatggccctcattatagtcttgttatagtgctgggacactttaggctcagaaaacagactctctctgtctctgactttctcctgccctcctttcacctgcccaaggcaggactctgcacatcataagatcctcattccagagagggtcctgcccatccttaggaggtgggaatgctgcacagagaggccaagaatctggataagccttggtgggttttcccatctcagacaactagtgttagatcatcccttctggtccagttgtatttgtacatggttgtcaatcatgtctacccaatgatgtctccattgaaggctcaagaggacagggctcagggagcttctggaaagctgaacacgtggaggctgacaaaactcttccctatgccaggagggtggccacaccccaactccacagaagctcctgggttagggacccctccagactcaccccatgtatctcttcatctggctgtttatttgtatcatgtaaaataccctttgtaataaaccagtaaacataagtgtttccctgagttgtgtgagcactctagcaaattaatcaaacacaaagaagaggtcataggaaccccaacttgaagctggtgggtcagatgttctacagacctggacttgctatcttgggaaggaggggacagtcttgggagaatgagcctacaacctgtgggatctgatgctatctccaggtaggcggtgtcacaattgaactggaggacacctagctggtgtcccctccagaactgcttgtttgcttggtgtgtggggagaaattcccctgtatgtcgtcatagaagtcttccatgttgatggttgctgtggtgtgagagcagaagaaaaacacattggaggtggtttttccacacacaggcacttactatgaatggagcttgcaggactggaagttgctctgggtgagtcagggagtgtgtgttgcgtgcaggtgaaagcctaggacattactgcacactgttgtggactttataaacagtggacacttaggctacactaaatttgttaaaatattgttctttcttcagtaaattaaccttaggtttctgtatctctttcactttataaacgttttaattttttaaactttttgactcttgtaataacgcttaatttaaaacacaactgtacagcttttctttataagcttttttctatttaaaaaaatttcttttaaacttttctgttaaaaattaagacacaaacacacacattagctcaggcctaaacagggtcaggatcatcaatatcactgtcttccacgtgttgtcccactggaaggtcttcaggggcagtaacgcgtatgaagctgccgcgtcttatggtaacaatgcttccttctgggatatttcctgaaggatcttggctgaatctgcttttcagtcagcttcgtttttggaaagcagaggccgggcatggtggctcacacctgtaatccccgtactttgggaggacaaggtagaaggatcacatatagccaggagttcaagacaagtttagacaacagagcaagaacctgtctctacaaaaagtaaagataaaaaaaattagtcgggtgtgatagtgtgcatctgttgtccagctacttgggggactgaggtgagaggatggcatgagcccagttcaacactttagtgagctatgattatgccgctgcagtccagcctaggcaacagagcgagactctgtctcaaaaacagaacaaaactagaaagagtacactctaaaataataataaaagtattgtaaacacataaaccagtaacagtcatttatgatcattatcaagtattgtgtactgtatgtaactctccaagctatactcttatacactggcaactcaggtttgcttataccaggaccaccacaaacatgtgagtcatgcgttgtgctaccatgttatgatagttactatgccactaggtcacagaaattgctcagctctgttataatctatggaaccaccttcctatatgcagtctgttgttggctgaaatatcgttatgcagcccgtgactgtgcattggcatttgtccacttggtcttcagcctagctttgtactttgtctttgacattttggcttccactgcaatttacttcaggcttggactccttgaggatctctccaaacctgccatggtctgtttcttgccaccagtccctagctgcacattcttagggcagctgccccagcttagtctgatttatggggccccttatctcgtaacttttagaatcttgaccaagtcaggctacccggcaggaggaaatgtcaaaggcagaggcaaaagtggccctctcactttatctgtatctccagggtcttcctttgcatggtctcctttccttccaccctcaagtccattcctctcctgtttctctccgcccctccaggtttcctcctttaaccgcatcacctagagtcatcttcaccgtgcaaagtggttttgttcaaactaatgtattaacactcaactcagtgcagttgccctttgaatgatcacacccaggagacttttttctaattagtgttcaccttgactgtactatatttcagtgttgatcattttgtcctttggctcagatagctgtaaactgccttctatttcactgattcatcattctctcatcttcctttcccatcttcaaatgtggatatttcctaaaggtcattctctgttcctcattttttttcaaaaacttttaataaaatatacataatcaaatgtaccttaaccctgttcaaatgtacacttcattcatgttgaacatactggcattgttgtgcgaccagtctccagaacttttcctcttgcaaaactgaaattcttacacccgtaaaacaactccctatttgcccttcccccagcccctgacaatcactcttctactttctgtctctatgaatctgactactctaacaacctcatgtaagtagaataatacagtatttgtcttttgactggctttttcactgagtataatgtgatggttaattttatgtgtcaacttggctgagccaccgtacccatacatttggccaacattattctgggtgtttctgtgaaggtgttttttggatgagattaacatttaaatcaatggactctaagtaaagcagattaccctccgtaatgtgggtggacctcatccaattaggtgaagaccttactagaacaaagactgacttcccctgaacaaggagttgtgccagcagactgcctttggccttgaaccataactcttccctaggtctccagcctgccagccaatacaatcagattttcactcaccagtcctccacaactgcatgagctaattctttaagcctctttttcgctctgtgtagacacacacacacacacacacacacacacacacaccctgctggttgtttctctggagaaccctaatacaaataatagcctcagggctcatccatgtcgtagcatgtgtcagaacttccttccaagactgaatcatattccattgtatgtatataccacactttatgcacttatctgtcaatagacacttgggttgcttctaccttttggctgttgcaaataatgttgttataaacacaggtgtgcaaaaatgtcaagacactgcttttacttctgttgtttacaaacccagatgtgaaattgttggatcatatggtaattctatttttaatttttttccatagtgactaccccattttacattcccaccagccatgtacaaaagttctaatttctctatatccttgccatcatttattttttgttttgctccttttgggttgaggttttttctttcttctttttttttgagacagggtcttgctctgtcacccaggctggagtgcagtggtgcaattatagctcactacagccttgaactcccgggctcacacaatcctcctacctcagccttttgggtagctgggactacaggtgtgtgccacgattcccccctaatatttttttaaattttttgcagagatctggtctcactatgttacacaggatggtcttgaacacctgccctcaagttatcctctcgcttcagcttcccaaagtgctggaattgcaagcataagccactgtgcctggctgtgtgtgtgtgtgtgtgtgtgtgtgtaatagtagccatccccatggattgcagtggtacctcatcgtggctttgagttgcattttcccagtgactgggatgtcgagcatcttttcatgtgcctgtgggccatttgcacatcttttacggagaaatatctatttaagtattttgccaatttttttaatcagattgttttcatgttgctgagatatagaagttctttatatattctggttattaaccccttatcagatagatgatttacaaatacttgctcccattctgtaggttgccttttcactctgttgatcctgcccttcaatgcacagaagttgtaacttttgttgttgtccaattcatctatttttatgttattttacaaatccctcaactcatcaccaattttttttgttgcctgtgctttttggtgtcatagccaaggaatcattgccaaatgcaatgtcataaagcttttcccctctgttttcttctaccagttttatagttttatagcttttaactttaatttttaattttaacttcattttaactttagaaaatccatcttaagttaatttggatatattgtataagacaaggatcctacttcattcttttatatgtggatacctccttccttttggaaacttttcctttcagtaatcttactacctccacagctttagtttagatgttttttgttgttgttgttgtttcccaggggtgatcaaatccatatatccagcttttaccaccttcctgagttctagtccccccattttcaaacaccactgaaaatttagtttgactaagtacatcaacctattatgtgaagaaacaccatgtcccacccccactacggtgtggcttaatgagctaaagtaatatatcaagatagacataataatccaagaaactggggttcagagaagtaaatattattagggtgcatcttgcgctgttccagagtgaggcatatagggttttggggacagaacaatctagtctctgataatgttttctcttatagcacaggcacatttcatgagcctttcccactacctaggtgttccagtttggatgtggtttgtttggcctaagtctcatgttgaaatctgatttccagtgttggaggtggcgtctggtgggcaatgtttggaccatgggggtacatccctcatgaaaggcttgctgcccttatggcagaagtgactcagttctcactcttagttcccaagagaattgcttgttgaaaacaaacttgtacctcctacatgctctccttctagaagaggatctaaggaaatttataataaaagcagaggaacgctgaaaccaaacccaattcatatcagtaatagctaccatttgttaagcttccacaatgacaagtaagatgttaagccctttatgttaccaggattatctcatttatctcataagaattctagaacataggtcctattattatctttattttattcgtgagaaaagcagagactcagaaggcttaagtcataggccaaggtcatccagccagttgaatggtggagtggggaatatctggatccaggcagtcagactgtttttttttgtttttttttttttgagacggagtctcgctctgtcacccaggctggagtgcagtgccgtgatctcggctcactgcaagctccgcctcccaggttcacgccattctcctgcctcagcctcccaagtagctgggactacaggcgcccaccaccacgcccggctaattttttttttttttgtatttttagtagagacggggtttcaccatgttagccaggatggtctcgatctccagacctcgtgatctgcccaccaggcagtcagactttattagaacatgcacttaaaattagcaagaaggaatgagaacaacaacaacaaaattaaaaaatgcttgccaaagaaaactaaaacaatgtgcaatatttagccctgagatcactagcagtgaaggcaaagaagaatgcataatgggtttctacagctctcactgtccggttatagaaaatatttctacattagtacaagcacttttcttcctaagccctgagttttgagagtttatcaagaaggcctctgagttcattcaattaatggcatcatctaaggctgtttaataacaaatgcagaggtagtccacataaggaacttttgcctttacctttgagacaaagcccagggcctcacgttaggagtacagctctctaaatataagcctccagggcagaagcgaggggaggatggagggacacaatgcagatttacagcctggtgggtacggcctttgtcctctccatgtctattgtcactcttgaggtccaagcctctactgcactgcctggtttactgcacaacccaacttggctgcttgcttctggtctctccccaccaaaccatccttcacactgcttccagcttaatatttccaagacactgcatttgcaaatccactcctctgtttaaaaatgtttcagtgacttgcaacttgtctacagtgtgaagtataaatttattagcttgttgtttaaagccttctacaaccagaccccgaccgaccttcacgtcctattgagaggtgacagcctgctggcagccctcgcagccctggctcgctcttggcgcctcctcggccttggcacccactctggccgcgcttgaggagcccctcagcccgcagctgcactgtaggagcccctttctgggctggccaaggccggagccagctccctcagcttgcagggaggtgtggagggagaggcgcaggcgggaaccggggctgcgctcggcgcttgcgggccagcgcgagttcccggtgggcgtgggctcggcgggccccgcaatcggagcagccggcccgccagccccgggcagtgaggggtttagtacctgggccagcagctgccgtgctccatttctcgccgggccttagctgcctccccgcggggcagggctcgggacctgcagcccaccatgactgagcagcccgccatgactgagccgcctgccggcgccccagccatgggctcctacgcggccggagcctccccgacgagcgccgccccctaatccgcggtgcccagtcccatcaacccccaaagggctgaggagtgccggtgcacagcgcgggattggcaggcagctccacctgctgcccgctgccgcatccacttggtgaagccagctgagttcctaagtctagtggggacttggagaacctttatgtctagctaagggattgtaaatacaccaatgggcactctgtatctagctcaaggtttgcaaacacaccaatcagcaccctgtgtctagctcagggtttgtgaatgaaccaatcggcactgtgtatctagttaatctggtggggacttggagaacctttgtctagctaagggattgtgaatgcaccaatcggcactctgtatctagctcaaagtttgtaaatgcaccaatcagcactctgtgtctagctcacggtttgtaaatacaccaatcgacactgtgtatctcgctaatctagtggtgacctggagaacttttgtgtctagctcagggattataaacgcaccaatcagcaccctgtcaaaacggctcaatcagctctctgtaaaacagaccaatcagctctctctaaaatggaccaatcagcaggatgtgggtggggccagagaagagaataaacacaggctgccctaagacagcagcagtaactcactaggattttcttaccacagtatggaagctttgttctttttgttttttaggtctgcactgcctttatgagctgtaacactcactgcaaatgtctgcagcttcactcctgaagctagtgagatacacgaacccaccggggtgaactagcaactccagtacatgccgtcttaaaagctgtaacactcaggcgaaggtctgcagcttcactcctgagccagcaagaccacaaacccaccagaaggaaaaaactccaaacccatcggaacatctgagggaacaaactccagacacaccgcctttaaaaactaacaccgcgagggtctgcagcttcagtcttgcgttagtgagaccaagaacccatcaattctggacacactatcaactttgtttctccaagggtgcttcttaaactggatgatgcacaccctaggagtgtgtgtgtaggatggggtttgaagcagtagggtaaaaaacctagcatacattctattccagaggtgtcaatttaccagacaacagttattttaaaacttttttatgcaaaaacatgttatagggtggaatgcaacatttttatgggcctgtgggccatttgtatacatctttggagaaatggctatttaagtactctgcccattaattctaaacttaaaactaagacttcaaagtccctctaaggattttgctgggccacatcccaagaccctgaagggtattacttactcgccctctccaaactgccgaagtcggaagcaggtgacaaaaaagctgaccctggaatcaccttttgtaaatttcccacctccaagcttttcgatagtttgtaacactggctcctctccccaaaagcctttccttcaagtcccagcaactctccctgaccctgctgggaaggcgcaccaattacctgtcattccaggaaagctcatagcataagatgatcccattggtcatctcccagaaccagactttctgaaaagtcctcaaggaccagctagtccaatccctcactgaataaaggagaagcaaagtctagggaggtgaggtgattcgttgtcctcctaattagcaggtgagctcctggcagggctggggtttcatcttctgggctctctgcaaggtcgtgcccggcacgggccaggaacaatttcataaactcgtcatctagacggcctttgactgacaccatctctccgtgtggaggagccgctggggtgcacggggcaggtgtcgtccgtttcaaaggtaaaataacccagctgcagacctccagaggccgactagagccggggtcagaaaacaggttttccctctcggggacagcgcccaggggaccggcattagaacatcggctgatgtttcatctggtcagggaaccatccagcgcttagtacacctggcgctaatcggcggggattaatctcacaccccgcagctggcggaaagcagcgggaggaggcacctagccctggggttgagatcccagttcccgcgtgcgcaaaccacgcccctgtagattctcgctgctgcgtgttcgcgcgcgtcccggagtgcgcatgc

SEQ ID NO: 535 - DNA, 95628 bp, Homo sapiens
cacagcattaacatttagtgggagtgcagtgagaattgggtttaacttctggcatttctgggcttgtggcttgtggttgattttttatttactttgcaaaagtttctgataggcggagcatctagtttcaacttccttttgcagcaagttctttcctgcactaatcacaattcttggaagaggagaactggacgttgtgaacagagttagctggtaaatgtcctcttaaaagatccaaaaaatgagacttctagcaaagattatttgccttatgttatgggctatttgtgtagcagaaggtaagattaaaagagactcttttctgaaaactgtattatgaaacatttgctaatgatgcttttcacaggagtaataaaaatttgatttagaaaatgtgcttaagtattctgtaacttgacaattgagtggcttttgacattgttgagtttaaaaaatgtaagaaccttatttgaatggtatatctaaatattcatcataattatatttaatataaaatagaataaaatgttttaataaacatttctgaaaaactatgatctggaataatcatttcccttgtaattatcataaaatgtaatttacttttttgcttaggagtataaccaaaatgtattatgtgaaagcattaagaaggatgtgaatatacatagtcaataaaagccatcaaatcataatgattagatttatttcaaatatgattttaactcttcctaaataaaaattcatttatcatttacaactgatattgtcatgaccttagaattcttgtagacaagtattacttgtattatcagaataaaaatattatataaatttgaaacccaattgaatatacaatatttgtaacagttaagttgttcaatagagatttttttcctgtagttgtatataacatatattcttgaagagcagtcttttggagtagtgaatatgaatgtaggagtttttttctgacctcagtaagacaatttctggattcataataaaatttaattatatcactgcttcttgatagattaaaaagcttattcttggaggaggtttgctttcctagtttttgataggtaaccagttatgtgatagatatttggtaaacatttttaaactgaatgaattacatattattcataatttctaaaatcttttcacttagtaaagaaattttgattgagtgaccattacatagcctctaggaactgaagaatattagcaaataatacaaatctctgtttcagtcttccaatctagaaaataaaagcagatatattcttatagttatacactttggtaatttaaaaaatattcaaatatgtttaataccttttgaaaggttgaattattttcagttatattttctaatgttattgcttgttctttggcttgtaaactttatatgtagccactttttaaatgaagaaaacaattatttccttgtacatataaatattataattagtattttaaaatgaaacctttttgtatttacaaacagttccagaacaatgtcaatattacctattgtaaaagacatctttttctgtttctttgtgtaaatatttctgtcttttcttactaaatttatgggaatgtttctaacgtttcatacctacatactgtttgctccagttttacatagataccatttgtcatataagggagatttgttttatttctaatctttaaaatcaagaatcaatggcaagtttaataaacagtttaagttattaaaaagttgaatttgaaatattattaaaatagagtacatcaaagtatatgtgataattaaacaatagtgatttaaacatcttatttacataattgattattgctgacttgtttcacttttattttatttttcatcaatgtgtgtttaaatgtggtatcagtttctactggtgaattgaacatcggcactatatatgttatggtgaaaatgatataaatctgattatttcctaaaagataaagcacaactttgtatttaaagcaatgcttaggccagcctcataattttcataaaagcacatgtaatgcaaaagccaatggagaaaaactacatgaattttcagtggatatcagactcctaatttattccttgtttcccaaatactctctgaaactaaactagttcgagatgtccatcagttctattaatctaccatatctaaaaaatttttacttaacagagtagctttgatcatgaaaaatactcacatatatttcaatatttgcttctgtttatattttccacattgaatactgaataccaaattgagaagatagtttgaatactatcacaatctgctttattcaacagcataacattttagcattacttctgctctgttaagagtgaactttcttcaaaaaaaacactattcattactaagaaagaattatagccagcaggaataatttgtaatttcagctttctatttgttttctttttttaatatattgggtactacatagaacctttctaatgcaatatattgtctacaataacatttccaattgtgtaggaacgttaattgcctccttgttttaacagtctggctcagggggtcactgcaggctactaagaattgggtcagatttacaggacaaagtttaaaataacagtttctcaatcgtaccacctaatttcacctttttgaaatatagtatgaccaaggttttgaatatattatgaccaagcagattttttagatttagggtctaacaattgtgtactatatgaaattaggccacagcccagaaattccaagatgattaaagtgaataaattaaaactctactgaaacatgttcaagtaaatactggctgtgttgtttgggagacatgttttttaatcctggagatttagagtgcagaaacgttatttcaggtcccagaagactttatagatcagagattgatggattccattacagtcagagaaaggagaatagtggtctaaaatcctaaattgtatgtttgaatttcagtgtgataaataagaattcccctttgctcccccaaacccccatattttcagagatagtagtatgtgtatttatctatatggtgtgatttaaattgtgcgatggcccaattggcttcaatatctcatctcctcctaaaatactttacgtgttgatattaatattactataatttcaaccaatctgtcatttacatggaatgacaaatacactgaatacatattttaggatagttaaatttagtattattcataatttactttgaattattatcatctgacaacttccctgaaacaatttcagtgggcgggggagggtagaaatggatgttgatgaggataagaatagaacaaagtgattctggaagatggggttttcccaggtaggacagatctgctggttgaagtgctatagtgagtgctataagagaaggggtagagaaaatgcccacagaaatggcacgagcctgagacgtctgccaaggcaagctttgcttattttaaatttaggcatatcctgggaatgcatatgctactcttttgcctacatataatttaaactaaaaatgaaatatctaagtattgctaactaaaattattcttaggtagaagtaagttcccaaatataagttcaaaagcagattggtaaatgttcttcatgtgtggcctttggtttctaagatctgagccagtctacattgacccacttttatttgcttaatcctcgattgtttattctgcagtcttttgccacttttcattcttcccagttatgccttctcctcctccccacacacaccatcccccacctgcctaggcctttgagattctgccacccaatctatcccgtgctcagttaactaacgtgtactttacccatttcttcacaaaaccatagtacatggaaaggggatgatgtaattgacaaaaaagtattgcattttagcttaaaattataaggagtcataaaaagatagctcagaggaaataaagtaactgaacatcaaaaaatgaaacaataaaaaggaaagaaaaaacatttgacagaacacttttatttcttctgacattttaacttagccaagtttttcataaaccttgttaactggaaatgtaatagatagaaaagtgattattcttccaggccgggcatggtggctcacacctgtaatcccaacactttgggaggcccaggtgggtggatcaccatgtcaggagttcgagaccagcctgaccaaaatggtgaaaccccatctctactaaaaatacaaaaattagccaggcgtggtggcgcgtgcctgtaatctcagctactcaggaggctgaggcaggagaattgcttgaatcagggaggcggaggttgcagtgagctgagatcatgccattgcccttcagcttgggcgacagagggagattccatctcaaaaagaaaaaaaaaaaaaagaaagaaagaaagaaagaaaaggaaaaagcaatattctttcagaaactcctgaactgtaacataaatttaagcttaggacacataggtcagatgtacaatggaattacaaatgttagagtttcctgggttcttgcaacagagttttaagtgcactaaacagttatcaccttgtcttctcttatattttctagtcactactgtctactacgctttttccacaggctgtccataatctacagatataatggaaaggcttccagatagtttcattgttactcatctgttctttcgctcattcatttttccatcactttaacttccacaagtactacttagtaatacttggtacaatgtgtgttgcgtttttttttttttttctctattttcagggtcctaattgtactgtctctttgtggctgagttcgttttttgtgactggaacaataactggcattagaaattagctattcaaatacacatttcaagaaagttgtggaatttcaacccatgttctgatagtatcttgttttatctctaattatgacatacttgttattctatccaacttcatgtgactatcgtctattctcctatctgctttttatggttctggaattttcttcttgctcttttcactgttaagttgtttgtttgtttgtttgtttgttttgagacaggatctcgctttgttgcctgaggctggagtgcccacgctggagtgcagtggtgcgatcatagttcactgcagcttccaacacctgggctcaagcaatcctcctgcctcagcctcccacacctagctaaatttttttcttttcttttttctttttctttctcaaatgcctattaagtgtgacataatctctattctgctttgtctctagagtttgtttctttaaacaattctttactctgtttacaaaggtatatatgttacttctgaaatgatctttattctcatgttatttataaaataatttgaatatttcttattttgaaaagctaattagatcatatcgtatatatgcatatagaattgacccttgaccaatatgtgcttgaacttcaggggtctgcttactatgtgaatttgtttcaactaaacctgggtcaaaaatacagtattggtgggttgcaaaacttaagcataggaaaaactgacttttcgtacatgcggtttccagagagccaaatgtagaatttaagtatgtgcagattttggcctgtgtgggagtcctggaatatatatcccctgtgtataccaaagccaaaggattattgaataaatagtattactatagatcagtgagaagataagaaagaaatttaatgcaaaatacctatttttgctatttctgttttgttcatttgctttatttttttccaaattgattttgtaactttgctttataatatattctgatacctactaagtttagaagtaggctatttaaaaaataatatctactgttttttatgcacaaaataattttagaaaaatagaataattgaacaaagagaccaactttagtctaccaaaacaatctagcacaaatttgattaaggatttcccaaatatataattttatcatgatttatttcatttgaataaaaacacttttcaactaacagttaaaagatatattgacattgaaaataagtaattagttctatgtttgtatgtcaataataagtaattagcttggtgtttgtatgtcaataatgcccccttaaaatttgaaagtgaaaaaattaggtaaattaagattattaaaatattaagtaatattgatttttagctttgaccaaaattatataactattttcctcaaattatagtaaaaacattcctactctttaccagtagttaaacgtattcacactcttaattcatgggctaaaaaaaaacttgattttgtttagtattattcttacttttttgagacagggaatcactttgtcacccaggctgcagcgtactggtgcaatcatggctcactgcagcctcgacctcctgggctcaagcagtcctcccacctaagcatcccaagtagcagggattacagccaccttgctcaggtaattttttttttttttttttttttgagatggagtcttgctctgtcgcccaggctggagtgcagtgtcgctatctcggctcactgcaagctccgcctcccgggttcacgccattctcctgcctcagcctcccgagtagctgggactacaggcacccaccaccaagcccggctatttttttgtatttgtagtagagacggagtttcaccgtgttagtgttagtcaggatggtctggatctcctgacctcgtgatctggtgatctgccggccttggcctcccaaagtgctgggattacaggcatgagccaccgcgcccggcctgctcaggtaatttttaaaattttttgtagagacagggtttcaccacgttgcccaggctggtcttgaactcctggggtctattgatcctcttgacttggcatgtcaaagtgctgggattataagcatgacccactgcatccagactaaaactaattttaaattgtaaaataaagccaaatgaattaaagcttcaccaatgtagtgttttgtaaacaaaattaactggcaattaaatgacttgtaaacgtaagatgaagtattcattgtttaaactcaaatacttagatatgatggcttagtctactcattaatctagaatgagaaaaatgagatggctatttcttttagttttaagataaatcacatctcaaaaaaatgtttctgtgcctttcaatttgtatgcatcctatttaataagcccgttgtacatacatgctgagagtttgactacttgggccaaaataaccgtttgttgtctacttgaaggtggttcaactgagcttgaacattcgattgttagtcaattcaggcaaataaaagttatgtcacaagatatacctaattattattagaactcagtgcagtgaatcattaccttaaatacttttgctatggcatgagttgataatgatgtaggacagcaagcccccaaattgggtcttagcctgggaaggttcttggttttgtccagtaaagaattcaagggtgagcctgtggtgttaaacagcaatttttgttgaagtggcagtgtatagcagcctcagaggcacctctccttgctaagcagggctacccataggcagtgtgcccacagtagcagctcagaggcagttctgcactcatatttatatgcacttttaattatatggaaattaagaggtagttaatgctgaaattgccaggaggaggatggtaacttccggttgttgggtcattgctgtggaaagggcctgtaacttctgggtgttgccatggtaatggtaaactgtcatagcacactggtctgtgtgtcttacagggaggggcttccactcagacctgttttggataatcctcaatttggtccagtgtccaagtcccatctcctatctcaataatactcaatacaataatggttagaacaaaagcagacaggaaagtgtatctgaagtgagaagacctagacattaatgaaaattcttccacgaactatgaaaaacattgttcttcaattgtggggagcttacattttgatgtggggagatagatagaaaacctaatgaacaaaaatagttatagcattgtgaaaaattttgtgaaggaggtaaagtagggcctaagagaaaatagagatggggatggtagtatgtagagacattaggtgggcttggtcttggggactagaatgagtggatcactttgaggacagaacatttgagtagaggcctgaaagatgagacaaagccagtcatcagaaatctgtcgtaaaattattctaagaggaggaaataacccgtgtaaaggatctaaggaaaaaataagtttgaaatgctcaacaaaatataaacaaataaatcagcgtgactttgcacagtaaatacatgggagatttaacatgatgagatccgagaaagtggcaagagccagataaggggttcccaaaccaaggaaaggagttagcaatgctggataagtaaaaagtgaagtcatagaagaattttaatcacaggaatgacatgaccagatttgcaagaatcacttgtcactctgtgaatagactgaagtaacaggagagtagaggactggaggctagttagcaggcaagtttcatgaccaaagtgacagatgatgatctgaactaagattttgaagatggtagtaggagcaagggaaaatagaacaggggcggtcatatctttttcttacaagcagaatcaaaagatgccatttaacactgatggaaaaagcaccagaattttaagtactatttgaagagaaaaggtaatcaatatgataattctttatatatagtaaacatattcacagagtaaatattgtgagaagttggtaggaagattttgtggaagagatgtatccttgttttctacatctggttgttaaaagcaatgaactatatttggaaatcaagaattaggggcacaaacgtatcacctggaaatataataataaccagaagggaaagcatttacttctcactaggaagtgagcgggctaaactttttttgtgttaatggattactttacttatttattttttccaataacctgaacatcatcaaatggatctaaattttgaaagtgaaaaacaaacatatcagcttgtaattaatcagttttccttttgtgcggaaggggccggggattgtgttgttatgatagagtattagcaccatctagtggagtagaatatgtttacttaaattataaacatcgaaatagtgcaatgtggaatcacatattatatgagttcactaatacaaatttgcaaaaaggtcaagggaaaattagtgcccataaaaactttcacattattttgtaaaatataattttatatggtgttttctttcttatgaaatattgcaaaatgttttcatatggatttgttccaccatgttaatgggcacttctaaaacttttttctttgggctgctacaacaaaatattattaactgcctagcttataaacaacaggaatgtatttcttacacttctgaatgctagaaagtctaacagcaagatagtaccagcagattcagtgtttggtgaggtctgctctctggttcatagacagtgccttttggctgtgtcctccaatgatgaaagggacaaggcagctctgtggtgcctcttctataaaggcacacatcccaaatcatgacagctccaccttcacgacctaatcacttcccagtgtccccacctcctaatactatcacattggtaattaggtttaaacatataaattgggggttgtggggaggttgcatgtattcagagcatagcatatgccttcttaacttactaaagtctaataataatttatcactcaggattcaatgcgggaagcttaagtagaagtagaagattacctatctatcagtcaattaattgattgacataccaatctcctatctacctacttaaaaagaggttttgttttgtttgttttgttttgttttgttttttaaataaattgcctcaaggaattgtgagcatgagataagcaagtctgaaatccacagggcaggtagtcagaaaaggaagattacagacaggatggaactcacaggaaaggaagctgctttccacagaattccctctctttttcagaggagcctcagccctatgtttcagacctttcaaatgatttgatctggcctatctagattacctagaatgatcagcttgtttaaagtcaactgattgggagtgtatctggcaacatattttctcaccaacatttagattagtttgactcaataactgggaatgctgacttaagcaagatgacttattaagaaaactgtcacagctcattaatacctttctgtttttctggacactgtgaagaacttaaaagacattaattttattaatccttctcacagtttacctactattgtcatgtgttttatgtatatgggtgtatacacatacatgtttgtatttaaaaccatgtaaggtaatatttttattattttatagtcagtattcatttatatttacttgaacatttaccattttctttgtttttcatttcttctttcatcctaagaccttatatttaggatcagtttcagttttctgaaatatatcttttttctctccttaatgtgtatttatagtggcaaattctctcaaattttattaatcagcccgggcacggtggctcactcctgcaatcccagcattttgggaggctaaggtgagtggattgcttgagcccaggagtttgagaccagcctgggcaaaacggcaaaacctcgtctctacaaaaaatacaaaaattagctgagagaggtagtttgtgactgtagtcacagctacttggggggctgaggcaggggaccacttgagcccagggggtcagggtcgcagcgagctaaaatcacaccactgcactccagcctgggcaatagagatcttgtcaaaaaataaaataaaataaattttatgaatcaaaactttattctcaaaaaattatttctgtatatagaattctatatagatagttatttcttcctgaaaatggaagtgattaatacctggtggcgtctgctattgctattgagaagtctttgtaaatctaaccattactgcttttaaattaatatttttctctaacaaggttaagatattttctctttggttttctgcatattccttatgatgcatataggtgtgtttttttactgcttggaattttttaattcttggatatattaattggtatgttccattcattttttaaaattctcttccaacattgctctggcttttctatcctcattgactcttagctcatcttgtgtattttccacacatgtgtgtctccatgttgcatcctgtattatttcttttgacctgccctcctgtccacgaattctttttacaactgtgttatctgctattaagctgtccattgatgattaaaatgggttttttcatttttagaaattatatttggttctttttaaaatctgctactactttgttataatttctttcctcagatatcattagtcaaacttttctcttacatttaaacaacagaattagtattgttgattatagtctgtatatatttattccaatatcaaatatctattttgttccttatgaagtttatggtaactaggtgctttttctcccgtataatgtctttgacatttgtaataataatttggtgcttaagaaaaaaatcttcctcatattaaagttacaacttatcttttctgggtggctagaagaactttcagtgtgagactaccttaagccaaatttgtgctttaaaattccttggtgctctaagcaattcaaagctgggttcctgtaagaagagtgtggtttacttccagttctcccttatcctgtgggtgaattcatttaggtttccaactttgaattttgttgctttagcctaataaggctatcaaaaagcaagcttgtgtcttccccaaatggtgaatgcccacagtgcagaaaaaaattggctgcctgttttcctttctgggttctgattataccaagatatgttatggtaattctttactgtctcgtcagctttctaaatgcctctatgaaagtatttatttcaaaacatatgttttcctgtttttttccccttttgtgacagggtctcaccctgtctctcggctggagtgcggtgacatgatcatagctcactgcatccttaaactcctgggctcaagagaccctcctgtcccagcctctcacatagctgggacaacaagtgtgtgccaccatgggtaactaatttgtttctttaattttttgtagagatgggatcttgctatattgcccagggtggtctcagactcctgggctcaaggggattctcccacctcagcctcccaaaatgttgggattacaggtgtgagccaccatggctggccacctggttttattgtgaaggtgtcctaagtgataagattaatctgaaataatgaatcccaaggcactcaaattttttgtgaaatagccagacaataaatattttagacttcgtgagccataatgtctcgctactcagctcttctattgtaacataaaaggagtcatagacaatatataactatatgagcatagctgtgttctactaaaattttatttacaaaacaagcagcgattggatttggcccacaggttagttttctggcccctgacctaatgtatctcactataacagaaaatatatactgactttccttcttactattataaattttatgcacataattaaatattacccaaaccacaatttttaattcagatgggtgtagcataatttgacaattttcataaatattctaattatatccattattaaaaatgctggaataaacactctgtacctaaatatttcacaaaatctttaattattatttgttacttttaaaaaattgaaattatttgtcaacttacgtatgagtacttttaagattctttattgctaagttgctttttagtgaagtaatagtcatttatatttcagttttatttaataataatatttatattacctaattttccagcaaaattgattatcatctcctttacatttttgtgttaaaattggtcaaaaaataattttcttttaatttttatctcttttaattattggtaatggtcacgttaatgcctgttcttaagtaaatgatctatcctactctaacatttttctttagatagtgtttagtgcttttgttactgcaagaagtgtttgtgttaagaataatttttcagttaaattttctccacattttgtatatatgattttttcacaaatataatttttaattaacaaagttttaatgtgtatatgttctgtttgcaaattgctttatgcattaagccttccttttttgatatttattcatactttttaataaatatatttataaaataaatataattatagatagatggcactaagataatagtaagttaaaatgacatatcatcatatatagcagataattaaaaaattataaaagaatgaaacatatatgtatttattttaaatttgtttaaacctaactctttagtctacctggcatttgtgtgcatgtgtctgtgcaaataaagtaaggattcaaatttatcccatttcatttccagtgggttttattttttatttattattattatatttttttgagacagagctttgctcttgttgcccaggctggagtgcaatggcgtgatcttgggttactgcaatctccgcctctcaggttcaagagattctcctgcctcacgcccccacgtagctgggattacaggcatgtgccacaacagttggctaattttgtatttttagtagagacggggtttcgacatgtttgtcgggctagtctcgaactcctgacctcaggtgatccacccatctcagcctcccaaagtgctgggaatataggcgtgagccaccgcacccggccccagtggattttaattgcaagcctgccagagtgagtttcaatttgaggtagtccaagtttacacagtacgatagacttacccattgccaaggttacttggcttgaaggaaaatacagaataaggataaaggcagtatgcacaagaacagcttgatggagatttcaggcactgaaactcagcttctaatatcttaacccccaccaggataattttgctgatgaaggatgaaagttgatgccagtataggtcacatccatgcccggtaacaacagaattgggtatccttagtttaaatactttagttgtcaccttgaacttggagggtgatttatgtgatcatcactattatttgctgttttctattttctttagatttcatttaatgttttactagtttcttgaattagaaatttggataattgatttccaacagttttttatttctaattcattcgagttatatttttttctctctaatcagtgcttcagcatcagcccacaaattttaacatatatttccattattgtttatttcaaatcatattctcatttatattatatttttctttaactcatgagttatttataagtgttgcttgccaagtgcggtggctcacgcctgtaatctcagcactttgggaggccgaggtgggcggatcacttttgggaggccgaggtcaggagattgagaccatcctggctaacacggtgaaacaccgtttctactaaaaatacaagaaaaaaaaacccaaaaaatagccgggcatggtggcgggcacctgtagttccagctactcagatggctgaggcaggagaatggcgtgaacccaggagtggaggttgtggtgagctgagattgggcactccagcatgggggacagagcgagactccgtctcaaaaaaaaaaaaaaaaaaaaagggttgcttaacttcaaaaattttgtgaattttccacttattttctgttagcaatgtctagtggtcagggagtatacttagagtggctttaattttttgagattggtagagatttgcttggaatgaatatgcatcttgcaattgttgaagacagtgttttattaatataaaaaacttaatttggttaataatgttgcttatatcttgtatatccttatttttctatttcttttctattggatattggaaacagtgtgcttaaatctcaaactatgatggtggattgcttacttcttttatttctgttatattttgaagatgtattaatagttttatgcaaagaggcatgctggtaaatgtaaaacaaccaactattttttaaaaggaaagggaacaaccatgatttgtaaaatttgctgagtttcatggtgtaaattctcacaatatggtcaatttcaagttaccaacgtgtcatcaggagacattgtattagcaaaagatgtgtataattggctcctatgagtcagtatgagccagctccagcaaacattgttcagacacatttgcaattattacatctttctgttaaagtagcctttttattaatatgaaatgactctctttttatctaataatactttctaactaaaattatcatttgcttgatattaatacattaatatcattcttactttggttgatacttttctagcatattggtttttatcatttactctcaatttatatgtacaattttattaaaagtaatcatcatatatttgagttttcttttatgcttttatccagtcagacaatctttgtatgtttagtatggtgatgaatccatttatatttaatgtaattactgatacagttcagtttaagtctagcatattgctacttacttttgcctcaatttttctctcttcttttcctgccttctcttattttaatcaaatagtcttgactatctcattacatcatgtattctagttattttatgtatctcaatattattggtttagtggctaacttagcaattacaacaaaacatgcttaaattattacaatttattctaaattaatatttttaccacatcaagactatggggaaaacatcacaacacttttattttctttaccttttcctgacacttttgctactattgtttcatattatactcttgaatttattaaaaacactattaaacatggtctattgatttaaacagtcaaggctcttttttatttgagtaaaatatacatagcatagggtttatcatgtttcaatagcttttttatttactcttctatttattttcttcagttctgcttattcctttttgtacttctttgcttatattttagatcagtttccttcagcccagagaacttttttagtatttttctatagttgagtctgctcttgttgaattctttctgcttttgtttgcttaagaatgtgtttctatttgctttcatttttgaagtatattttcaccatttatagagttctctgctgacttttaattttcagcactttagtaatgctaagacatatatattcagacttcagtatttacttccacagacttggctgttatttttactattctcctggaaaaaaaatgtttcctctgtctgtgatatggtttggctctgtgtccccacccaaatctcatcttaaattataatctccataatcatcacatgtcaagggaggaactcagtgggaggtgactggatcatgggggttgtttgtcccatgctgttctcatgatagtgagtgagttcttatgagatttaatggtttaagcatctggcatttccccaacttgcacttctctctcctgctaccatatgaagaagatcctctcttcttcttcaccttccactatgattgtaagtttcctgaagcctccccaaccatgtgaaagtatgaatcagtttaaacttctttttttatgaactacccagtctcaggtaattctttatagcagtgcaaaatggactaatacagtaaattggtaccaaggtagtagggcactattataaagatacctcaaaatgtggaagtgactttggaactgggtaatgggcagaggttggaacagtttggaggtctcaaaagaagacaggaagatgtgggaaagcttggaacttcctagagacttgttgaatgctttagaccaaaatgctgatagtgatctggaatatgaagtccaggctgaggtggtctcagatggggacaaggaacttattgggagctggatcaaagatcactctaactgtgttttagcaaagagattggcaacattttgccccttccctagagatctgtggaactttgaactttgagaaagttggtctgaaattggaacttatgtttaaaagggaagcagagcataaaagtttggaaaatttgcagcctgatgatgcaatagaaataaaacccgaattttcttgggaaaaatgcaagcccactggagaaatctgtgtaaggaatgaggagccaaatgttaatcaccatgacaagggaaaaatgtctccagggaatgttagtgatctttaaggcagcctctcccatcacaggcctggttgcctcggaaggaaaaatggttttgcaggcctgggccccactgctgtatgcagtctcaggagttggtggcttgcatcctagctgcaccagctgcagccatgtctaaaaggggccaacatacagcttgggccattgcttcagataatgaaagccctaagccttggcagcttccacatggtgttggtcctgtgggtacacagaatacaaaacctccacctagattcagaaaatgtatataagtgcttagatgtccaggcagaggtgtgctgcaagggaggaaccctcatggagaacctctactagggcaatgagcaagggaaatgtaggattggagcccccacacagaggtcccagtggggcactacctaatggagctgtgagaagagggccacagatcctccagatcccagaatggtagattcactgacaggttgcaccttgtgcctggaaaagccacagagactcaatgccagcagtgaaagtagccagggcagggggccataccttgcaaaaccattggggcaggtctgcccaaggctgtgggagctcacctcttgcatcagtgtgacctgaatgtgagacatggaatcaaaggggactgttttggaactttgagttttaatgacttccctattggatttctgactttcatggagcctttggtccctttgttttagccaattcatcccatttgggatgggagcatttacccaatgcctgtattcccattgtatcttgaaaatgactaattttcttttgattttacaagctcatatgtggaagggacttgccttgtctcagatgagactttggacatggactttagggttaatgctgtagtgagttaagacttggggggactgttgggaaggcatgattatgttttgaaatgtgaggacatgagatttgggaaaggcaaggggcagaataatatggttaggctctgtgtccctacccaaatctcatcttaaattgtaatcaccataatccctgtgtgttgagggaaggacccagtgggacgtgcttggatcatggggcagtttctcctatgctattctcgtgatagtgaatgagttctcatgaggtttgatggttttataagcatctggcatttcccctgtttgcacttctctcttgccatcatgtgaagaggtctttccttccccttccaccatgactgtaactttcctgaggcctccccaaccatgtggaattgtgagtcaattatatctcttttctttataaattacccagtcttgagtatttcttcatagctgtgcaaaaatggactaatacaatctgcttttaagattttgcctttatctttggttttcagcagagtatcagtataggttttcttggtatacagcattttgggggtttttagaaattttgattttgtgagctgatttctttcatcaattttggaaacctttgagctattgtttcttcaaatattgcctatgttcattttcttctctattgttagaattccaattaaacatgttttataacttgactctacaccacacatttttttatactctgttttgtttgttgttgtttatacacttttgtctttctatatttccttttggttatttttacattaaacttcctctaagtttaataagtttgtattgtgctgtgtccatttgattcttaaaaccatctgacaagttgttatttctgatttttgatccaattttaagatagcacatgatttatgagtcaattttattttgaatatcttttttaaattttcatttctatattttctatagttcctttaatgttcctaaaatagctgttataaagacctaacactaattctaacatctgaatctgagtgtctagttctactgaatatttattttctctttttgttcacagttgtttttgcttttttgtgtatcttttaatttttattcaaaatcgtatttttaaacaaaaacatgtaatgacaaaagtttatataacttactctcatcaacaagattgtttgctctttcttgagccactcaaaaatttaactcagagggacctgggtaacacttttagtttgagtcagtcccatttctggtttctagtctcaaagattaaaccctcttgggtttttaaagtcaagaatctggttggtttcttctatctcaaaagactaatacacacacacacacacacacacacacacacacacacacagagtatatacatatacacatatatatacataaatataaatatgtgtatatatatatactatatatgtgtgtacatatattagacttttgagatagaagaagccaacacatatatattatgtatgtgagcatatgatatatatataataaaagccatttatatatatgtttgcttttctgctgttttgactctgttcttatatatatataatcttaaatgctcatatataaatgaaacagcagaaaagtgaacatatatataagagcttttattatatataaataatatatatatgtatacagcttttctgctgttttgacatctgctcttaaatatcatccagagtgactttcaaatatggcatgttttgatgagaatactagttgtgtatttgagtcagatccattttcttattgagactttttttctatgagacaacgggaaagtcagtcttcccgtatgaagctacctagactctagcaaagcaacctgatttggcaaagtttcagaattcttcatgctagatatagcctccttatgtttggttctttcttacctcattaccattcttccattcagactaaatagaggcctgatcttcaatccatatccagagctgacaaacataaccaggtaaaaaatggccagagaccctatatttacttgaaacaggtccttcctacttgtgttttgttcatttaatcctctttgctcccacaacttacctttgaacatacacatgcacacacaatttgttgttgttccaatttggagtagaaacattgttcttttccatcctattctatcttatttggagtgcctgtataattctgtattaacttatcatgctaatttttgtaaatataatttttctacctgtaatgcatattatacatctctttgattacttaataactggcttccctaatagaatggaaatgctttgagaacagatagtttgtttcttcattgttttttctttataacttagaatagtgctcaataaatatttcccaaattaatggaagaatagtagaatgctctccagcaattaagagtaatataacaaaatatatctattgctttgcaaagttttttaggtgtttttccacagtgaacattcttataaaattatgtagatacaaattttataaggtgaaatgtatagttacactacatgcatgaaatgtatgtttactccatagatatggggttaggagagagagagagagagagagaaatttagatagacctgtgactgtctaggcatttttaaaagcaacaattacctaaatatactgtacatttaaatagacactttatgcacttattttgtttttattgtttgtagattgcaatgaacttcctccaagaagaaatacagaaattctgacaggttcctggtctgaccaaacatatccagaaggcacccaggctatctataaatgccgccctggatatagatctcttggaaatgtaataatggtatgcaggaagggagaatgggttgctcttaatccattaaggaaatgtcagagtaagtacttaatacatttgtgaaatttatgaaaactaggtgtaaaaatacttaagatttaatattgtagcaattatgcctgaattatatcactattgccagtcaaatacaaaataatacataatcttttttttttgttttgagatggagtctggctctgtcacctaggctgcagtgcagtggcgcaattttgagatggagtctccctctatcgcctggctggagtgcagtggcgctatttcggctcactgcaacctctgcctccctggttcaagcaattctcctgcctcaacttcccgagtagctgggactataggcacgtgccaccacgcccggctaatttttgtatttttagtagagatggggtttcaccaatgctgggcaggctggtctcgaactcctggcctcgtgatccacccacctcagcctcccaaagtgctgggattacaggcgtgagccaccgtgcccagccaatacatcatcattttcaaaaaggggtggtcatcctccaaaattaaaaaagcaagcatatagtttaagttcaattatgaaataatggctttgctatgtttaattttccttacattcaatctgtcttcttatataatatcaaatatacttgttcccccactcctacataaaatatattccttgctattacatactaattcataactttttttttcgttttagaaaggccctgtggacatcctggagatactccttttggtacttttacccttacaggaggaaatgtgtttgaatatggtgtaaaagctgtgtatacatgtaatgaggggtatgtagtccatacgaaaagaggtttataattaagatagtaaataggaactctactactttatatatttttaaggttattatatttttctatgagcatttaaaaaagtaatacacaagtacctgaaagtttaactatgatggaaataattaaatctggataccatattatctccttaacattgaaaaatttaaatgaagtataacttctctgatagagtataattatgggagagtgggaaaacagtatgcacatatataagtattcacccaacaagtcttcacgacattctattttgtgcagagtatcatgggagttcaatgtgtcaggaacaataggaattgtaaccaatttatattgtatggtaactgttttgacaggttttataaaatttaaggaaagcaagactttcacctgcttataagttttacttacaactaaggttacttaatgtcccaggtctgcaaattattcttaccacatggattaaaaatactactctttcagaatcattgactctgttccttctaaccaactactgggttttcattgccaaaatcatcactgtatatcctcagtgttattttatcccccttattctctgctagatgaaaaattattttggagaaaaatttatgtatgggaaaaccaggattagatcactataatcgtatacttcataaatataaatgtaaccaaatattacaaatggaataacattattatttccccattttttccttaatttgaagcaataaaatataatagtttaaagcttagtcactggagtaagcctgcctttcaaaactctaccacttaacatttatgggtatttaaaaatatatctcttcactaccatttcctctcctacaaaacagacacattttatgtgcatcatggattggcaggaaaaataaataagacacacatctgcagcccttagaagagaccttgagatatagtagataccaaataagtataatttcttatgaatttattctctccttagtcactacctgagggaggtttttcaaatacatttttagcccttcaatcattactgctgatcttatcacacataaccaaataggttataatatcctggggctgaattttttaatttgctaccttcctcacctctgaaatatttcttttatcacaggcttgtgtcctctctttaagttcagcacttgacttggctaaggagataaaaatgtatagatctgaagcctctagcaatgattgcacattttgcacatgtcccagggaactcatattcaagtagagcattttttagattcaaagggcaggcttgatgggttactaaaattacttaagttcaacattagatggcttggatgagcagatttgactcactgggtattctcaggaaaaaatctctacgatagagatggagagatggaggcaagtgctgaaagtaaatcacacactaacaacttttggctggcactatctttattatgtagaaaccctaaggtgttcagaaaatatcagaatcatggaggacagaaatacggtctaagactggaggagagggaaacataaggttagtcgttggttactatggtatttttagcttttgttttggtgatagttcatggagcttactatattattgaatttagctaattagataattcaatgaaaaataagaatactttgtatgaaacaataatgattttgtcgtgaaccaaggattatgattattttcagtccatgcaccaagaaggagagaaagataaagggagagagaggttaagagatttttcatctatgaaaattagaggaagaagattaatgttctagagaacgttaagaaatctaagacagagtgaaggaggaggagaaggaggaaggaaaaacaaacaagaaacaagaaacaagaaaatgcatatgctgttcattttccttaatatggagtttctggacactcagaatggcatcgagtttaaaactgcatgtaaacacacattatgtcaacgttctgttattttttggttttcaggtatcaattgctaggtgagattaattaccgtgaatgtgacacagatggatggaccaatgatattcctatatgtgaaggtagacataaaatgtatttacaagtatattgaaataaatatctaagatttaaaaaaagtcttacattaaaatatcttaaagtctctattaaatatttttatttaatgtttttttttctcatacaatgtagagtgggaatctagtctttttattactacattcttggtgtttcaaaagccaaaaacgaatgcagcctgatctgatataataattgaagtattagacattaaggaatctaaaactgatttttatttccttttggattctaatgactagaaacgcatataagcatcattagctaaataaagaccagaattttgcctttattaatgaagaagaactcacccagtaaccacccaaatgcagggatctatggtaacagctgaagtggagaacgtgattgagacctcccactaagggaggttgcctgtggacttacctttactgaaaagaggaataaactaagggcgagctctgttatttctcactggtctgtaaagcaaacagtgaaaatgagaaaatgtagattctgttttcatgttttgagctaataatccaaatctctagtcattatggaaataaaagaaatcaaccagagtagtatttcctaattccacagtgagtggcaagtggagagagatacagaagaaacgtgataatcattcaaaaactgtcaactacagaaaataatggaagattttttcatctatgaaaattggaggaagaagattaatggtctagggaacatctacattgaaatcacctgggatgcttgttaaaaactaaaatctttggttactaaaaaatgacctactgaatcagtatctttggggtgagcatgcaggaagatagccctaaaatttttattttaacaagcatcctgagtcattctatagtacaataaagtttgaccacaactttagagaaattggaaaatattaagtagaatcaaaagaactactcaaattattttaaacacttaggtcgaagaggatggaaaattaacgatgatttctctattgaagttaatgtcataaagtttgcttttacatcttttaggaacacagtgttatattattctagggcataaatgaaaatgtatttaattatctcaagctttatatttcttaattatttaaaaatactagtttgttactacaaaaatacaagctagcattgaaagtagtaattttcattgtccactcccatagaaaagaatcaggaataaacattccatttgcttgtttcttagaggaaagtatctctagcaaacaggtatatcaaatgcttctaaaaataatttaagtaatttcctccaatcttatcctgaggatgattttatacatacacatatttttcacaataaacttttaaaattccattagaaaacattacatgtattttcttcagttgtgaagtgtttaccagtgacagcaccagagaatggaaaaattgtcagtagtgcaatggaaccagatcgggaataccattttggacaagcagtacggtttgtatgtaactcaggctacaagattgaaggagatgaagaaatgcattgttcagacgatggtttttggagtaaagagaaaccaaagtgtgtgggtaagatacacttactgttttagtatttttagctttttaaatgtaaatatacatttaaaacatcgttcattctaaggaatatcagcaatattaacaatagctaatgtttattgagcacttactatctgcctgtaattgagctaagttctttgcatgcatcatttcattttaactttcaaaaaactccatgatttacttactcatcactttcattttataatggaagagactggtgcaaagaagttaaatcacatgccctggattatcatggcataaagagtcaagttaggatttaaatgtaggttatctgacaccagagtccatgctttaaccataactccattgtagttgtctcttaggttgaaagagaatgctaagtatttctgctgcaagctgtaagacctctggaatagacatttgtttttattttgaaagccaaagattcattatgtatttccagagatacattagaatgacattcgtttttgaataacacttttaggaagcagacctattttatatttgtactgcaagtttactataaatgttgctgaattgaacagaatccactaaataaattgttgcctcttaaaaaaagttttatagtaaactgtaagccaggatttttttagtcataatactgccaacctgtgcatcatgaccaatcaaagattttggcttctgtgataaacatcgtggttgatttgtttagtagtaccatagttcaagttcattttaccaataattgtttggcagaagtttctggcatatttatattttaatattatctaaaatatctaaattatttttactattaaagtctgttatatcttagatacagataaaagaatttctcttcttaagaacactttgtaacaacaatagttctttatgttaaatctaatatttttattcagcatagcaaatattatgtactttagaagtacatggatggaatttacatccttacaactagattcctgtggttagtgaaaacttcctggaatggctgatgcctacgattaagtcttaaagaaaaaaaacgagattttgtagatgaaaatgagagcaaaagcataccagagttcagggaaagggaagtggaagggcagtgaggctttaaggagcatgaagcaccactgattcttgtccattgttcctaggcaccttagtctaggatgcaagtagggaacgagtcagtgataaatagaaggtgggccaatacatagtgctgaggtgctgcatgcaccatgctgaagaacgcgtcttttattcagattgatttgggaatcaatgaaggatttcaagtggagttacgatgtgtctacctgagaggtcattaagctatacacaaggaaaatggattagaaagtgggagaacagagtttgggaaactacttatgattggcacaatcccaggtaaaaatgtttgagagaagtgggtataaaaggtataaaagatgatggccattttttttttttctgaggaaatcttggctaaatagtgatgacacaaaaacaggtcagttacttttcagagatgtaatgacaatgagttaaatcaatgtctttgacaaaaagtcctgttgataattcctgtcttatcaataactagaagatgtgttattttttgcaggtcattcagtgaaaacatcacaataaaactatatttatgatcaattttatttatacagttgatgaatgttactggtcactatttatttcaagaaggctaatttatcctgaaactaaataaaatcagaagcataattttaatcagaattttaactttcttcagataaatcatttattaagcggtcaagtcaaaacagaacttttgtttggttgactgatttacctgatggaaacaacatttctgttttcatataattatgtcctggtcacagtcctttaatttgcaataaacattttggaatttaatcccttttatttagaaatttcatgcaaatccccagatgttataaatggatctcctatatctcagaagattatttataaggagaatgaacgatttcaatataaatgtaacatgggttatgaatacagtgaaagaggagatgctgtatgcactgaatctggatggcgtccgttgccttcatgtgaaggtaatgttacctttattttctggatctttataaatttatcacatattttaattaattcttttaataaatccacttattttaatcaaaagtagagtgctaatttatgtaaataaactattataaaaaacatatagcattttctgtgttcaaggttcattttgagtacacttcgtacgatacacacactctgaaaacagacataaacagggccagaaaagttcagtagcttattaagtcattggtctatcatcaaaaaccatgtctggatcagagtgaggactataatagacttcctaattctcagtaacatacaattctcaaacaagtagattgctccactaatgcccagaatttatttaaattatatgaatattttaaaatactttaaaagtaacttgtattaataccaggtgaggaaactctcaactgacaatggaattaagttgaaggaagtgaatatttttgttaacaacaggcccagtatgactcaacggtgatgatggtcctggaaaattaccaaaaaaaaaaaaaaaaacctctcaactttcattatggagggatgttacacagagccaaagagttcatctcaactgtgctctttgcccaccaaaaaatatatctggaatagagtgttctacttaacctacttcattttaaacgggaaagtttcaaactatcatggccaagaagagagaatatggacagttgtggacttttaagaaattatgccataagacgtacagtaagaagctacagctatagtgtggtgataacagttttgagatattttcaaacatttataaaataagtgggtttgcttttgatgaggtctgctgcaattagtgaaacaaggaacagtgttaccacatatggtccagaaatctaaaagggtgatactgccatactgtgagagaaagaagagttgaactcttaagagccctctgaactttaaatcccatgattcataaatacatgtttaaactgtgctttagtaatcctcttttacaaaagaatagttaattttgggttaattttatacactaaaaaaattttggtttgagcccacaagtgtctccttggaaaacatatttttcttcacaattgcgtgatctctacttttaggcactgttaagagaatattttagaaagaaattaatgaacatgagacagtaataacccacatcagatccatgtttggctaatggtgtgtggggtccaactatttgtcttcatggcattcgtagttcctaagcaaaggaagtgcatgcacaagtcctttggcattaacttctacctgaagtatattatttccagagcccctctcaaatctatagtgaatttatccatgcagtaatcaaaatgtaacttataaaccacttattttacatcaggaccttgctgtgtattgaagataaacattgcaataaaccatcattccagctttcaatgaattcaaaataagactctgggaatttagttttatttgaatatgtgactctgtagcattactacctcattgtagtcatctgattttttcgtctcttttacttcttcactttgatacctacttaaaactcttccttagcacatatttgttttcacaatgagagatccatctgtttttcccaaatgtattactgcatttctattcttgcttctcttgaacactaattgattcacacacacacacacacacacacacacccctcaaagactctacatttataaaacatttttcttttataatttttttccatttctcagtcacaagtacaagtaaaacctgaatattcaatactatgcttgcaggtcctgctttctttaggaaaagagataccaagagaaggcactgggattgggtactccttttcagaagacagttcactaataatcgatataaataaaggaggatttatcccaaattagttaagcatacactctctcaccacgttttattttattgaaatatactttacgctgattagatatagagaagtctttcttaataaaagaattccactctttgtatgccaactaatatagcataaatatgactattttcttggtacaaagcaaggatctacttgctgatataagatgaattcaaaatctatacacatcattttctctgaaatcaggtaacttcaaactctctttgttgcttctaaatctataagaagtttggaattaaataataagataatattaaagtgaaataatctacttaaattttaaatactttaattttcttcaatctggtctatggcacacacatgtcagaggactgatttaaaggtgaattgtcaaaactttggtctctgtgtccaatagggacaatctgtaacagaaagttatttatagaaacaatcaaaggtacgaagaactgctaaaggaaagctatctttgatccgaatctatctcttccctgtacagattggattttctattggttcaaagcatagagtgctaaccttgaattagtattctaacttcaaatgaccaatggttgtttccaatagtaggaaaatatggatagtctcaagtattgttttggataaaggtacaggttcgggcaatgttttaataacatgatgtatttttaaaaagattatgagtgtaggaaattaaggtttatcacaggatttatgtctactgcttgagcataatcaccagaagtctttctattcttaattaacaaaattgttccatattattttattgatttcttagttaaactcttgttttttgcatctcatagcttttgacttcaaaaattggtattaaattgagctatatcataaggaaaaataattgaagatacataaactgaactttaatgggtatatgaaaatatgatagagaagaatgaagtgacagaaaaaaagaaaaaaggaatacatttaggacttatttgaagttagtgtcaacatcaaacactgaagacatatttttacataaaatagtaaaattttaaaatagtaaagctttaaaacttgtatattaagtcacatacatattgtttctcatataattattgctaatctaaatatattatcctgttagctatagagatatattaaagcttattctgtcagaacgaagtataaacttaggagctgaatggacacagtggaagtatggtattgagaagaggaaatatataatgaataattaaaactttataaaattttatgtttgactaatatacaacttatgagaaaggaatggtggtagtatagagaagaagtagaaaaatggcaggagatgagatgtgacaagtatgcagggcccaaaaattaaaaaattaagtaaagtacaagaggagaagcaaaaaatataaagtaaaggaaaataataagatataaaagaaaagcatcacttagacaaagacaaggagaagcaggagaacataaatatataaggtaatggagaacaccaaaaagtatgtaatcaacagagtcaaatattacagagttttatctgttcagttcaataaataattaagaagtccataatatgtaccagtgactggaatatgtgaaatgcaaagcatttctgaatttggacattgggctcattggtagcttttatcagagcaatggcaacaaaatagaggtcagaaactaggtagtagtgagttaaagaataaatgtgagacgggaaagtggagacagcaattataaaatggtattttaaggattttggttttgaaggggaggagaaatgtagtacattagctaaacttgaacaaagggttgagtgaagggactgaaaattggaaaagcttccatatcaatttaagagtgtggttgataaggtaagaaagagggaaggaataaacaatggtttaaaatacaggggaaaatgaaagaattaaagctaacctgaatttgaaagcaacactttaccactgaagactaaactaaagacttaaatcagtatagatacagataatgttgaggagtgctggaaagaagtataggaaactcactactgctggtctcaattgttttgtgtgaatggagacttattatctgttgatgaagaggcaattgtttcaggtggcttgagaaaagagaggagactatggatcatttaccatgggaaatcaaatagtaaataaattgggggtatataaatggatttcaagcaatgctgaatgtttgccacagctttttagtccaaaataaaatatgactccaatagaagtggtcatatagtttttctacaatacttaaaatgcatagtattttatcttaaaacgaattttgcaaatggatccaatattgagatatagcagagttaatggaaaggagtgagaaggtgccttatagattaagatacactgggccaaaggatggcaaactataggctgcaggtaaaatacaacttgccccctttgtgtaaacaaagttttattgaaacacagccaagttcatttgtttatgtattgtttttcattacttttgtactataatggcagagttgagttgttgcagcagagacattttatctggccctttacggaaaaggttttccaaaccctctgctattttatcctattatagtaagaaaaatgtaatgcagtatctcaatgtttaagatattaagactgaagtttattttcattcatgttcactgtcaatgtagatcagaagggactttactcattgtattaattgtaagaatcaagtgacagaaacatcattttttttcatgtccttctttaatcgcggtatctttgggaaagagaacataaaaattcacacaatggcttttaaaacttctctctaaagtggaagatattacttccacttttattatagtctcctacgcaatcacatggccacagttacttcaaagaggaagggttgcgcagtcctatcaattgtccagaagaaagaaacactgaatatttgtaaacaatccttatgagaaccacagaaaccaaagaatagaaggaaagtgaaagtaagaattgaagttatatgtgatgagaacattgccagttatggaaaatcatgaagtatgggatgactttggagaagaagggattaagagcccaggaggtacaaatatgtcagatgagaatatagtgaagggaaaaataagtgatataccagaaaggatactatgatatgttcattttaatgccattttgtattatgctaaggacaaataaataacacccacttttaaatgtttatataaatgattaattttaacggatacttatttctgcattatccatatatcctttttcttttcagaaaaatcatgtgataatccttatattccaaatggtgactactcacctttaaggattaaacacagaactggagatgaaatcacgtaccagtgtagaaatggtttttatcctgcaacccggggaaatacagcaaaatgcacaagtactggctggatacctgctccgagatgtacctgtaagttccattcatatcttgacccatttcttaattctgaaatttcttttaaacacataaaaaatagggactcaataaaaccaaatatttgtcttattgtatatacaaagtaaggctgttggaagcattctttagttttcgaagttgccgaaactcatattttttgctactcaaaattaaatgtgtatgtgtgtttatgaatgtatgtttccctaattaataaattattccaatatctgaattaaaacactagataaaaataatgtcatctaacacatactatattagttatttattgcattgtaacaaaataccccaaaaacatatttacttaaaacaactaacctttattatcttacagtttctatcggtcagtaatctcaaaatggcttatataagtagttgtgaatcagactgtcttcttgtgttgcaatcaggatcatggcccaggctacagtgatcagaaggcttggctgggaaggaggatctgcttctaacattactgacacacatggctgttgtcaggaggcctcaggtccttaccacataggcctttccatgagttgataaatggcagctttctccagcactgctaatctgagaatagaggaagccacaataccatgtattagtgtgttctcacactactagaaagaactacctgagactggataatttatgaagaaaagaggttaaattgactcacagttccacagcctgtacaggaagcatggctgggaggccttaggaaacttacaatcatggtggaaggtgaaggggaggcaagcacatcttaccatggcagagcaggagagacagagagcaaaggggaaagtgctacacacttttaaacaaccaggtctcatgagaactcactcactatcatgaaaacagcaagggggagatccacctctatgatccaatcacctccctcaacattgggaattacaattcaacatgagatgtgtgtggggacacagagccaaaccatatcaattatctactcacacactgttaacttcagccatatctattctttcgaagtgagacactaagtccagcatatatccaaggggagagaaattaggcaccactatttggagggaggagtgttgaaggactccaagtcttagtcatttcctagtgttggaggtaatttccaaaaatcatcacatgtagcaaaataccactcaagtcaatagagtattttatttctgggatgctcctttacccctttttaatgttttttctatctctacaatcaaatttcttttctttctatctataagtacatagacaagaagtactacacttaaactatatattccatgaaagaaaaatatgatacaaatgattgattaatgacttcaactttaattcctggcataattccaatccctaagagaggaagctattatcagtatgaaacatttcagtgtgcataagaattatgaggaaaatatttaatgattttatggttggcttatgacaatgtagttcagcccaaatgtatctaaaccaactgagacccaactatatttggatttcaattattaatgtttgacaatgaaccatctggagttctcatggacaagatagaggagttgatgagttatatggtttatcagtttttaatttcattaaataaccatatctaattatcagacgcatgactttattctcaggcctgcttcattactcacttgtgtcattgaacagtttaatgatttaggggaagtgcagtacaaattcacaattggaatgatacagaggatgataataaggaatctgcattagggcagttcagcattcaaagagactcttatgtgctaagctgaatctaataagatgaaatttaacaatgttgactctaagatcctggacttgggtcaaataaattacagtatgaatatattagcagcagttataaaaattagtgaatatttttatcaattttaagatctgtttgagccaactttatgatggaaacaccataaatgctgtgaaaccaaaaactacatttgtagaagtgtaacaagtagaatgaagctatttgaagtccttctattctcagcgctgatgagactctctgtgggtactaatatttgcttcaaggaatcaatttgtaaaagggataaaaacagatgtaaatgtgaccaaattagagaatagctaaatagctcgagcctgtggtaatgttatatgtttttaattatgcctcctttttattccttttggaaagaaatctcggtggacaattttattttatgaccttctgggaaataccataataagatggatactcatacttgctttgaaatcaaccacaagctttgaaatctctactctaccatttaatgtgaaattcaattgaggcctttaaggcacagctcccacaaatccaagactcaagctttcccaatgcagaattattgttaaataatacatgtctcaacaaatcatgatgaaatttgtaaaatccaatggtaaatagaaaatattccaaatctttaaaaagtggtgaggaaaaatgtagaatgttacttaaaagaaataagactaagtaaatgttttaatttcaacactgggagcttcagataaatagggaaaaaaatctatcaattataagatatatggattgtaggccaagaaactatactgaaagaagtatcattcactagtctttattagagaaatacatttaagatatacaattattcagtttataatccacataataaatgtagaaactacatgaaaatttctctaatcaaatacaaaagaaaataaatcacagaatttaagaaagatggagatgtaaaagaatatttatatgtgtgtgtgtgtatgtgtgtattgaaattctttttaacctattgcataaggtttattgaaatagaaacatatttcatggaaaacattaataccattttgttattgaaagtactagataatctacaaataatcccatgaaaagagcaaattttctgaaaaatatataaacctgttaatataataaacaagatagcactcaaatgtatttgtcaaaattaatatataataactcagtaaaatgtaattatattgtaccttacttaaatatattttatgacatcaaaattatttttctctccaattaaaattagaaataaacaaaaaagttaatcaaaatcttaactatttggatatgaagaaatatttctagtctgtttctctggttaaatacagactggagaacttggcttaatgaattgtttgaggcatgaattaactatgttatttttctgcgcggtatcatcaaagaaaaatttttgtgtttctctatatttttacgttgtctgcaataaataggaaagagcctaatttatttatttacttatttatatttttcgagatggagtctcactctgtaacccatgctggagtgcaaagacacaatctcaattcactgcaacctctgcctcctgggttcaagcgattctcctgcctctgctttctaagtagctggaattacaggggcgcaccaccaggcccggctaattttttttgtatttttagtagagacggagtatcaccatgttggcccagctggtctcgaactccttacgagtgatctgcctgtctcagccttccaaagtgctgggattacaggcgtgagccactgcgcccagcccatgaattcaatctaaaacaaataaaaaccttaaatccctcaaaatactacttccttacattgaattgttctgagaagaaaatgcagggctcttgtttactgatgagaatagaaaaaaaagaaagaaagaaagaaagaaatacatgagctaagcggtaaaattggcatatttctcaaccgaaaagcttatttaattaaccagggatagggtatgtgtatttaagggaaatatattaaataggtctgtgcatttttctttctggagagccttcatacaaatttacgcatcatgtgatccacaagacataatttcatcttcattaacaaagaccttcttgttacatatctcagtcatctgagttctatcatttgttttgacctagaaaccctaatggaatgtgtaattatactaagaagagaatataattcagtgataaaaatttatctctaatatgagtgtttattacagtaaaatttctttatactttttttaaaatttttattgcaagtgaaaccttgtgattatccagacattaaacatggaggtctatatcatgagaatatgcgtagaccatactttccagtagctgtaggaaaatattactcctattactgtgatgaacattttgagactccgtcaggaagttactgggatcacattcattgcacacaagatggatggtcgccagcagtaccatgcctcagtaagtaaacctctgaactgctatatatatgtataaaactttcaaagatcgaagaaaggagagcacataagtgattacacctgtcttatgtaacagaaatagggccaagaaaagagttgttcaagcaaagtgaccaaaatagatcttttctattatgagggtttcttcttgaaaatcacaggagaaataaatatagggactttatgagaatatctatataatttatacatctattaattataaaaactaaagataagtaatattgaatattgatatttctttttgtgcaaacctttgttagtaactttagttcgtcttcagttatacattatttttggatgtttatgcaatcttatttaaatattgtaaaaataattgtaatatactattttgagcaaatttatgtttctcatttactttatttatttatcattgttatggtccttaggaaaatgttattttccttatttggaaaatggatataatcaaaatcatggaagaaagtttgtacagggtaaatctatagacgttgcctgccatcctggctacgctcttccaaaagcgcagaccacagttacatgtatggagaatggctggtctcctactcccagatgcatccgtgtcagtaagtacactactctgaaatcctagcatgttcatgtctttctaagtaacatagatgacattctaagactcatctatattaattgtggcaaaatgtttatgtcaccttgttttaccaatggacctatttagtttttggtttttcaactgtgtataaatgaatatacaaatttcttgataagtacatagtaaaataaattctcctattaatgggcattagtcaagaatacagtaaaagaatttgaacacaatacttgttggttaaatgaagtcgtattgaagcggcatcattgtctgggtaaatatctgaggttcgttatctcacaccaagaagattaaggacgtggacacacacaaggagtgagtttaggagcacaggtttaataggcaaaagaaagagaaaggagaacagcttcctctcttgtgagagagagcggcacctgaaagtgaatccctgcccctggtggagtgcactggattttataaacggtcttgaggaagcagtgtctgatttacatagggcccaaagattggttaaactaggtgtgacatttacataatatgccaggaagctggccgccccaccctaatcttattaatcaaatgggatctttgcctggccagcgccatgttgctttctccttactgtacacgtggctggcaaagagaaaggaagatgcacctgccatatgaacatgcctagtcccaggtagccttttcctattggcacaactgctggcattcaccttgcaagcttccagcttgcttgtctatgtttgcagttcgattttacaggctcctcttgttagaaaagaaaatgatttgggggctgcctttcattaaaaggaaaaaccttatcaaggactgctgtaccctcattatctgcctaaacaattttttctcaactcctatatcaatattaatatgtacattggaatcaatcatttgactcaaaataattatacaattatagtttaaaatagaaagtaaatacgatgatacccaataattcatatattcaagcagtgatatgacatttttacagtaaagctatttgactttctctagtatatgtaagtacaaatgggtattctgagatcttgtgcatattctactctagaaggtttcctacagtatttattccaacatacatttatatcaacagttacttctttttttacatgttaatgattggtgatgtcacattttaatatttacaaattgaatggctataaaatgttataacattatagtgtaaatttgcatttcttttaccactaactgggtttagaatatatattcacagtttaattggtatttaatgcttctaatctttggaaatgcagtttgattttctttatttacctttttgagagttttggtattattagttggaatcatcttaacaattctgaatataaaatctcttttaattatacgtaatgcaaatgtattctctttgtggctagtatttttctttccttttttctgcattatgaacataagttgctcattctactacataatagtcaatcttttttcatgatgaatgtttcttgtttctatttaaaggaatacttcaaaaacatagagccactatactattctttattctaaaaagttataagttaccttttcttttcatattttaaaaatattttgtgttgattttattcatgataatggctgtatttcatgtttaaatgaaatatggtaaactcaacatttccctaacaatttttatagtacctttctcaaacagtatattttttattgtatattttgtacattgtgtgtgtatacacacacacaataactattactctgagtattctgcactattagtaaacaattttttaaccagcattgcagtaaccctctattgaattttatttatttattttattttgagatagaatctcactctgtcacccaggctggagtgcaatgtcgcgatctcgcctcgctgcaacctccactccctgaattttaattaatataggtttttaataagtatggatatgacttttcaccctaatcatgacctttcacccaaatctttttgcttcatcagtctcttttttgtctcatcattcagtgtcagatgatcccattacttttatttttttcttcacagattaattgaggctaataatatgccttgattagatatgcaatttctcctgatatcaaacaactcaatcaacgtttatgcctcttggtttgattttggagctgattgtagaatcaactacttattttttctctttctttccttccttccttcctttttctttctttctttttctttttctttctttcttctttctttctttttctttctttctttccttctcttccttctttctttttctttctttcattcttttttctttcttcctttctttgtctacgtttctccttctttttcttttttctctttctttctttctctttcccttcctttctttttctttctttctttctttctctttcccttcctttctttttctttctttctttctttctttctttctttctttctttctttctttctttctttctttctttctttctttctttctctttccttctttctttcttccttccctccctcccttccctccctccctctgtcacctccctccctccctccctccctcccttccttccttccttccttccttccttccttctttccttttgtcccaagtttgtctggctcaagttattcttaagaatgttactattttactcttcatgctagaccctgtactttagtcaggttatttagctactttacggttgtcatataattaacaagtcttagcttcatcttcagattgagatatcaacgttatattttcatgtacagtcaattgtcagtgaatcacattgtttttcaatttaataaaatctaaattcctcataaccatgttgtgagaatatgcagaaaaaattaaacatacttgagtgagtacagtagatatatattggagtgtatcctttatgaatgcaaactggctgtagtttcctttaaaatagtcatttaaataaaaaatttgccagataaatcacagaatatcaatttctcttgacttgtaaaacttgaattactagtgccatctgaatgattcttctgaagatagacagagtagtctctacttacctgtgagagaaaaaagctgcactagtccctcttattcatgtgggatatgttccaggctccccagtaaatgcccgaaatgattaatagtataaaacccaagtagactatgtttttccacctgataacttggaatactactaagtgactaacaggctggtgcatacactagacgaagggaggattcatgctctgggcgggatggagctgaatggcataggatttcatcaaagactactaagtgactaacaggcaggtagtataaactgtggatgcactagacaagaaagtattcaggctctggggagaatggggctgaatggcataggatttcatcacactacccagaacacctttttttattgctaagtattattccattatatcatgtatcacggtctgttaatccattcatgtgttgaagggcatttgcattgtttttggcatttgtgaatcatgctgttaagaaaaatattcatctgcagtttttatataaacacaaatttattcctcatggatacatatctaagactgggtttgttagataaatggtgtgtgtgtgtgtgtgtgtgtgtgtgtgtgtgtgttttattattattatactttaagttctgggatatatgtgcagaacgtgcaggtttgttacataagtatacgtgtgccatggtggtttgctgcacccatcaacccgtcatctaggttgtaagccttgcatgaattagctctttgtcctgatgctctctctcccctttccccgcacaccccaacaagccccggtgtgtgatgttcccctccctatgtccatgtgttctcattgatcaactctcacttatgagtgagaatatgtggtgttttgttttctgttcctgtgttagtttgctgaagatgatggtttccagcttcgtccatgtccctgcaaaggacacgaactcattcaatttatggctgcatagtattccatggtgtatatgtgccacattttctttatccagtctatcattgatgggcatttgggttggttccaaatctttgctactgcaaatggtgctgtgataaacatatgtgtgcatgtgcctttatagtagaatgatttatattcctttgggtatatacccagtaatgggattgctgggtcaaatggtatctctggttcttgatctttgaggagttgccacactgtcttccactatggttgaactaatttacactcccaccaacagagtaaaactttcctatttctccgcatcctcgccagcacctgtggtttccagatgttttaatgatcggcattctaactggcgtgaattggtttctcattgtggttttgatttgcatttctctaatgaccagtgacaataagcttgttttcatgtatttgctgactgcataaatgtcttcttttgagaagtgtctgttcatatccttcacctactttttgatggggttgtttgtttctttcttataaatttgtttaagttccttgtagattcttgatattagacctctgtcagatggatagattgcaaaaattttctcccattctgtagattgcctattcactctgatgatagtttcttttgctgtgcagaagctctttagtttaattagatcccatttgtcaattttggcctttgttgccattgcttttggtgttttagtcatgaagtctttgcccatgcctatgtcctgaataacctactgcctaggtttttttctatggtttttatggttttaggtcttacatttaagcctttaatacatcatgagttaatttttatattaggtgtaagggaagggtccagtttcagttttctgcatatggctagccaattttccctgcaccatttattcaatagggaatcttttccctattgcttgtttttgtcaggtttgttgaagatcaaatggttgtagatgtgtggtgttatttctgaggcctctgttctgctccattggcctatatatctgttctggtacaagtaccatgttgttttggttactgtagtcttgtagtatagtttgaaatcaggtagcgtgatgcatcagctttgtgctttttgattaggattgtcttggctagatgggacctttttttggtttcatatgaaatttaaagcagttttcttagttctgtgaagaaagataatgatagctagatgggaatagcattgtatgtatcaactactttgggcaatatggccattttcatgatattgattcttcctatccatgaggatggaatatttttctatttattttggccctctcttatttccctgagcagtggtttgtagttctccttgaagagttccttcgcatcccttgtaagttgtatttctacgtattttattttctttgtggcaattgtgaatgggagttcactcatgatttggctttctgtctattactgatgtataggaatgcttgtgatttttgcatattgattttgcatcctgagactttcctgaagttacttatcagcttaaggagtttctgggttgagacagtggggttttctaaatataccatcatgtcatctgcaaaaagagacaatttgacttcctctcttcctatttgaatactccttatttctttctcttgcctgattgtctggtccaaaactcccaatactatgtccatcctagacagatcaacgagacagaaaattaacaaagatattcccaatttgaactcaactctggaccaactggacctaatagacatctacagaactctccaccagaagtcaagtgttcttcttggcactacatagcacttattctaagatcgaccatataattggaagtaaaacactccccagcaaacgcaaaagaacaaaaaccacaacaaacagtctctcagaccacagtgaaatcaaattagaaatcaggattaagaaactcattcaaaactacacaactacatggaaactgaacaacctgctactgaatgactactgagtaaatattgaaagtaaggcagaagtaaataagttccttgaaaccaatgagaagacagacacaatgtaccagaatatctgggacacagttaaagcagtctttagaggaaaatttatcgcactaaatgcccacatcagaaagtgggaaagatctaaacttgacaccctaacacctcaattaaaagaaatagagcttgatggggatggcattgaatctataaattacctttggcagcatgccatccccatcaagctaccaatgactttctttacagaattggaaaaaactactttaaagtttatatggaaccaagaaagagcccgcattgccaagtcaatcctaagacaaaagaacaaagctggaggcatcatgctacctgacttcaaactatactacaagcccacagtaaccaaaatagcatggtactggtaccaaaacagagatgcagaccaatggaacagaacagagccttcagaaataatgctacatatccacaaccatctgatctttgacaaacctgagaaaaacaagaaatgggaaaaggattccttatttaataaatggtgctgggaaaacaggctagccatatgtagaaagctgaaactggatcccttcgttacaccttatactaaaattaattcaagatggattaaagacttaaatgttagatctaaaaccataaaaaccctagaagaaaacctaggcaataccattcaggacataggcatgggcaaggacttcatgtctaaaataccaaaagcaatggcaacacaagccaaaactgacaaatgggatctaattaaactaaagagcttctgcacagcaaaagaaactaccatcagagtgaacaggcaacctacagaatgggagaaaatttttgcaatctactcatctgacaaagggctaatatccagaatctacaatgaactcaaacaaatttacaagaaaaaaacaaacaaccccatcaaaaagtgggtgaaggatatgaacagacacttctcaaaagaagacatttatgcagccaaaagacacatgaaaaaatgctcagcatcactggtcattagagaaatgcaaatcaaaaccacaatgagataccatctcacaccagttagaatggcgatcattaaaaagtcaggaaacaacaggtgccggagaggatgtggagaaataggaacacttttacactgttggtggaactgtaaactagttcaaccattgtggaagtcattgtctagatcctcagggatctataactagaaataccatttgacctagccatcccattactgggtatatacacaaaggattataaatcatgctgctataaagacacatgtacacgtatgtttattgcggcactattcacaatagcaaagacttggaaccaacccaaatgtccaacaatgatagactggattaagaaaatgtggcacatatacaccatagaatactatgcagccataaaaaagaagagttcatgtcctttgtagggacatggatgaagctggaaaccatcattctcagcaaactatggcaatgacaaaaaaccaagcatcgcatgctctcactcataggtgggaattgaacaatgagaacacatggacacaggaaggggaacatcacacaccggggcctgttgtggggtggggggaggggggagggatagcattaggagatatacctaatgttaaatgaagagttaatgggtgcagcacaccaccatggcacatgtatacatatgtaactaacctgcacgtagtgcacatgtaccctaaaacttaaagtataataataataaaaaaagaattagagaagcaagagcaaacaaattcaaaagctagcagaagacaagaaataactaagatcagagcagacctggagatagagacatgaaaacccttcaaaaaatcaatgcacccaggagctggtttttagaaaagattaacaaagtacactactagccatactaataaagaagaaaggacagaagaatcaaatagacacaataaaaatgataaagagggtatcaccactgatcccagagaaatacaaactaccatcagagaatactataaacacctctacacaaataaagtagaaaatctggaagaaatggataaattcctggacacatacacgctcccaacactaaagcagaagaaagaagtcaaaaccctgaataggccaaacacaagttctgaaattgtggtagtaattaatagcctgccaaccaaaaatagcccaggaccagatggatttacagccaaattctaccagaggtactaagaggagttggtaccattcctttggaaactatttcaaacaatagaaaaagaaggtctcctccttaactcattttatggagccagcatcatcctgataccaaaacctggcagagacacaacagaaaaagaaaatttcagtctaatatccctgatgaacatcaatgcgaaaatcctcaataaaatactggcaaagcaaatccagcagcatatctaaaagcttattcaccatgagcaagtcgccattatctctgtgatgcaaggctgtttcaacatatacaaatcaataaatgtaatgacaaaaaacacataattaactcaatagatgcagaaaaggccttcaataaaattcaacaccccttcatggtaaaaacactcaataaactaggtattgatggaacatatctcaaaattataagagctattttttaaaaacccatagcaaatatcatactaaatatgtgttcatttttataagaaatagacaaactgttttcctgagcgatcatacattgtaccttcacatactcagtgtatgtgagatccagttgtttcgcaaccttgccagcctttgagataatgtgtttttttttccattaaattatccattctaatatgtgtgtgatggtattgcattccctagtgactaatgctgcttagcatcttctttgtacttatttaccatctatgtacctcctttggtgaacactgtctaaattttgcccactttccattgagttgtttcttccattacggaattttgagactacatgatatattgtggctacaagcccttcactgagtaaatattttgcaaatatttttcttgcatctgtagctttacttttctctctaatagtctcttttcatgagcaaaagtatgtaattttgatgttatcacatttttcatttatagattacgctctttgtgtcatctaaaatttccttgcctaaaccaaggccatatacagttctagaagttaacattttacacttagttatatgagttaatttttgtatgaggtatgaggaatatgtagagggttattattttgcatttggatgcgttactgttccagtatcacttgtttaaaagactatgttttctttattgaattgcctttgctccttttttaaattgaaaacatcctcaaaaaatttttaaaaacagttaaggaggaaaaagtaaaattcaactaggcttgtaggacaatcaatggtaatcattaggctagctttccattgacccacttccttatagctggtcactgattactagtccaggataacataatctttgtcactagaatctttgttctttttctgttctttagttaaaatttaagacaatatgagatgacaaactttccatttgagtttctcctttaggttctgcatactaacaaaactactgatgccagccattctgaaaggcttgacaagaaactcaacttagggaagaatgtactttccatatcctgatgatttcagcccccttacccgaatcaattgatgacctcaattttccagccactcccccttcaaagattcttgcccagaaagcttcagtgaaatgggtttgagtcttgagaattcttctcatgtccttgtttggtgaccttgcaattggtaaactctctgttgcaaactccactgtcttggtatattctgttgctgcacagcaggcatacaaaccttacaatcttataaaaattcatggcaagcacccagacatgatggctcacacctgtaatcccagcactttaggaggcaaaggagggcagattacttgaggtcaggagctcgagaccaggctggccaacatggtgaaaccctgtctctactagaaatacaaaagttgcccaggcatggtggcacatgcctgtaatcccagttacttgggaggctgaggctggagaatcacttgaacctgggaggcagaggttgcagtgagccaagatcgtgccactgcactccatcctgggagacagattgagattccgtctcaaaaaaaaaaaaaaagaaaagaaaaaaaaattcatggcaagccactctccttgcagtcatttacctacagtccagtgcccccatgccactggggctgacccagagagaagctcaagaagctgcttagttatgatgaactaagggccttagctggggccttctgtgttggcagggcagtgctgactttcagcacacaaccttgtctgcagcagagaaaccatttctggtctcagaagaagtctcaggtgagttttctcagagcagctggcaccccatttccttctgtgtgtgtgtgcctgttttcgtcttagaggtcttgtggcctctttgaggtcttgttgacactccctaagtctaggtaggaacttatttgaggagatctcccttcagatggaaaaagactagagggcattgcttgggagaaatggtcttggattttggaatctgaaactttatatggaaaggtcttttgtttgtctttgtcttgttatatgtatttatgtttgtggaggggatccctgaagaaattactagtggaagaaattactaactcagggaactcttcttgtttggtcagtcacattcagttagtcctgaaggagttgctagtggaatctcagcaagcctaactcagggtaatcatctgctcttcaatctttcccaggctttaccctctgaacttctgatcgaaggtcatccctctccagcttgagtggatcaaagatgacaagggccaatggaaccaagtttgagtcttgccaggtcaatacttgggtcctgagtatggtgactagtatctgttttgttatgtgtgtattattccagccagaatgggaaatgctaattcagctcctccaggcagcccaatggggctggtggctttgagattattaaactctttctctgctgcaaaccccactgtctcagtgtattgttctgttgctgtgcagcaggcatacaaatctgacaatctcgtaactatttgtggcaagccaggtcgaggtcactctctttgagggcatttactcactgcctagtgccccctttccactgggacagacccagagacaaaccctagcagcttacttagctctcatgaactaagggctgtcccttagttctcccaaagtaacccacaatgcaaccctgatgggctgcatcttccaaaattgaaaggcctttgtctatcattccatgaaacaaaaaaagattatcttactttttaacatggcttaaccttaatacccactggatttcggagaacagtggccactgcatggttctcatgcttacagtacgatcctgtagctagatttgttttgtaagaaggaagaggaatgagatgaaataccctatgtataatgttttatgttgctttggaaaagtacaacaatgtagaaaaaggtaaaatcatgataaagtaagaaattaaagactgtttggactgatttacaagaaaaagatgatgctatgatggttcagttaaaggaacctatgactcacccccctccactttatgggggagctgcagcagcactactggcgcctctccagagtccccaccaccaaaaagtcacaaatccggggcaacaggtatgatctctacttcttataacccaacaggggactccatttaggcagggtgtcacttcttatacccaacagggaactccatttagccggggagtcactctggttctgagaggcagtttccccataacaactgcttacaggaggtgttgctgccacaggccagcctataggatttatcttggtttattctctgttctccacttccaacctacttaattagaaaaataatatgcctatttattgagaagatctaaagtttatggaaggaacaggattgaaaaaaaaaaaaaaaacatccaaagcatatgaagaatctattctcctctgtatttgccacacagaaccctacctgagcaggcacccccaatttgctcaatattttgttgacttcagagaaacaaagaatggttttagaaaaagctaaggaaaaggctgatcttattcacactgactctcccagtaatccagtaagggcagctgctcagattgcagttcccacctctgacctgggatggaatataaacactggagatagatctaaccttgaacactatcaaaactgcattttgatcagcctctgcaagggagtgcccaagcaaaggagtctcagtaaggtccaggatggtcaagcagaagcctaatgagggttgctttggaattcttagaacaagtctttgaagctttcagagaataaatggatattgacccagaagccccagaaaatttgatgatagctaacatgatgtttatccaacaaagtgccccagatattcagagaaagttacaaaacgtagctgaggcattggacatgtttttgtctcaattagtgaagattgtttttaatgtatttactgatcacaagtttaaagagtggaaaataaaacacaaggaataatgaaaatggcaagctgacttgttatctgtggctctgaccctagtagtccctggaccacaacaagggccgtcatcagacactccatctatggtagaaccacctgggcccccaaaggccaataaaaacggacatcccattgcaggtcccaaccagtgtgcttactgcaacaggggggacactgagtggaaaatttctcatgccctacaaagcctgatgttaaacagtcagccttctgcccaccaaatgcctgggatagctggggagcttgagagagatactaaagaaaaagaccagaaatggtagcacccaggggcttctcctgacccagacaacaccctccatatttcccacatggggcttgagatcctgatgatggtgagaaatcagcttctggactttctagtagacatggtgccatctatttggtgttaaatatctggtggtctaaactttcctcagaaataatgaaggtgactgaaatctcagaaaaaatgctgatgagatcattcctccaaattttggattgtcagctagagtaagatcatttaaagcacagttttttgctgggcgcggtggctcactcctgtaatgccagcaccttgggaggctgagatgggcagatcacaaggtcaggagatcgagaccatcctggctaacacagtgaaaccccgtctctgctaaaaatacaaaaaattagtcgggcatggtggtgggcacctgtagtcccagctactcgggaggctgaggcagaagaacggcgtgaatcggggaggcagagcttgcaagtgagccaagatcatgccactgcactccagcctgggggacagagcaagactctgtcaaaaaaaaaaaaaaaaaaaaaaagacagagtttttctatacatccttgaatgtcctatccctttgttggggaaagtcttccttttttgttgttgttttgttttgttttgttttgagacagagtcttgccctatcgcccaggctggactgtggtggcacgattgtggctcactgcaacctctggctcactgaaacctccacctcacgagctaaagcaattttcctgtctcagcctcccgagtagctgggattacaggcgtgtgccaccacagccagctaatttttatatttttagtagagacagggtttcaccatgtttgcctggctcgtcttaaactcctgacatgaggtaatctgccctccttggcctcccaaagtgctgggagctgggattacaggtgtgagccactgctcccgtcctgttagggcagtactcttaaccaaactaaatgctaagattactttttctctgagatgattggacatccaggtgccttcagaccaagcatgtgctctgcaggccatattattacaactggagatccttgaaagtgcctgcacccctgaagagatactccaaaaggttagtccggaaacatgggcagatgggaggccagggaaaacaaaaactgcatctccagtacaagtcaagttttgtgcaggagtggcgctgccaaatctaaagcagcgccctttgagagaaaaggcacagcaatgcatttagcctctgctaatggccttcctgcaatacaggaagaattccttgtttctcatgtaacatacctgtcttgccaggacaaaaacatggaactgaggattattggtttgtacaggatttgagggctactaggcaaattttcaaagccatttatctggtgataactgatgcttatacattattcatgactttaaccagtgagttgtactggtgttcagtcttgaatctgaaggatgccttcatctgtattcccctgagtccagagtcccatgaagtgtttgcctttgaataggaagactctgacactaaagctaaatgatagtattgctggatgatgctccatcaaggcttcaaaaactcactaaccgtccgggggaaatacatgctaaggagttttgggacctccaattgaaaaatgagactttgcttatatatgttgacggcatattagaagccagcacaactatggcaaattgaccagaatattatactggctttacattttttttttgtctggatggggatccaaagtatccaagaaaaaaatcacaaatattgaaaaactcaattatatattttaggtttgaattttctcaggagcagagtaatctgctttcggactggagagaagctcttgtcagggtggccagactcaggacatggcagcagctgtgaggggtttttaggtatggctgaatgttgccatatttcattttcttattttgggcttatagcaaaatgtctctatgaagccctaagaccagacacttgacttctagaatggacaaggaatgtcaaaaggcctttctaaccattaagtaaaaattactaatggatctggctactgagaccccctgaactaagaaagccatttgatttgttcatacatgagagagaagggatgggtttaggagtagtaacccaagacttggggaatatcatgaggcctgtagcctacttttcaaaacagctggacattgttatgatgggttggacttcttatctctgagccactggcaccacttgtgatcttctccaggaggcagaagagttcactttgggttaacctagcactgtacacaccccatactgtgtatgctatttgttggaacagaagtggagctactgacttacctctagaagactgaataggtatcaggtcatcctcctggataatcctagtgttactttgagagctgtttctgctttaaatcctgctaaataaacctatacatgattgcatataaattactgagcaagtgtgttctattcaaccagacatgaccaaaattccctttaaaaacctggacttaaaaatattcactgaggaaagcagctttatgcaccacggacaacagaaggctgagtatgctattgtaaccctgtgacagatcctagatgcagagacactccctctgggttcatcggcacagaaggcagaacttagagtcctaatcagggcatcccaactaggtaaagactcctgagtcaccgattactctgattccaggtatgtttttattgttgtccatgctcatggggccgtttggaaagaaagcgggctcttaacctttgatgattaaaaaagaaaaacaattaagcatgctaaagaaatcttagcctgactaaaggcagtcttggtacccaagaaagtagctataatacactaccatggacatcagtggatggacaatttggtagcaagaaaaaaaaaatcactaggcagagcaggccactaaagaggtgaacagagaaaaaaatgcccaaagccttcctaatgccattaatccctgaaataaacttcagcctaaaatccctacctaatggaagaagatgtaaagagagaattcgattgagactttgactccaatcaaagaactcaaaatgagtggatatgtgacacggaagaaaaggttctggtgcccaagtatcttgtgacagatatcatcaaacacatacatgataccacacagtatggcaggcatgccacccttcaattgatccaggactatgtctttgggacacacttaaagaagactatccaaaaaataatttaaaaatacctacttggtgcccagaacaatcttaagactggtcctccacccccagtaccaaggattcaagcaagaggtgcagggctattagaggactggcaaattgattttaccgtgatgccaagggtagcaggaaattttaaatacttgcttgtatttttagatacattttcaagataaacaaaatcattccgctgcaagaccaagagaatgtctgagctaatgagagccttggtagagaagattaccctcaggtttaggtggcctgtctccatccagtgtgaccatagtgcaatttctgtagcctaggacaccatatattccaggccctcagcataatctggaatcttcatacagcctgcagactgaagtctactgaaaaaactcaaaagataaatcatactatataaaacaaaacaaattttagctaagatttgccaagaaactaacaacctggaataacattctgtccattgccctgctcagagtaagggtggtccctaaaagtgggcttaaattaagccctttaaaaattttacatgggagatcattcttccgttaccttctcagactaaggaatgccaataacatacacataaataaattagatattatcaaacatacacaatctttaggttgtactttaactactattcacgagtttgtggttccagcagattgtggtatccaactgacattctctttcatcccatccaacccagagactgggttctgctcaagaccaggaaaagtcgacatcctggggaccacttaaaacacagtgaaagaggccatgcaaagcatgactggtgacccattcctctgttcagcttgaaggacttagaccctggattcaccacagccatataaaacccgccccgccagattcttgtcctatcaagaaatgtagagaggccacttcaacttcagagactgtctcaaccctatctgaatggataagtaaatctttgatgggcctcaaatatcttttgaggaaaaatatcagataagtaactttaatgaaattagacaaaacatatgtcttcttgacaactacaatagttactttgagcataacaggaatgtttgttattataattattttatataaaaaggtgagataccttcctgtctattccctgccttactgaatgcttaagccatatatttacttggtcattataattgcctagataattacaattgctacccttatagacattacttcataattgccttggtcaatacaattgttagacttatagattttctagacattctatgccatgctaacatagtctcatgccactcattatgtggacattctaaaatttagaaatggtcactcttgttttaaaacttctaattatacctctcctgttactacagtgcctagacaggcatagcaacactgtagttcaactgtttcaaggtattgccactggaagaaacttaccagaatgatggatctgtcagtaactcccccaaactattcaaaataagcattttctgttagtcatacttgtcactgactttctggatgttccaaatatgactacctatctgcaccagcttctttccatggctactttccaggtccaagtaatagtacaccaagaaatcaccaccccatgtgtcaatctctctctgcctatcataaatggaaagtcattccattacataggccctccatggcccatggcatactgggcagacaaacgcagctaggagaagggaaataaaactaaaagtttctccttactatgccaaaaatatttacagtggggaatatcacacaaattctggggagcctgtaaaaaaagatccctagttcaattccatttgtctatattccccatgaaaaaatccatcaataaatgcacccttgagggctttacctgtgtgcccccttggtacatgtttatttgtggcataggatcagaccctcctctgttagggcaagcccactggtgtctcaataacctgtatattaagggctctcacttactgagatacttctcagtccatcctaatgacaaaatattctgcccattttcccaccgactccaaaagggactgccaggcatatatcaatatatctggtggcagagccttctaggcatcacgagtcctagctatggagtatacactcactgggacatgatcagaaacttattggcaaccacagaaataattgcaaaagaggctgctaagaacattgaggctgagaaaactcttcaaatttacttgcccagatagttcttgacaacggaactacacttgattttctcttggctttacagagaggagtctgtacagtgatcaataccacctgttgtacttatatcaatgcttctggtaaaataaaaaccaaactaaagaaaatatttcagcagtctcgctggagaccatatgtctctaccacagaccctatgtctgaatagttttttgagctttccgcctgcatactccatgttttccagtccatttttcaaggactcttgaagttcaagctcacaattctgtttatagggattataatttacatgattcaattaaatattacaataaaaccatagactgaagtactaacatgttcatccagcaccctaagctgggtataacagcttgcaggttgttacaagacggtttcattcctctaatcctgactctctctctgtgccccgtgtcagcaaaaagaagctagaatggccattgcccgattcataccatattagcttttacacctcagaattgagaagggatcaagcccggaaggaactgaaactgtccctaggaaagttatataaaattgattaagggggaaaaattcaactatgatttcaggaaaatcagcagtaatcactaaatcagctttccatttgtccaacttctctgtagctggtcattgattactaccctaggataaagaagcccttgtcacaagacattttggtccttttcctttctatagataaaatctaagacattgtgagatgataatctttctgcatgagtttctcctttaggttctgcatatgaaaaaaaaacctagcaacatactggtcaacaaggcaaaacctcattttcacaaaaaattaaaaaattagccgggcattatggcacaggtctgtagtaccagctgctcaggagatctgaggtgggaggaccacttgagcctgggaggcagaagttgcagtgagctgtgatcacgctactgaaatccagatgggcaacagagcaagatcatcttgctcaaaaacaaaacacacacacacacacaaacatacacacacagacacacagacacacacatcagctggtctaaagagcccagcaaaaagctgactcaggaaataatgcaggttccacatcctggtgacttcatcccccttaccctgaccaattgacaacccaaattttctagcccgtcaccctccatgatccccttaaggtctcttgcacatagccccttctcagaacagatctggggcttgagaatcctcccaattccttgtttggtgcccttgtgttgattaaagcctttctttgctgcaaaccctactgtctcagcgtattggtctattgctaaacagtgggcatgtgaacctgatagtcttataacaaaatagaatagaagctatttataggatcgatccatgcatgtgagtctatttctggacaccgttttctcttctattcttccacgtgtttgtcctttaaccagtatcatgagatcctttactcactgtagctttttttaagtcttaaaatttggtaatgtgagtttttcaacttctcttatcttttgaagaattgtttagctgttttagcccctttacctttccatatgactttagaatcagcatgttcgtatgtgcaaaacattgtgcttggttattcactagaactgggacacattcacagatgaatctggggagaactgatatgtaatagtattaaatttttcaatccatgaatattatatatcctttgatttagtaagatcatacagtcttaccctagttttttttattttaagcatacagatcctgtattttactagatttataactaaatattttgtatttcatccatcaacgaaaaattcaatttgtttaatagacagaatttattaatgctacctaatccttcttgagagagccatgatagtttgtggcttcagtaattttttaattcattcaagttcttgaatttattgacatggcattattcagaatattttttatttttcttttaatatatgtaaaaaccataatgatgtcatttctgtcattgctgttataagcaatttgtgttattttttctgatttagtctgtctaaaggtttctcaattatagagatctaaaataacaagcttttggtttccttgtttatatacatatttacttctttattatttcatctctgatctttattgtagtatttcttctgcttactttgagattaattttttctacttttactaatatctaatggtagaggctaaggttattgaagtggaacaccgtcattttctatcccaggtatttagtgacaccaatttatttcatactgctctagtgccattccacaacttttgatatatagtatatcaatcagtgtttggctggagtagggtgagtattccataaaagatttactgtgatttttggagggaggtgtgaagagggtattattaccaaaatgtggatttttttttaactccattctgtattttggctaagagaagcagctttggaacttctcaagtctgtacatctgtgagaccccaaggattacttgttttaatttttttttaagtttaggtttgttttgggtcaacttagttctttcaaggcttatttttaagcttttaaaaagcttaaaaaaccccagagatagtttgttcagaatattaagctgcttctgatgtctctactacgtgacctagatgttcaaacgagtctttctactctgattgattccatttaaatgtctccctgtgttgtgtgtgtgctctgggaatcctttacctttttgttctctggtagtgttcttcatctgataggtatcctttgtccattcttggggagttttgctctactctccagagtgtcaatattcagccaaataatctagggagttgctgtggaaatttgtagagccctttcactccatagtttcttcttttctcactctgtttcctgcagattctagtgaactcatcttctttgggaacactgagttttgtttcttctactcagcaagtgtggcactttctgctgaattctccttctccatgctgctgtttggaaaatttctcccagcataaagtcactttgatgatggaactcatctcattgtcactttttctctggaattaggtgcttcctgctttccaatgtctgaaaatgttattttcatctattttgttccatttccttatttgtggcaagaactctgttttacttgattattcttgcctggtcttttacctttttaaattgtctgtactgattgttttctatttggtttcttctcatatttggatttgtttcaaaatttatactcatgctggattttgtctggtttctttgttataatttattataaataataatttattttcagtttttattcttttcttttatagctatataatgataaatttccctctgaggattgttcgagtgtcatctcaccaagtttaatttaatatgtttttattatcattcaattcaaaatatttaatgtttcctcttctgattttctccttatccatgagttatttaaaaatgaagctgagttctgggaagcaacctagtaaacgacagtaatttctttttttgggttattattattattattattattatactttaagttttagggtacatgtgcacaatgtgcaggttagttacatatgtatacatgtgccatgctggtgtgctgcacccattaactcgtcatttagcattacgtatatctcctaatgctatccctcccccctccccccaccccacagcagtccccacagtgtgatgttccccttcctgtgtccacgtgttctcattgttcagttcccatctatgagtgagaacatgtggtgtttggttttttgtccttgcgatagtttactgagaatgatgatttccaatttcatccatgtccctacaaaggacatgaactcctcattttttatggctgcatagtattccatggtgtatatgtgccacattttcttaatccagtctatcattgttgaacatttgggttggttccaagtctttgctattgtgaataatgccgcaataaacatacatgtgcatgtaaccgacagtaatttctatcatcagttaacagaaacagtaacttccactctttcaagttaagttctacataatttgaggaatcatcattttggcctttcaagataaataaatctgttactgttcctcgtcttctttgaactccacatgtccatttactttgaagcacacaataagaatgacatttcaaattcttggagccaaaggctatgaaaattattttggcagattttctaagatcatcacaggatctcagatactccaattggctaaatgagatttggaattgccagaagatctacaataggcaagattaaaaagtcctaagaaataatactcattgtctattgagttctgacatgctgtagaattccaaatccattagacaaacagatttccaataatttcttagaaataattgtaagtgtcttaaatagagccttgttttaaaaagtgatgaagagtcttgatgtaatgtctttggcaactctgagcttattttccttgacttaagtatttgaatgcttatggttatccaggttttcagttacaaatgactcattattttttatatttacatattacttaaattcttataaaatgttattgatcatatgcttgtctttttcttattctcttcccttttagaaacatgttccaaatcaagtatagatattgagaatgggtttatttctgaatctcagtatacatatgccttaaaagaaaaagcgaaatatcaatgcaaactaggatatgtaacagcagatggtgaaacatcaggatcaattacatgtgggaaagatggatggtcagctcaacccacgtgcattagtaagtaatttattatgtttgtattgattatccagatgatacacaaaagtttactaactttagtctttttgtgggggctgatataatttcatttgaaaagataagaaaaaaaaacctgcaggaacaaagcagacatcaattttttttccttttcacattaattactcagatattagtctgtctttccattcaggcttttcctactctaaagcattctgtgttacagaaacaagttagggagctttatgtgtattctggtttaaactgattttgctttagctgagacctttatgactgttaatatatatctgttttataagattagacttttacatcaaattctttactcctagatacaaaagcaatgtttttattgaagatatggatgcctagtgcataacatcaaaataatttaaactctataatttgtagatttgacactgtaggatatgtctaatactgaatatcttccctcttagaaatttttcataaatatttaggtagtagagagacaaaatattcctagatggtaccaatttctgctctgttgtatgatttccctaccacactatctagatatttatgaagatttccctaccacactatctagatatttatgaaaattttctgggaacaattggttcaatttgtcttattttttgcaaaaccactcagtaatatgtgtgtgtgtgtgtgtgtgtgtgtatacgtatatatgtatatatatatatatatatatatatatatatatagagagagagagagagagagagagagagagagagagagagagagagagagatggagtcttgctctgtcgtcggccaggctggagtgcagtggcatgatcttggctcactgcaacctccattttccgttttcaagcaattctcctacctcagcctcctgaatagctgggattacaggcaccctccatcatgcctgcctaattttcgtatttttaatagagacagggttttgccatgttagccaggctggtctcgaactcttaatctcaaatgatcctcctgcctctcagtaatatatttgaagtaatatttaatatactcatgttaagtgaagtgaataaggtattcatgtatactgttttcattttttaatgtctgtgcttaatatgaggtctagtttacaaaaaatgttagtcctcataaaaaagctaattttatactaaatttttattaattattcttttaagattttcttattattaaagagaaaatgtcttgtataacataggaatttatattttcagtctttttctcctttttacatatgtctcaactacgaattagtttggactcttaatttacaaaattctgttatgattttctttaaaaaataatgtatacctgtaatggcctgttttattactagcattgtcataaatgctttagtataaatgaattaagaaaaatgtttttaaaatatattttggggcttaagcaatgaaaaaaaatgttgtgtagaaagatatactttcacttttgacaactattttacgacaacaaattctcaccagtcatagattatttttgtacggtacctatttattagtagatctaatcaataaagctttttcttcttagaatgggaaatactcagattgtttattagatgacattagaaatgacattctaaattttttatgcactagaatcttgtgatatcccagtatttatgaatgccagaactaaaaatgacttcacatggtttaagctgaatgacacattggactatgaatgccatgatggttatgaaagcaatactggaagcaccactggttccatagtgtgtggttacaatggttggtctgatttacccatatgttatggtaagtactggtttttcagaaattcattttcaaaatgaaaataaatctgttttccaattttaaaaatttgaattatatagaggaattgttaaggaatgttgattaaaatcaagatatctcctgatttgacataaactgggaaaagaagggagttttgaaaatatctctaaagtagtgcattaaattaatacttcctatgggccacctaccttccagatttgtgattataatataattgcttttgttaccctaaataaaagctttcaaattatttagaacctagcacttattaccaaaattatagttggttacaacttcctcagctaatttgtttttttaatttctactttacatcttctatcttgtgtgttaatttctgtactttctgagtgtagttctttattttctaaatttgaaaagttctgaagaccattacatgaatctcatttacgtttctcaatcagccatctatttttcagggttagaagaaggattggctctgtgggaaaacaagtatatgcagagtgttccaaggcaaagaaaaatatgtgcaaagctgtaaaaacaaaacaatatatttcaaggtggtaaagcagagtctatcctgctgaggctagatgggaggcaaggaaacaattatccagatcagctcaaggcatcatatcatttggattcattttatgactaatgaaaacccataaaagagttttaagaaaaggaatggtataatttgatttctagttttgttggattgttttcctggatgctgtactttttgtaggcaagaggcgacaccatgagtccaggtagggtgagaaagtgtggggactgagagagagtgatgataggggaggtgcagagcagaaggctgatttggaaaacatttaggtgatgaaaagtacaggtgatgttactaaatgttgggtgtgaaaaagagtgagattaagggactcacatgtttgttttcaattgttttctcacaagtatgtaggtaaatggcaataaccattttgtaaaatggtactgactggatagaatgcattttgagagggctttgcaacttttgacttggacacattatgattgagtcgccaatggaaaatcaaaactggatatgtgaagtgtggagttggatatgcatctagagaggagatatgcatttcggaatatcatcatataaatgatgacgctaaattggataagaatacagaatgaaaagagcaaagagctcaagatgaagccctgaaacattaccacatttatatataagacagaagagcaatagatagtaaagaaaatggggaaaaaaggaggacccagagaaacaggagaaaaaatctagaatgttgccatagacataaaaataaggaaattattaatgaaaaggtagtgtaacagattgcttaataagtcatcctgtctgaattctaattccactgcttgctgggcatgtatctttggccaacacagcaagtctatttgaagctttgttgactctttcttgttggtaaaatgtcacatatttacaaacagttctaatatttcaaaggattgtgttagttagcagactaaaatatttataaatatttattgccatagtgccttatataataaagtcaaagaagttgtaatttaattaccttaatatcattatcaaagtgataaatatttctaatttagttattatattctgttcagaaattgtgatggattaggtaaggtacaggccaatgacaagtgtaacaaaaatggattttaatagagtagaagagacagaccctacatagaatctgccaataaaaataatgagctagacattcaatacagactgtagacataactctttcaagattctggctttgaatctaataggaagatcagaatattgcttgaggaaagttgtgcactgaagggataattaaaagaaaaaagatggaagacaccagagcagatacagcaaaaggggagctgcaaaggctgaacacatgacttacatagttgccctgagaaaatgcgaggggaaaggactcacagctactgtggaggtattgtgctttggtggcaacaggactgcttacaaccttgtgacaggtggcaacaggactgcttacaactttgtgacaggagatgggaaggaaaatgagcagtaacgttggaaaatggtagaagctgatggattctgttttgaagtatgagacatggtcatctgagattgaatagtgtgtgggcgaaggaggaggaagagtactaggtagaatagaaaagttttgaaatagtcacagctgagaaagagaatgagtacattgtagatgaaaggcagtgtcaaaggtccagttaaatttgactcattcctgctgttgtaaacacctatcataggacaggagaaaatggtgaaaacacaagcacaggtctacttatccagagattttattctaatataagacagtggaaaactaaaaagagataagccaaatatccaagtaataaaaatatttaaaatatattttatgtatcactgtgtacagagaaatagaaaatccaataattgagatagaaaataggagggaaggaactggagatctgttttacataggaagtcatcgatgcaaagaatggttgaaagccatttgttatagtgagaagggtatgtgcaacagctgaggcagcgaagaacttgacctttttaataaaattcaaagatcataaaatctgaatcctggatttagtggaggagagagacatttgataacattggaagagtaggcatggatcataaagaggttgagttttgctctaattgagagggggaggcttaatttaagagactcataaatttcttttctgtgatgataggtaaatttaggttttatgaagccagaagcttttacaattttgaggggtcttcttcaaaaaagaacacaaaattgtgaatatattgcttcagtagtctttccaatcaccagacatgaaatgaaaacctaaaggagagaaagttggagtggcggacatagcagtagaagctgatgtagaaaatgtctttctattgcaaattgtacaaagacttaggatcatttgaacacataactaggaatttgctagtatagtacaggcctccaaacattaaacgaagaaataccagcttagtattcttttcaaatattcttctctcagccatgtaacagaaaactgcatgtggattgacagacatctgagtatatttcaagtgtcctaggaggtctcttctttgtggaaaggtttccacagaattgttattatggagcacttaagctaaataaggagtatgtatctcagagttaaaaattcatattaacatttcacatatctagtactaggacttagggttttgagttttagatgaagaaaaatatttctaattcatggagtgtccattcacattcttctctaaatcacgttttgtaagttattacctctatataaatacagcatttgaataatacccaataatcaagatcttaactttcctttttaagataatgcttttcacaatattacaacagacagaatttatataaaattagcacaaaatacgtgaacaaacacacatacaaaaaaaagaattgctatgtagaagattggtatagacttttaggagagaaatcccagtgattctcattcaagtgtgattttctcaaataatctgcaaaactcattaaaacaaacacaaaagcaaatttttgtagttattattttgtgacattacttttaagaatagttttaaatctaattttgtaattgtattttaataattgaggttatgatgtaattaattttctttttagtatgattctaatttatgaattctagcttgtacttttctaagttagcaagaaaggaggattctgaataagaaaaataatattttggataatatttagtaatgttgctgatttttaaaaattataaacatgtaagagataattttacacatttcttatctgaatcagaataattatcaaatttattaaacattgatataaatagtacatataacaaaaattgttatatgttaacataaatattcaggatacctagaatttgcctttccatgtgaacttgaaaatttatcttggtttgttttctttatttgtaatatattaattatgtgttttttatattttttttaacttaaaatatattagaaatgctattttgggttctttttccttgattacattaaacaaaaataccaattttaattaatttcttagtgcatatatcttcactaataaatctttgatgagaatttacctttttgtgatgtatatgtcagtcatcaagaattataaacatgatgagaccagaaatcatttgaggttgtttagtttcagttaaataaagttatcattgactctgcaatgacagatattataccatcattattctcgggatcctccccagttctattataaatttaacttcttaagatatttccatggtgttttatgatgtgttcttttatttttaaaattttaatttctatgttttatatgtttagatggtccaaatgcagttttgttgcatggatatattgcatagtggtgaagtctgtacttttagtgtattcatcacccaaatactgaacattgcacccattaggtaatttcttattcctcaccctcctgctatcctgccacatttctgagtctccaatgtctgttactcagcactctctgtccatatgtacgcattatttagctctcacttataagtgacaatatgtgggattttactttctgaatctgaattattttacctaaaataatggcctttagttttatacatgttgcttctgaaggcatgattttattctttttttttctttttattttttgttttggctgagtagtattctatggcatatatctataccacatattctttatccaatcatctgttggtggacaattagtttgattccatattattgctactgtgagtagtgaggctataaacatatgagtctgggtatcattttgatatgataattgatttcctttgggtagatacacagtagtgggattgctgggtgaaatggtagttctgtttttagttctttgggaaatgtccattctgttttccatagaggttgtactaatttacattcccaccaacagcgtataagcattcttctttctcctcactgtcaccaacatttattattttttgactatttgacagtggccactgtgtctaatgtaagatgataactcatttttttaattcgcatttctctgatgattactgatattgagtttttatttcatatttcttggtcattttcatgtcttcttttgcaaaatatctcttcatatcctttgtccactttttcatgggattattatttttttttcttgttgtgttgtttcagttctttgcagattctggatattagccctttttcagattcatagtttgcaaatattttcttccattctgaggttgtctgtttactctgtttattatttcctttgctgtgaagaaaatttttagtttaattcacaatcacccagaagcaggtcatttaattttcatgtatatggatagttttgaaaattctttatgatattgatttatagttatatttcaccaagttctgataagatacttgatattatttctaacctttaaaattttgggaacttgctttgtagctgtagcctagcatatggtctattttggagaatgttccatgcacaggtgagaaaaacatatattctgaggttgttgggtggaatgtcgttaaaatgtctgttaggtccatttgttctacagtccaatttaagtatgaggtttctttgtttatttttttgtccctgcaatctgtctagtatagtcattgggggtgtggaggttgcttgccctcattatattgctgtttatctttctacttagctctagtagcatttcatttatgaatctgagtgctgaggttttgagtgcatatatatttagaattgttatatcttcttgcttcctttatcattgtgtaatgaacttcttgtcttttttttcttgttgatttgaaatctttttttatatataaatataactataccaaatgctttttgtttctgttgttcaaaatatctgtctccatacctttaccatgagtttgtataggtttctctaagttaggtgggtttcttttgagcagcatgtggttggtttctgttttccatatttggtccacaaatctatatcttttaagtggaacatttaatctatttatgttaaaagttaatattgtcatgtgaggttttgttcttgtcattatgttagttgttacctagctggtttgtagtcccaactgtgtaattttttaataagacctgtgagttttgtacttttgcatgtctttatgatagtgagtattgaccatctatttccatgttcaggactccctggatcatttcttgtggggtgaattcctaaagtggatttctagtggtgatgaacttccttagtattagcttgtttgggaaagactttatatattcttcatttatgaagtttagtttagcaaaatacaaaatatatctctaatatatgttttttcaataaatatgaactaatctttctttaagaaccctgaaaataggacaccaatatcttctggcttgtacagtttctgctgagaagtccactgttagtcttacgagatttccgttatagttgattagatgcttttctcttgctgattttataatttttcccgttcacattgactttagatagcctgatgactatatgtttgtagaagttcatctcgcaatgcatcttcctggtgttatctgagcctcttgtataaggatttctatgtctctagcaagagggcaagaggagataaattttcctcaaaaaggtttttttagctttttcttctccctcaagaatatctataactcttaagttttctcattttttagaacgtcatttttctcaaaacctttgctcattaaaaaatgttatttgctctttatttttgtctgacagggttaattggaaagacctgtcttcaagctctgagagcaagtttttctgcttgatgtaatctgtaattaaatctttcaactatattttgtaattcttcaatgaatttttaatttccataagttctatttgttttttaaaaaatatttttagtacatttttcattcatatcctgagttttttttctaatttctttgtgttgcttttcaactttctcttggactccatttagctactttaaaataaatattttaaattctttggtatttcaaagattttattttggttaggacttattgctgaagagttagtgtgatcctttgcgagtgttgtaatacgctgttttaaatcatacttccagaaatgtttcagtggtttcttctcatccagatgaactatcccttcttatttttaagtccagtttccaacagacaggattttttttttccctttgagaatatgactacgatgtatgttgtatagggctatttggtttaggttctgggttctttcagtggtaaagactctgtttgagtaccttggttagagataacttttgtatgatggctttcttaattgctggttgtagtagttatgtactgggtgtatgacgaggcttactgcctcctgaagggctggtatggaggactacgcagaaaactaaccttgttctgcatcatgccctagtgtcagcattttgcactgggctgtgcagttcaacattcaggacagtaggtggcacggacaggtaagagccagctgcagcagaggcagatgagcctatgcttgtcactgtttatgggagactctctgttgccccaaggaatggactgatctgtgaaaggtacagtggtctgaggagctggggacaaagcgggatagatctgtaccactaagctcacccttggatgctccaaggatgagcacaagcaccagccctgacaggggtgtcaggggaagaccctggggagatacccgtagcttgtctttcttgcaagcctggcttcattgggcacatgaccagtggagttgtagccaccccctaatacccctacaatgtccgtcctctggtgtgtctacaccagtctcctttgcgagtgaccacagctatgaacacagaattggatccacgggacatgttcccctctctacatccgtgcccaagcgctgggaccattgggctcctgggatggatctatactcctcccttgcagagccaaacaccgcgtctgcgtgtctgctggaagtggcgtagtcattttcagcccacaagcaggttgctcttgcacacaggaaagtgaatgctacagtcttctttgccacaaggggtgttcctttgttgcactttccattaggaatagcctccctggtggttaaactattgggaatgctgtaactcctttgggtccagccagctatgggtgactgccacatccaagcaggtgacagggaatatttgtgcggctctggtgttatggggacagagggctgaggttcctgggtaggaaacagtccccacatgagtgcactgcaggcatgaaacctaccactgcagctcaggcccaaggggaaggcagatgaccctattcaactagtagtttggtgtaatgccctcaagaagttcccaaatctccactcacaccagtgtgtgtgttcacgaagacagaagagctctctgatggcttggatccacacggtgagctgcagggagcccagaagactcctacctacactttctatgaggtcccacagggtcctagtcaacctttgtcaggctcttgcttctgtctttttccatgctttggcttctctccatggtttctctatgacgctcctgcaccctctcttaaatatttttcaagttatgatcatttacctgtaactttggttcttctttctgaggagaacttgtgtccaaactccttagtcagtcatcttgttttcaaaaagccccaattctggtctatatgcacttttcttttttaatatgagagagtaatttcatgttttgagtaaaaaaagtaatattaaatttcattaatgtcagtgattaaaactagattcattgtaaataagttgaatttacaaattaatttttagaacagatatatttcaataccataacatttataataaagttccatttcaatttagacagcatataaaacataatatgtagcattctttacagggaaaaggatttatctgatgcccctctgtatgacccaatatcaacctcactttattgtggcatatgtaaaattaactttggcaatgattaattatatattctcatgaaattattttacctttttcaagaaagagaatgcgaacttcctaaaatagatgtacacttagttcctgatcgcaagaaagaccagtataaagttggagaggtgttgaaattctcctgcaaaccaggatttacaatagttggacctaattccgttcagtgctaccactttggattgtctcctgacctcccaatatgtaaaggtgaatgcttatcttacaattgctgaaataagaattagaactttgaataccaacttttttcttattaattttgtttgggctcccattgcctgtaatctaatgaattaagtcaaatatttgcctgtgaaggacatgtattgagtactgaatacctgagattcagtcacttaagttaatctccactgtttcttgaacgatgtgctggaagtattcccagacacacaggtgttgtcggtcttagtctactttaggtttatgtttctataaaggaataactgagtctggatgatttgtaaaaatgttttatttggctcactatactcatgactataaaattcaagatcgggcatctgcattcagtgagagccacagaatgctggtagaaagggaagaggagccactgtgtccagagaacacatgatgagagaggaagcaagagagagagcagggcagtgacaggctctttttaagaaccagctcttccaggagctaatagagtgagaactcaccctgagagggggcattcatctgttcatgagagatccatacccatgatccaaacatctcccattagaccccacctgaaacactggggatgaagtttcaacatggggttggaggtgacaaacatttaaaccatactagtggctgacaatggagggatttctttgttaattttcattttgcttgaaatgtcaacatccattctggacattttatatagtgtgggctgcaacttaagtttcaccgggtgtgtctaaacaatatttaagcagcttatattcaattcagttgcttgtattgattagtcaaactttatgttgatcaaatgcttgcctcagttatgatatttttccaaaatgttatgataaaatgtttccatgaaatgtaaaaattaacatgattttcataaccacatttgctaattggttttcttgcatctttaagatatctagaagtctgagcatattttaacattttaatataccttcaatatgacaatttagtataagtaatacaatatgaacaccattcttgattgtttaggatgctataataagttacataatgaagaatacatgaataaaagaagaaaatctttccattttactgaatttttatattgtaaaacagacaatttaaccattatttacatagtatttctactatagagcaagtacaatcatgtggtccacctcctgaactcctcaatgggaatgttaaggaaaaaacgaaagaagaatatggacacagtgaagtggtggaatattattgcaatcctagatttctaatgaagggacctaataaaattcaatgtgttgatggagagtggacaactttaccagtgtgtattggtaatgtataaaatattaatatttaaacttgtcaaaacttttgtattttgtatctaaaacacatacatcatgttttcacaataaactttttttgtaaaatttacatagtggaggagagtacctgtggagatatacctgaacttgaacatggctgggcccagctttcttcccctccttattactatggagattcagtggaattcaattgctcagaatcatttacaatgattggacacagatcaattacgtgtattcatggagtatggacccaacttccccagtgtgtgggtgagaatacccttcttaaatcaacatttaacaaagtttaatatttttattgtaacaacaataattgcaactatatttttgaaatttacagatatgcctcaacatttccagtcttcaatatgagaccaatcttttgcatattgcttataattcaatatgtgtctagaaagaaaaaataaagctagtaatataattttatgaatctttctgcgtctgataacagtattgtttatatttaaaagtgtgaagcaacattttacttacaaaaattgtcatgtgaggccagggtggttgctcacgcctataacctcaacacttcaggaggccaaggcaagaagattgcttgaggccaggaggtagacactagtgtgggcaatatagcaaaagcccatctctataaaaaaaattttgtaattagttaaggtgtggtggtgcatgcctgtaatccagctacttgggaggctgaggaggaatgattgcttaaggccaggaattcgagattgcagtgagctctattgtgcattccagcctgggcaacagagtaagactctttctttaaaaaacaaaaatattaaaaaattatcatatgattaaatatgagtactaattactgagaaattataacagttttatataaaatataaatattattgttattgtatggtattcctttttaggcactgagaagcaaagaaacaaagttgacaaaatacctacttactactctcccataggattcttttctctcttaaagcttccaaaagtgataatttttcagtttgttccatatcagccaaaataagtgaatgtgctgcagggttggtgggccacaggccctctacatcagtggtatagctgagtggcatgaggtagtcagggactgagtcaggacgtaaatctcattgacggacttcacactgtaaatctcatgtcttgatcagcaagaaggcaaggtgattcacttacagtgtgacttgagatgtacaatctttaaaatcattttgcctctttgatgactaaccgggaggatcttggggaccctcattcacttttctctaaactgagatttttcctaaagttttcctgggtcctgaattctaagagtcctaatgtccaatcatacttatttatccaatgaaatatccaatgatattttgtatttcccaaagaataaaatgtcttctgataggtatctctaacatttcagcgacagaatacagggcttatattttgacataatagcattttgatgcaatgtgatcaggaataacttggttggtgaaatttataatgattaagtcataattttaccatgctaatactatttactttataactatttttatgtaatagttggtttgattcctatcatttgaattttcataaaaatatatttattttatagcaatagataaacttaagaagtgcaaatcatcaaatttaattatacttgaggaacatttaaaaaacaagaaggaattcgatcataattctaacataaggtacagatgtagaggaaaagaaggatggatacacacagtctgcataaatggaagatgggatccagaagtgaactgctcaagtaagctcttattttgttttcagaaatgtattctatttctcatttggaaaagtaataggtatgtgtgtcttttaaaaactttagctatttattattacaaatgctactgaataaggcaggtaaactagaaactaatgaaaacactgttcctaatattaactgtgccctgtgaattagttacctttagtataaacacacacacacacacacgcacacacacacacacacacacacacataaaccaggcactacatgtcatcattactgttggaggaccagtgcttctcattccttttcttgtcaacaaatgttcctgtgcctatacctctgtctatgccaataactactatgtatctgtttgtatatgtctgtatgcatgtatgtatgtatctatatctatttctgttgattcatttatttaatctatctctctgtctattcatctacctgttcatctacctaatcatctatttatctattaatttattgttcatctatcttgaaaagttagtcatattgacacatacagtttcacttgaatagtgtaggttttattccagtcttctcatattttatatctgtattttgctatccaattgtgggtttccttgcctcactaacttcaatatttttaccaatgtctgccagtctaggatatacagaaagcattgacaaccaatacaaaaactaatctgctatcaacatttcaatatgtttagagtccttaaagaagcaaataatatatatatgcagtgaagtgtacatgttctacagttttttcttgaagttttatagttttagccattctatatagatttattaaaatgatcgtatagttatcgtcctttctgttaatgggatgcatcacctttactaatttgcctatgttaaacgacctttacatttcttggattaaacccatttgatcatagtgaatgatctttttaatgtgctgtaggatttgttttcctagtatagtgttgaggggttttgtacctatgttcatcaggggattttgcctgtagttttctttttgcgttgtgtccttgtctggttttggttccagagtaatgttgggccactagaatgagttagaaaaatgatctcctcatcaaatttttggagtcgttttagaagaattggtattagtcctttctaaaatgttgttataattcagcaatgaagccatcaggtcttggattttctttgatgggaaacattttattactgacttaatctgttgcctcatgattactctgttcagattttctatttcctctgaattaatcgtcgtaggctgtgtgtctagaaatttatccatttcttctaggttatccaatttgttggcatataattgctaataacggtctctcattatactttgtatttttttgatatcagttgtaatatcacccttttcatctccgatcttgtgtttctttaagccgtatctctcttttttagttattctggttaaagctttgtcaatttttgattatctaaaaaaaaactattttcattgatattttgtactgctttgggggctctattttacttacttttactctgatctttatgatttccatccttctactaattttggaattgactagtttgttcatgtttttctgcttctttgaggtgtactactagactgtttatttgagttctttccactttcttgatataggcaattattcctaaaaacatccatcttagaactacttttgctgcatcccataagttttgctacgttttgtttccattctcctttactgaaaatatttttaaatttatttaaaatggtttgaccctatgattgtttcagagcatattgtctaattttcacctaatttaaaattttccatagttcctcctattattgatttctcatttcatacctttgttgtcagaaaagtgacttgatatgatttcagtcttcttgaatttgataagacttgttttgtggcctaacatataacatattctggggaatattctgtgcgcatttgagaagaatatgtgtttttttgttatgtggaatgttctttatatgtctgtccaatctatttggtataaattattgtttaagtttaatgtttccttattgatattctgtctggatgatctgtctcaacgttgaaagtaaaatattgatatcccctactattactgtgttgcagtccacatctccattcagattcctaaatgtttcctttatatatttagttgctttgatgttgggtgcatatataggtttataatagttgtattatcttgacaaattgaccccactatcattatataataactttctttgtacctttatacaatttttcccttgtctattttgtctgaaatgagtataactacccctgttctcttttagtttttatttttataggtttttttccatgccttcactgcaatctgtgaatttacgttacagtgaagtaagtcaattgtaagcagtttataattggatattaatttttgatttatttagtcattctatgccttttgattatagaatatattccatttccatttaaagtaattttagataggtaaggatttatagtggtaatttgttaattgtgttctggttgtttttaaaattctttgtttctttcttgcttgctttattcatggtttgatgactttctgtagccatatgcttaggattttttcttttaatcttttgtgtatctattagatgttttgcttttggctatccttaggcttgcatagcataccttataaaaggctatttgaagttgtagttatccttaggcttgcataacatatcttataacaggtattttaagctgataggaactgaattttgattacatataaaatatctaaattttactctgctcctcccatgttttctatttgatcacatgctttgcatctttcaataattcgtatctcttaacaaagtttgtagcttcagctgttcttaccacttttgccttttaacctttatgctagctgtatttacccatcactattacagtattagagtgtttgaatttcatattgtgcttacttttactagtaagttttatactttaacatcttcatgttactaattagcatcctcttctttcaccttcaagaactccctttaacatttcttgtaaggcaggaaagtgtccttatgctctctcagctttttttcaatctcagaaagcctttatcactcctttgtttttaagacagaatagtggaatctagaattattccttggcagttgttttctttcagaattttgagtatatcattccacttccttatggcctgcaaggtttctgttgagtaatccactgatagtcttgtggaaattccattttatgtaaccattcacttttcattggcttttttcaatacttggtctataacttttgataatttgattgtgttatgtcttaaagtgactatctttcattaaacttatttgatttcctttgagatttctgggtgtgggtttctatttctttcccagttgttgaaagttttctgtcattatttttttgaatatattttctgtatcgttgtgtttctttctgtttttaacatggtgataatgcatacgttattccacatggtagtattccatctggatcttaagctatcttcacttttatttatttatgtgtttattttggttctcagatttggtgattttcagtaatttgacttcaagttcactaattccttcttctccttcatctagtctgctgatgaatacctctttaaaacttttccgttcagttatagtattctcaaatttgtgatttttgtttggtattttaaaaatactttctacctctttgttgaagtagttaatttgtttttgcattgctctcttggtctcagtgagtatctttatgaccattattttgaattctttcttgagtaaaacacctatatccacttccctcaggtcaatttctggagactcatcttgttcttttgtttggagttatgatatcttgtttctttattttctttaactcacagtgtttctatgcaatagataagacaatggcctttctcagtcttatcagactggcttcatataggagaaagacctcactaatttttccagccagagattttcatgtgcctctcaagtctttgtgcggactgctgtctcttattttttgtggccccctggaggttagaatgtgccacatcttttcaggacctgggaccaacaagttaggagccaggaggtctagatgtagctgaaaatattgaagacttggctgtgtatttacttacttctattttcatagtgaaagtgaatgtgcgtgtttatctcccactctctctctgtattacaccaagtaaagaatctgtggctaatacctgtactaatattcaggctgcatgctctgatcctgaagaggtatctgcttgaaatgagtccattgtattaccagctttttgtattctgtgatgtagggcctttcaggaatgcagatctctatcatctcccagtgtgagtttgttaaggagacgatctcttgagttggagctatagaagtgatgacctttgaatgcatggctaaacttggtccaggaagaatggataaatctgaatttatcattggggcgagactcatgaagtgccaaactttggctttggctgcgggaagattattttttgtttgcgtcattagataccctgtgcaagctcgatagaggccagttcattaagtagccagtggaagtatgtgccctaagccctttcgacagagaaatggaaattgaactttctctttccttttctgcactgctccaatttggcatagcgcctggagtttttacatagcattttaagaccatctatttgctttacgatctatggagactggtatttttctaatatctgctgtgacagttaagagttttaagaggagtccttttggaggtaactgtaaaggttgtagcacttgatggatgacacaaacctttttgaggataaacaggggagctgcattttaaaaaccttttctctgcactgctcttgggcaatgaagctcctggaagtgcttacacacccatataaaacgccatttcttttttcagtggtctagatagactctggatatattttgtgccctctactcccagaactaagagctttagaatacagtccctgaatgaaagttgtaaaagttagggcactcaagtttgtgtggacaaacttgttctaagagtgattaatgtacctggatgtatcactggggtgagccacgggaaccggctagagaagtgcctgatgcaagttcattagaatccagactgcaagttttttagaattcagacctctaagtagccacaggaagaatatatcataaaacttctcgggagaaacaggggactgttttttcagccccttctctgaactgctattaaggaatgaagtttctggaagctcttcagcacttgtatcataccaccatttttcctgtgatctagagagactctcatgtgtttaatctcctctgcttccaaaattagtgaattaaaggccaaaacacaggatgctttatgtgagatccaaaaacttctccacaaggagaaactgggtttttgagattccttttctaattgtgtggtgcagtgaacaaggctggggtccatgctccattgtgttgcaacttttcttacttgttcaatgtgaatgttgtctttgttgcctgttaagtaggagtccctttactggtctttcattttctttcaggaggagttcatttatgaatagatgtttttttaggacattcttgggtggaagaagagtcaggagcttccacttctgccattttgctgacatcactccctgcctagctctttattttacccccaggaaactagagtattgcaggtatcgttaagtgctcctacacaagcaagagagaaacctgtactttaggatgctcccccaaaagctaggatgatagatgcttagttcactcttatctttcctctctgagggagaagcagtcaaaatatattggtctctgtttactttagggggttgcaggaggctttgaactggtttcttgatttctcataaagggaattgtttccagtatcgtcattgaatcagtgtgcctgtggggggaagggagagtggtggcttcctatactggcatcgtgctgatgtcactgccctctttcatcctcaatattgatcattttttaaatcttgatcattgtttttactttgtcctcaattttattaatattttcaaaaaccaattgtaatgcctttaaattttctccatttgctctgtattttttagttttattatgttttactgattttagctttgctaattttctcccttctctgtgtttctttgtccgttttctcttcttcactgattttactgttttcttccttctgatgacttcagttttaatttcacttttctcaatcttagggtgaaaaatgaaaacatggtcataaactatcatactttgaaaatataaaactttaaagctctattcttttaagcactgctttagctgtgtcccagaatgttacacacgtgtgtgtgtgtatgttctatgtgtcgggagacagagagagagagttcatttttatttgatttgaaatattttctcatttgtcttgtggtttgtctgttgatgattaattatatggaagtttattgtttaatttcaaaatatttgtttttttctagataagtgatttttgctggtttctaatttaattctcttgtgaaagaatactgggaaaatttcaatattttgaaacactcagttttttaattgctcagcacatagtctaccttgctaacggttctatttacaaataaaaatatgcatacacactaaatgtagaattaggctatactgggtcacaatgttcttcaaatttatttgccatgtcacaaaatgttaaataatctctttcttaattgtttactatcagcaaatactttaaattaaataataatgattgtggtacacattaaaatcaatgggatacagctgaaacagagatgtatttagcattataacatgcatcagaaaaaacaaataaaaaaataaaagcaacaggtactacaatctagaaggtagacaggaatgtacacccaacaaaaatagaaggaaagaatcattcaagcataaatagttgaccattaatcttaagaaaaataaattgatgagaatgttaaaaacatgtcaaaatattgaaaaacagaaataagcaaaatacttttgataaatatgaaatactttatcataagcgaaaaaagaaaactcgacattatcaataacctttaatgaagttttgttcatccaaacgtctccctgaattgataacaaaatgtcagacacttaaaatcattgccatgatttcctatagtacgattacataaagctttaggtgaagtagagcatacactatgataggagaaaggaaaatcaagggattatagaatgctcccagatgcttctaaactcccccgtcagtcaaacaggacatgcttcattttcatattatgaaaaaatgagatatttctgatgtatcgcagtttaacaggagcttagctgtgagtttacaaaggtgtctttatatgtgattatacaactaaagccaggctgtgcaatgcattaaactgggtgcataacatccatttaaatatccctaaacagtacaggtaagctagtaaataaaagctctaggggagtttcaagttttaaatagcacactataaatcactagtgattatatttaatgcttatattggtcaagtgtcagtaccaaattgattattaactacatataattctacttctggctaatcagattccattggcagaaaatttgtgagtgttttaatccaatcctgatacatttgattatagatatcaatttttatttaatgcatgtaattaagagtgtgtaattccattaaaacattctaaaggctcaaaataattaaaatcaatattacataaattatgcaaatttattaaacaaagaatatatgaaaaaactacaagaaagtctatgagaatacaagccaaaagttctattgtttaatgtaactgttacacagctgaaaagtataatatttgcatacaaaaacatcataattaatatgtgataatttatgaaacagttattgatctttctatttattctattttaatcatataaattatttttcatcaaaaattctaattttaatatttttattttttattttttattataacattaattatatttttaatattttttagtggcacaaatacaattatgcccacctccacctcagattcccaattctcacaatatgacaaccacactgaattatcgggatggagaaaaagtatctgttctttgccaagaaaattatctaattcaggaaggagaagaaattacatgcaaagatggaagatggcagtcaataccactctgtgttggtcagtagtgtataatttgttttacataattctttcaaatgaggttaatattctcttgtgcttcgtgtaaacaagagagaagttctttctctgtgtctattactttatcctgacaaaataaattaggacctaggcacattaatcaatcaccactctttcagttttttgaacaaaatacagccaaaatctttggaatattatgtaaatgtcagataacatttccattcatgcatattttaatccttgtgatgaacaagacatgaatgaagatgattattgaacaagaggatggtaacatagatatggtggaggaatatatctttgcgagtttctaatatgtttttgtttttaaataattttatttgttcaaattatactcactttaaaatccgaaatagtatttagttttatatttcaatttaagtattttatttgtttttaaccctttgattttcattcttcatttagaaaaaattccatgttcacaaccacctcagatagaacacggaaccattaattcatccaggtcttcacaagaaagttatgcacatgggactaaattgagttatacttgtgagggtggtttcaggatatctgaagaaaatgaaacaacatgctacatgggaaaatggagttctccacctcagtgtgaaggttaggccaatatgaatactcaatttctgtttatagtagaattcataaaaataatctcttgttatcaaagtgaggggaataattgagattactgcatatataaaataatttatatattataccattaaaatactttttgcatgattgaatctattctatttatgttaattttatttgttcatgatagagtcactttgtattctggcattaaaaaataatatctagtgaaattaaacctatctgtattattctcatgctgccataaagaactgcccaatactggataatttatacatacaaaaaaaggtttaattggctcactgttctgcatggctgaggaggtcttaggaaacttacaatcatggtggagggagaagcaaacgcatgaagacaggaaggagaagttctgaccaaagggaaaaggcccttataaaaccattagatctcatgaaaacacactcactatcctgagaacagaagcatggggataactgcccccattattcaactacttcctactgagtccctcccacaaaacatggagattatgggaagtacaattcaaattgttatttggttggagatacagtcaaatcctatcattccaccatggcctatcccaagtctatgtcctcacaattcaaaacacaatcatgccttcccaacagtcctccaaatcttaacttattccagcattaactcaaaagttcatatccaaagtctcatctgagacaaggcaagtcctctctgcttatgagcctgtaaaatcaaaagcaagttggttatttcctagacacaatgggggtacagggattgggtaaatgcttccattccaaaagggaggaaatggctgaaacaaagtggctatatgcttgatggaagtctgaaatttaatagggcagtcattaaaccttaaatttccaagattatctcctttgactccatgtctcacattcaggtcatgctgatgcaagagatgggctcccacagccttgtgcagatgtggctttgtccccctcctggttgctttcatgggctggcattgagtgtctgtggcttttccaggaacatagtgcaagctattgatggatctaccattctggggcttcaatgattgtggtcctgttctcacagctccacaaggcagtgcctcagtggggactctatgtgagggctctgaccccacatttcctttcctcaatggcctagcagaggttctccatgtgggctcccccctgcagcaaacttctgcctggacatccaggtattttcatatatcctctgcaacctagttgtaggttcccaaacctcaattcttgacttgtgtgcacccacaggcccaagactacatgtaatccaccaaggcttggggtttcaccctttgaggcaatggaccaagctgtttgttggccccttttagccacagctggagctgaagcagctgggatacagtcctgaggctgcatagagcagcagggacctgatccaggtccatcaaaccatttttccctcctgggcttctgggcctgtgatgggtgggggtgtcatgaaggcctctgacatgccccggagatatattccccattgtcttggtgattaactttggctccttattatttttgcaaatttctgcagcaggcttgaatttctccccagaaaaatgaagttttattttctattgcatttacaagctgcacattttccaaacttttatgctctgcttcctcttgagctctttgccacttagaagtttattctgccagataccctaaatcatctctctcaagttcaaagttccacagatctctaaggcagggcaatatgccaccagtctctttgcatagcaggagtgacctttactccagtttcaaacaagttcctcacctcatcttcatctgtgaccaccccatcctggacttcattgtccatatcactgtgagtattttggtcaaagccattcaacaagcctctaggaagtgccaaactttcccacatcttgtcttctgagccgtccaactccctaggaagttccaaacattttaacattctcctgtcttcttctgacccctccaaatggttctaacccctgcctgttatccagttccaaagctgcttccacatttttggttatctttacagcagcaccctactctctgcagtaccaatttactgtattagtctgttatcatgctgctataaagaactacccaagactgcataatttataaaggaaagaggtgtaattgactcacaattccacatggctgggaggcctcaggaaacttacaaccctggtggaagggtaagcaaacatgtccttcttcacatgatgacaggaaggagaagtgcaaagcaaagacagaaaagctccttataaaaccatcagatctcaggagaactcacgcagtatcatgagaacagcagcagaggaaaaatcgccctcatgattcaattttctcccaccaggtcccatccacaacacgtgaggattatggcaattgcaattcacgatgagatttgggtggggacacagctaaacctgttctgcaagttgtcatgtttgctttgccactatgttttaaaacttcttttacattcttcccacaatgccccttcttatttcctacaatatattatgttttacctggaatcgttaactctcaatgtgtatcttattatcactagtaagtttacagaggcattgtttaccaggcatagatgatctctttctgaaatgtattgctatttttagtttcaagtccttcttcagttggtgacagtccgatagacagacagacaccagaaggctagttttaggaaacatttgtgttacttctctgtgatgtcatagtagctcctgtattgtttattttcaaataaaactacttaatattaaaacaggcatataaaattaaatttatgagttagtgaaacctgaattcattcttttttttttaggccttccttgtaaatctccacctgagatttctcatggtgttgtagctcacatgtcagacagttatcagtatggagaagaagttacgtacaaatgttttgaaggttttggaattgatgggcctgcaattgcaaaatgcttaggagaaaaatggtctcaccctccatcatgcataagtatggtgcattgaattttattatatgtatgataaatattcttcattcaaagtgtaagtggtaccaataagaaagtaaacagggactctagaaattcataaggttttcttgaatattctggactgctgtgggaaattatagctgtagtaattaaaacatttgacattataagccaaattagttcattttcacatcatcttgtgtgaactttaagcatcctctgatgtatattctcagacttctcatctctgttcttagggcacagctgcctctactcatcaatctccacattattcaatcttctgtcagtttatcaacaatctgcctataagtacattttctgaaatattttaaaaaatcattataagtatttcacatttgatagaagcaaaaaatttggaaatgcacacacaatataggtggtgtattattccgttttcacactgctgtaaagaccttcctgagactgggtaatttataaaagaaaaaattttaattgatcacagttcctcatgactgaggaggtgtcatgaaacttaccattaccgctgaaggggaagcaggcaccttcttcacaaggtggcaggagagagaggagtgagtgaaggaggaacttctaaacagttattaaatcatcatatcttgtgagaactcactcaccatcgtgagaacagcatgtgggaaactgccaccatgatccaatcacttcccaccaggtctctctctcaacacctggagattattattcaagatgagatttgggtgaggacacaaagcctaaccatatcaggtggcaagtatggacaaaaataatgtgaacaaaaaaatgtgtaatctcaattgctacggctaccaatatttcttcagtcttctaatatcatttctatcttgtatttttaatagatttagaagaatttaatgtaattaagacaaaatggctaatatattttctcaagttataagaaaaatgttgtacagtattcattgattctatatatcgctattttagaatccattacatgtattgtatgtaacctatttttaaagatttgcggaacaaatacatatttttcctatttcagaaacagattgtctcagtttacctagctttgaaaatgccatacccatgggagagaagaaggatgtgtataaggcgggtgagcaagtgacttacacttgtgcaacatattacaaaatggatggagccagtaatgtaacatgcattaatagcagatggacaggaaggccaacatgcagaggtactttggtgaattttcaaaatttatttatataatgtgtgggcccagcccagtggctggcgcctgtaatcccagcactttgggaggccgaggtgggcggatcacttgaggtcaggagttcgagaccagcctggccaacatggtgaaaacccgtctctactaaaaatacaaaaaaatagtggggcatggtgacatgcatctgaagtcccagctacttgggagactgaggcaggagaatcgcttgaaccagggagatgaagattgaagtgggccaagatcgtgccactgcactccacccagggtgacagagtgagattccgtctcaaaaaaataaataaacctgaaataaataaatatataagtacaatttatttatatagagtgttttgggaataaaatatagaattgtctctaacatcattaaaatggacataaattaagtttttacggcaggacaaagtagtcgtatgcctaaaaataaaaagatggaactgagtatttgatgattaatcttagctcaatagttctcaaagtgtggtcgctaaaccggtagcatcatcatcttcttggagattgtttgaaatgaaaataaaattccgtaagctcattctagacatccagaatcaaaagtctcaaagtaaaaccctgaaactgttttaccaacacctccagggaattctatttacacttccgagtgagaagcattgctatagtctattcactacacatggatatgaaactctctgatgaattttgcattgttcagcataatatccttaatcattggcaattaaattatctgaggttatttttattattataggctttttaaaaaaatttttccacatctccaatttggatcctttgattaaccattcttcctccttttaacttgggtaattttcaaaatgtgtttttaattctttgcttattcgctaagaaaatgcctatttgagtttatttttaagaggctaaaatgtataagcaggatgattgcaaacaaaaatctggtatcacataatctatttatgctgactttttgcattttataaattaatgttaaataaatagaactggtaatatttgtttactcaaactcaaagagagatatccaggaaaactttcgtttacactggcttccagaagggaaaaataaaggtctatcagtgttctagcgaaggatgaagaagaaatttaaaacatcaacgcttgtaccttacaaaaaatagtttcatgtcttttcctcaatattacatttaaatttattaaaatcaacaaaatatttgatgagattgtctacttattttaaattcgtcttgaaatatatttgtaactgttatcagttgatttgctactcaaaatgaacactaggtggaaccacttcttttttttctattcagacacctcctgtgtgaatccgcccacagtacaaaatgcttatatagtgtcgagacagatgagtaaatatccatctggtgagagagtacgttatcaatgtaggagcccttatgaaatgtttggggatgaagaagtgatgtgtttaaatggaaactggacggaaccacctcaatgcaaaggtagagtattatatttcttttaacattttgggggagtatagcagggttaaaatatgttgatttaaacaaaatgaagtcatttttattaatagatttttcaaatgcaaataaaatgactgatggtgcttaaaattcaattcttcctgtgaacagaacacaagtaatagggtatattattttccagaaagattcgaccaaattgagagttggaacctgaaaaacaatactttttaagcattacaacacttagttccttctcaggaatacgtgtaataaaagatacattatgtgcatttgacagccataagtgatgtgcattctaagatatggaataggcagttgaagagagatcatagactgtgatataaatgtgggcatcttcagtatatggattatatttaaaggtgtgtgactgactgtatttataaaaagaagtccgagcacatagtcctgggtcattctaatataaagagatgaaataagggaaaccaaaaaaggaaattgtatcttactcacctttatgttttaaaattaatgtttttctgtattttttttttcactattttacttagactctacctatgtttattattgaagtgagtttttgtagacagcatatagttgggtcatgtttacatatccattcatcctttcatggcctgttaactggtgcacttggaccatttacacttaaaataattattgatatataggacttaaatctctgtcgtttatttgtttctgcctgtttcctctgggtttcagtcctatttccctattcctccattccctgtagggaaattattaaggagattaatttcgattcatatgtattgttttccattctatctctttgtatagcttttctcctccttttaaaaagttgttgctctagctaatactatatatgtaataatatattactgtctactggcactgacatttaaatctacaactggaatatggaaaccttactttcatgtagatccatttacactctccacgttgtaagtataaatgccactagtattttctctgcatacattgagctccatattaaactcacttgcttcaaatatcgaacataattgaaaaaacttatgaggaaaaagatatcctgttatattgactcctctgtttatccattctatttttctattttttcaggatcctaaagtctcaagctctttcttttatctgttttattttaatttgaagaattcctttagttaatctttaggcataggtctactggagacaaattcccttggtatccctttctctgagaatgtctgtattgatccccttacttgtaaaagatcgtgtcactggatatcaaatttggagttgacagttctttgaacacttgaaaaccgtgccacatggttatagatgaaaaactcagcatcatttgaattgttgatcccctcgaggaaaagcatagtttttgtctagttgctttcaaggtatttttttctttttttaaagtagttttattttaatgtatattggtataaattccaatgtttttatcctctttggagttcactcagcttcttaaatataagtttataccttatggtcaaaatgggaagttttcaggcatcattttatttattcatttttccagcccaatatcctttctcttctttttctgcatcggcattatttgttgttgtatttttctgaatgtctcagttcagttttttgttttcagtttattttcagagtgggtaatttatattgctgtatgttcaagttcatggatttatttgtctgtcagctccccatgtattattaagtatattcagtgtttttaaaaaatttttgtcatacttttccattttataattcctatgggatttttcgaatatgaaataagaaacttcctttgtcatagttttctatgtttagcatgtattcattcggaaagacatttcttaatcctggtctaccataagcagcaatatttgttaatgttttatgtgttctttcagtacggagaaaagaacttaaatatattactttcagtttaaagggttaaaatttcttccaggactcatttctttcaccagaaatcacaaaactgttgatattatatacagtgctgtgtttgcgtttgccttatttgaacttgtattttgatttgctctcacaacaaatcaagtgatgaaatgatgttttttagattctacaggaaaatgtgggccccctccacctattgacaatggggacattacttcattcccgttgtcagtatatgctccagcttcatcagttgagtaccaatgccagaacttgtatcaacttgagggtaacaagcgaataacatgtagaaatggacaatggtcagaaccaccaaaatgcttacgtaagtactttaatattcacgtggctggaaaaatctctgtgatgagtctgatatttcactgtttgtaacaaaatactcacagattattgaacaaccattctgctgaatgcttgcctaccaaatatttctgtcagaaagtaaagtttagaaatttttctctttagggctgggtgcggtggctcacacctgtaatcccagcactttgggaggctgaggcgggcagatcacgaggtcaggagattgaggaccatcctggctaacacggtgaaaccccgtctctactaaaaatacaaaataataataataaccggcatggtgacgggcacctgtagtcccagctagtcgggagtctgaggcaggaaaatggcgggaacccgggaggcggaggttgcagtgagccgagttcgcgccactgcactccagcctgggtgacaaagcgagactccgtctcaataaaaacaacaaaaaaagtaatttttctctttatatttatattttattttaaagcatttagttgacaaataaaaatatattttgatgtttgacaatatgttgttttgatatatttatgctacaaagattaccacaaattaattagcacattcttcatcacctatgcttagcattgggtgtaggtgggtgtgtgagtatgtgtgtgtgtgtttgtggtgaggacacttaaaatctgctttcttaccaattttcaaataaacaatacaatattattagctctaaatatcactagatctctatgtttgattccaagttcttattcatattatagctgaaagtttgtactctttgaccaatatcttaatcaaaagcagcaatgataagttctaaaacgcagggatcctaaaatgacaactgatgtaatgaatcattgataatacacccctaattctcatacattaaacatcgaacctcattttcacatcgattaccattctaagtttattcaaatcaatatgatgtttctacatagttggtttggatagtgttttgagaaataattcctgaaccatcatataacattctacttgaaaacctgaaagtctatgaagatttgcatactacttaatgttttatgtttactgttttttattttcagatccgtgtgtaatatcccgagaaattatggaaaattataacatagcattaaggtggacagccaaacagaagctttattcgagaacaggtgaatcagttgaatttgtgtgtaaacggggatatcgtctttcatcacgttctcacacattgcgaacaacatgttgggatgggaaactggagtatccaacttgtgcaaaaagatagaatcaatcataaagtgcacacctttattcagaactttagtattaaatcagttctcaatttcattttttatgtattgttttactcctttttattcatacgtaaaattttggattaatttgtgaaaatgtaattataagctgagaccggtggctctcttcttaaaagcaccatattaaatcctggaaaactaa

SEQ ID NO: 536 - DNA, 19275 bp, Homo sapiens
cacacttggtaactaataatgaaagatttcaaaccccaaacagtgcaactgaaacttttgtattagcatactactgagaatatctaacatgttgttactaatcaatgtcattctgaccttgtgggtttcctgtgctaatggacaaggtaagttaaaagagatctaaacactcagcttccctcttaaatgtaacttcatgtaatatctagctttgtatgtctataattattttatgaatcaaagaggatttattcactatgctagtagaagtgacatattttgtgagagtataacagaaattaattttataaaaaattatctcattttaacttaaagaaaaaatgaataatgttttatttgttttctaagttctacagtgtaaaaggcatttaatattgattatggagatatgtgaatatactcatgaaactttaagtaggaaacatgtcattagacagattctaagcttaaaatgttcagaattttcctatacgtaatacaaggggaacattgggagtgactgatgttttcataatcttacatatggtgatttttatagatttatatatcaaaaaatcaaataatacattttaaattatgcagtttcttatatttctattatagcttaagaaagctgctaaaactaattaacattaatatcaacttactacgtcaacaaaattagcaacatacatatataatgaaaaaatagaatataaacttacattggaaagatagtaagttttgattggcatttctgagttcactagcaaatgttcaataagtaaatatacagaaaatacttttcatagcgttatgtcattgttcactgatttctcctagatagtcatatattttctgtattaattatctttttgaatgcaggccttgcatattaaagaactatatggtaacattagcagtggaaccacatgggtcaaaaatcatggacaatcaagggtgtgtgtccattaatgaagaatacaaattttgtaattatccaaaacttcatatttcagccaatgtaatggagggtaatactggaaatcccattatcaatttatgagactatcttttccctcaaccactcttcgcgaagctatgccactttatttgattctagggaaagagctttaagttttatagtattatctatcacatgatttgctagttttatttgttgcgcaaaatcaaacttgatctgtgccaaaatggaaaaaaaaaggaatttcaccagttatttccttttttaactgaactgttacaggtacatttcttcaaataaagactaaatagattaaagtagaatgcaaagaagaaaatactactattttgaaatgactggaattagagaagcatatgcactatattttcttacttactttcttaaaagcactatagaaaagaatgatgacaaattctttcttatctgatattccagtggaaaacttgcctcctccaatgaactctttgtaagagtaaacttgagcaaaatgtcttgtaaatttgggttgcacctatatttctcaaaggagaaagtaactcatttagtggaataacatcttgggtagagagaaacatctttgtgaattcagtagcattggctcaactgcatcccgccaaaattcatttgttaaagtccaaattcccaatacctgagaatgtgactgcatttggagaaggagtgcttagcgatgtaattaagttaaaggtcaatgattcaggtgggtcctactccaatataactggtgtccatataagaagagaaaataagaacacaccgtatagggaaagatcacgcaaggcatagagagaaaacaaccatttacaaggcaaaggaggaggtctcagaagcatccaatcctgttgacagctatatctcaaactagtagcctccagaactgtgagaaaataaatttctatgaaatcagtagtactttgttatggtagctctagcagatgaatactatgatatttacacaatgtattaaaagaatattaataattaaaaataactttttactttttactcaaggatatatatatatatatacccaccaacacagattttagagggtattcatcagaattgggtaattatatcttgggtgtattgtccttgctgatttttgtcttgttgaatactttgtgtttacatattatctgtattcatctatattcagaatctagtaaatcgaatcagcaaatatttttcatatgattaatgaaggatatactttgtgagttgcttatgctaagaatttttttttaatggtggttgatgtttcagttctgaacaataaaatcagcacaccaattcttttggaagccacgctatttgaaagataaacttgacagaaaatttgtaattgcaacctattataatgttcattgaatttgtattgaccaatatttcttccatcaactcataagttatttacacttatttaaaaacaggttgtcaggaaaattatttttaatcatgaatatcctttcagaattgtataaactttatattcatctactagagttgccataacaaagtgtcaagggtgacaattagtaatgtagagtagggttgcctctaaattccttttaaactgatcattttcagtacccaatgcattacagttaattgccattgtacttctttgggacgctcaaatttatttcaagtttaactaagaagctggcttctgtgtatatttcacgtgtccccattacactttggcataacaaaaggtcccaggatttccttgacttttcctactacagaccaagttccaataatttccctatgaaattccagtgccttttagtgggagaaacgattttcagaaacaaacctaaactatgaaaaactcactacagtttcgaaattatcactgactaagaaaagtaatttttggtcgagccggggggctcctgccttaatcccagcactttcgggggccaaggcgcgcggatcacttgaggtcaggagttggagaccagcccggccaacatgatggaacgctgtctctactaacaattcaaaaaattagccggagtggcggcacacacctgcaatcccagctactcaggagactgaggcaggagaataacttgaacctgggaggcagaggttgcagtgagccgagatggtgccactgtactctagccttggtgacagaacaagactgttaaaaaaaaaaaaaaaaaaaagaaaagaaagaaaaattaaaatgatttcctttaatatatgtccctttcttcttcagactaaatagcctgcaatcataagaaaatgtaagagtatctcaggaggttacacagtgcagggagatttagattttccaatatggaggagacactcagcagaaaactgtgcatccatgcttgagggactgggtcagagaagctgtcatgcgtcacccaacaagcctctggagccagttctgtaactagcaaacacttcccacaaagtaaagatgtcacttctctgaacttagtcttctcatctgcacactaaagctgttgtgccgctagcctccttcccgttctctctgatttatgatgattcaaacttaaagatttttccttagtgatattcttaagttttcccaataaataggctgtaaatattattttctatcacttgttccagaattatagaagaaacataaattatatgctatttaaattatggtattggtcaacattctatatgtctacatacatatagaatgtaagaatatatatatatttgaacattcgtgtatgcacctatttttttatgtcaataatatatctcatccgatacatgaattctaactatggtaagaatgcatgccatcgaatacaaacaaaatgccacaaaactcaagaaaatgttttatttctggagataattggtacatttctgattttttttaatgtttagagtcatatttcttgtttctcttttccaaaaaacaattattggtaatgtgtgcaccctgaactgacagctttagcataacttggtatagttctagataagctcagttcaaattaatgttgataaaacctccagaattgctaaagagaccatactacattagtagaagtagagaaagtagaatgaggttcttcttgtcctgttagctgatttgggatccattaaggattttaagtgtagaaataaaatgaccagatgaagggttattaatttatacccaggaaaacagattatacagatgagaggtcaggatcaggaaactagttatggttgctgtaattccacaagaaaatgtttgagagaaggtgatatcaaaatttatctctaatatgatttattacagtaaaaattatttatacttttttgtttgttttttattgcaagtgaaaccttgtgattttccagacattaaacatggaggtctatttcatgagaatatgcgtagaccatactttccagtagctgtaggaaaatattactcctattactgtgatgaacattttgagactccttcaggaagttactgggattacattcattgcacacaaaatgggtggtcaccagcagtaccatgtctcagtaagtaatcctctgaactgctacacatgtataaaactttaaaagattaaagagaggagagcacataattgattactcttgtcttatgtaacagaaatagggccaagaaatgagttgttcaagcaaaatgaccaaaatagatcttttctattatgaggagttcttgaaaatcatatgaaaaataaatatagagactttatgagaatatctatatagtttatacatattttaattatgaaaactaaagagaagtaatattaaatattgacatttcctcttgtacaacctttgttagtaattttggttcatactaagttgtacattatttttggatgtttatgcgatcttatttaaatatggtaacaataattttaatatactttttgtgcaaatttatgtttctcatttactttatttatttatcattgctatgtccttaggaaaatgttattttccttatttggaaaatggatataatcaaaattatggaagaaagtttgtacagggtaactctacagaagttgcctgccatcctggctacggtcttccaaaagcgcagaccacagttacatgtacggagaaaggctggtctcctactcccagatgcatccgtgtcagtaagtacaccgctctgagatcccagcatgttcatgtctttctaagtaacacggacgacagtctcagacttgtctatattaactgtggcaaaatgtttttgtcaacttgttttgccaacggacctatttagttttacttttttaattgtgtgaatatacaaatttcttgataagtacatagcaaaataaatgctcctattaatgggcattagtcaagaatacagtaaaagaattagaacacaatacttgttggctaaataaagtcatattgaagcggcattaatgtctcgggtaaatacccgaggttcgtcatcttgcaccaagaagattaagtacaaatgggtattctgggatcttgtacatattctactctagaaggtttcctacagtatttattcaaatatacatttatataaacagttccttcttttttcacatgttgctaatgattggtgatgtcacattttaatatttacaagttgagtggctataaaatggtatagcattgtaatgtaaatttgcatttcttttactaccagctggatttagaatacatgttcacagtttaattggtatttaatgattctaaaatttggaaatgcagtttgatttcttttatttatctttttgggagttttggttgttattagttggaatcatcttaataattctgaaggtaaaatctcttttaattatatgtaatgcaaatgcattctctttgtggctagtattgttctttccttttttctgcattatgaacaagttgctcattttactaaataattgtcaatcttttttcatgatgaatgttttttggttctttttttatattttattattattatattttaagttttagggtacatgtgcacaatgtgcaggttagttacatatgtatacatgtgccatgctggtgtgctgcacccattaactcatcatttagcattaggtatatctcctaatactatccctcccccctccccccaccccacaacagtccccagagtgtgatgttccccttcctgtgtccatgtgttctcgttgttcagttcccacctatgagtgagaacacgtggtgtttggtgttttgtccttgtgatagtttactgagaatggtgatttccagtttcatccatgtccctacaaagaacatgaactcatcattttttatggctgcatagaattccatggtgtatatgtgccacattttcttaatccagtctatcattgttggacatttgggttggttccaagtctttgctattgtgaataatgccgcaataagcatacgtgtgcatgtgtctttatagcagcatgatttatagtcctttgggtatatacccattaatgggatggctgggtcaaatggtatttctagttctagatccctgaggaatcaccacactgtcttccacaatggttgaactagtttacagtcccaccaatggtgtaaaagtgttcctatttcttcacatcctctccagcacctgttgtttcctgactttttaatgattgccattctaactggtgtgagatggtatctcattgtggttttgatttgcatttctctgatggccagtgatggtgagcattttttcatgtgttttttggctgcgtaaatgtcttcttttgagaagcatctgttcatgtcctttgcccactttttgatggggttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcggaagctctttagtttaattagatcccatttgtcaattttggcttttgttgccattgcttttggtgttttagacatgaagtccttgcccatgcctatgtcctgaatggtaatgcctaggttttcttttagggtttttatggtgttaggtctatcatttaagtctttaatccatcttgaattaatttttgtataaggtgtaaggaagggatccagtttcagctttctacatatggctagcctgttttcccagcaacatttattaaatagggaatcctttccccattacttgtttttctcaggtttgtcaaagatcagatagttgtagatatgcagcgttatttctgagggctctgttctgttccattgatctatatctctgttttggtagcagtaccatgctgttttggttactgtagccttgtagtatagtttgaagtcacgtagtgtgatgcctccagctttgttcttttggcttaggattgacttggtgatgcgggctcttttttggttccatatgaactttaaagtacttttttccactttggtgaagaaagtcattggtagcttgatggggatggcattgaatctataaattaccttgggcagtatggccattttcatgatattgattcctcctacccatgagcatggaatgttcttccatttgtttgtatcctcttttatttccttgagcagtggtttgtggttctccttgaagaggtccttcgcgtcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgctaatcagctttaggagattttgggctgagacaatggggttttctagatatacaatcatgtcacctgcaaacaaggacaatttgacttcctcttttcctaattgaataccctttatttctttctcctgaaggagatccctggccagaacttccaacactatgttgaataggagtggtgagagagggcatccctgtcttgtgctgattttcaaaggaatgcttccagtttttgcccattcagtatgatattggctgtgggtttgtcatagatagttcttgttattttgagatatgtcccatcaatatctaatttattgagagtttttagcatgaagcgttgttgaattttgtcaaaggccttttctgcatctattgagataatcatgtggtttttgtctttggttctgtctatatgctggattacatttattgatttgcgtatattgaactagccttgcatccccgggatgaagaccacttgatcatggtggataagctttttgatgtgctgttggattcggtttgccagtattttattgaggatttttgtatcaatattaatcaaggatattggtctaaaattatcttttttggttgtgtctctgcctggctttggtatcaggatgatgctggcctcataaaatgagttagggaggattccctctttttctattgattggaatagtttcagaaggaatggtaccagttgctccttgtacctctggtagaattcggctgtgaatccatctggtcctggactctttttggttggtaagctattgattattgccacaatttcagagcctgttattggtctattcagagattcaacttcttcctggtttagtcttgggagagtgtatgtgtcaaggaatttatccatttcttctagattttctagtttatttgcgcagaggtgtttgtagtattctctgatggtagtttgtatttctgtgggattggtggtgatatcccctttatcattttttattgtgtctatttgattcatctctctttttttctttattactcttgctagcagtctatcgattttgttgatcctttcaaaaaaccagctcctggattcattaattttttgacaggctttttgtgcctctatttccttcagttctcctctgattttagttatttcttgccttctgctagctttgaatgtgtttgctcttgcttttctagttcttttaattgtgatgttagggtgtcaattttggatctttcctgctttctcttgtgggcatttagtgctataaatttccctctacacactgctttgaatgtgtcccatagattctggtatgttgtgtctttgttctcgttggtttcaaagaacatctttatttctgccttcatttctttatgtacccagtagtcattcaggagcagtttgttcagtttccatgtagttgagcagttttgagtgagtttcttaatcctgagttctagtttgattgcactgtggtctgagagacagtttgttataatttctgttcttttacatttgctgaggagagctttacttccaactatgtggtcaattttggaattggtgtggtgtggtgctgaaaaaaatgtatattctgtcgatttggggtggagagttctgtaaatgtctattaggtccgcttggtgcagagctgagttcaattcctgggtatccttgttgactttccatctcgttgatctgtctaatgttgacagtggtgtgttaaagtctcccattattattgtgtgggagtctaagtctctttgtaggtcactccagacttgctttatgaatctgggtgctcctgtattgggtgcatatatatctaggatagttagctcttcttgttgaattgatccctttaccattatgtaatggccttctttgtctcttttgatctttgttggtttaaagtttgtttcatcagagactaggattgcaacccctgcctttttttgttttccatttgcttggtagatcttcctccatccttttattttgagcctatgtgtgtctctgcacatgagatgggtttcctgaatacagcacactgatgggtcttgactctttatccaatttgccagtctgtgtcttttaattggagcatttagtccatttacatttaaagttaatattgttaaatgtgaatttgatcctgtcattatgatgttagctggttattttgcttgttagttgatgcagtttcttcctagtctcgatggtctttacattttggcatgattttgcagtggctggtaccagttgttcctttccatgtttagtgcttccttcaggagctcttttagggcaggcctggtggtgacaaaatctctcagcatttgcttatctgtaaaggattttatttctccttcacttatgaagcttagtttggctggatatgaaattctgggttgaaaattcttctctttaagaatgttgaatattggcccccactctcttctggcttgtagagtttctgctgagagatctgctattagtctgatgggcttccctttgtgggtaacccgacctttctctctggctgcccttaacattttttccttcatttcaactttggtgaatctgacaattatgtgtcttggagttgctcttctctaggagtatctttgtggcgttctctgtatttcctgaatctgaatgttggcctgccttgctagattggggaagttctcctggataatatcctgcagagtgttttccaacttggttccattctccccgtcactttcaggtacaccaatcagatgtagatttggtcttttcacatagtcccatatttcttggaggttttgttcatttctttttggtcttttttctctaaacttcccttctcgcttcatttcattcatttcatcttccatcactgataccctttcttccagatgatcacatcggctcctgaggcttctgtattcttcacgtagttctcgagccttggctttcagctccaccagctcctttaagcacttctctgtattggttattctacttatacatttgtctaaatttttttcaaatttttaacttctttgcctttggtttgaatttcctcctgtagcttggagtagtttgattgtctgaagccttcttttctcaactcgtcaaagtcattctccgtccagctttgttccgttgctggtgaggaactttgttcctttggaggaggagaggtgctctgcttttagagtttccagtttttctgctctgttttttccccatctttgtggttttatctacttttggtctttgatgatggtgatgtacagatgggtttttggtgtggatgtcctttctgtttgttagttttccttctaacagacaggaccctcagctgcaggtctgttggagtttgctagaggtccactctagaccctgtttgcctgggtatctgcagcagtggctgcagaacagcggattttcatgaaccgcgaatgctgctgtatgatggttcctctggaagttttgtctcagaggagtacccggccgtgtgaggtgtcagtctgcccctactgggtggtgcctcccagttaggctgctcgggggttggggtcagcgaccaacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcctggctgctttgtttacctaagcaagcctgggcaatggcaggcccccctcccccagcctcgctgccgccttgcagtttgatctcagactgctatgctagcaatcagagagactccgtgggcataggaccctctgagccaggtgagcgatataatctcctggtgtgccgttttttaagcccgtgggaaaagcgcagtattagggtgggagtgacccgattttccaggtgccgtgtgtcacccctttctttgactaggaaagggaactccctgaccccttgtgcctcccaagtgaggcaatgccttcccctgctttggctcacgcacggtgcgctgcacccattgtcctgcacccactgtctggcactccctagtgagatgaacccagaacctcagatggaaatgcagaaatcacccgtcttctgcgtcgctcacgctgggagctgtagaccagagctgttccgatttggccatcttggctgccctctatgatatctattttttagttagtgctctgttgctttaaattaaggctcatcttcagttacagctgacttttactttttaagtaaaggggactctgaaaattgtttgtgtgtattgtttgcaatttacaaaacattccattatagaaaccgcataataattatggaataattgagacgaaagataatgggaatcttcctacaccattataggagcaactgtcctcaacaatagcctaagcccctgaaagaaaagtccctttttctcctgccataagcaccaactctatcattaatccacctaataaatattgttgtgtgtcaagcactttgtaggtattgaaaataaagctgtttacaatagaaactgaacattgtagtttagaggctggaggagattaataggaaagtaggcaagaatagatcagaaaactcatgattatgacaaatgctatattataaatatgcatcatctttaacatgatttctttttctttcagatagtaaaattggtccatttacatttgtttttgaattactaattagaaaagaacatatacattactaatatcttaaaacatatgcgttactaaaataattactaccttgtacatatacccattagtaatgtatagaacacatacattactaatatataaagaacaaatacattgctaatatattagaacttatttttgctatcttgcttgctttcttttttctgcttacatttccacatgcctctcaaacaccacgtctatatgggtttaagcacccacttaagatgacaaccattttaaattcttggagacaaaggatttacaaaattactttcttgcctatggtagcagggtgtaccgtatctttgcctgggaaatggcatttgacttaatgaggtttaagaccccttaatagtaccaaaaatactcaggttgttgcaaagtagccagaaagtcttccaaaatttcattagggactggagagtctcctagatctgcactcctcaaggactgccagagctctgttgacagtctcaaggattctttgctttcattctgcccttccctgtgttcaacatttccttcagaaattcgtggtttcctttaagaacacggatgtctaggaaacttccagttttgctgttttcaattcattaacaaatgtttcattgtttcgccatattgccatgtttttacttgttccctcctataaaagaactattcaactaatatttacttttttcttgactttttctattttaggaacatgctcaaaatcagatatagaaattgaaaatggattcatttccgaatcttcctctatttatattttaaataaagaaatacaatataaatgtaaaccaggatatgcaacagcagatggaaattcttcaggatcaattacatgtttgcaaaatggatggtcagcacaaccaatttgcattagtaagtgatttacatattcccattcagtttctgtcaacttcgttcctctctttgagatgatagtgttttacttaaaaatatagaaaacaattttaggagtaaagagatacaaatacttctaaaaccattcaacattctgtgccaaattaagtcttttgcatgtttagagtaatggctacttgggaagatgatcatttcatctcttacaactcaatctgcctttacataaaagcaatcttatcatgtacagactagttagggagctgcatgagagtatcagcaaaatatgttagttgccaataaaaactttgttgtcttccctttctttgtatttcaaaattatcagctgcttgtattgcattccgtgctcacgctcagaaaagttgtacatgtcgggggagaaatgagtgcttaattctgaatttctgctagcgtcaggagaatcagaccttaataatttgtatcaatgatgctactgaggatatccaatcaaaaaattatctctaccctattgtttactacagagaaaacaagtaaaggaaaagggtaagtgggtgggctgaatgtttacaaacctcatacttgccaatggattctttacatgtaaagttctctgaacgtgctcgacctttacttagtatgataaagagaatgcataatgaacaaaggaaatctttcagtggcaaaagttgattttttttctttcctctttatatattcacaaagagttttaaagataaattgctgaatgtatttttaacccaaatactgttgtataatttacatactcccaaatccacttcattttcaagggtacaattcaactatttttagtcatgagataatatggaaccttgatacataatacaacatggaagactctcaaaaatattaagctaagagagaaaaaagatacacttacaaagtgattatctcaatgttatcatgagttttgggggttatatgaattcctacatttctagaatactgttttcaatttctatacttatcaagggctctgtgtaaagaaaaaggtgtatacttcaattttactcagctttgataaatgatctactttaaaacttgtgaaataaaagacaggatgcttcataaattttatagaacttatatccaattaatataatttttatctaatatatacacccttactgttagtaaatcgttacataactacataaatggttacattaacttttaaattcacaaatttaaaagcggtttaagctccgtgacacattggactacgaatgctacgatggatatgaaatcagttatggaaacaccacaggttccatagtgtgtggtgaagatgggtagtcccatttcccaacatgttatagtaagtattttattcaagtattttttattagaattaaataaaataataaatagacacctacatatgtatatgtacacatatgtgtgtacatatatgtacatatatatgtagtcctcctatgagtgtgaattatcttgagacttaaaaagaaaaaacaacgttgaaaatgcagatgtcttcctaagaaatcaaataagatacagttaagagtatataaaaagctttatttagaaagtttccaataagactattgatttttccccacatataaagtattttttttcagattcttcagaaaagtgtgggcctcctccacctattagcaatggtgataccacctcctttctactaaaagtgtatgtgccacagtcaagagtcgagtaccaatgccagccctactatgaacttcagggttctaattatgtaacatgtagtaatggagagtggtcggaaccaccaagatgcatacgtaagttcttaaaattctagatcctgagaaaatcagagtaataagtttgatatttgcttttttatactagaatttttatgggttattaccctagaactgtgttcacaaacagctattctgctgaatgtttgcctttcagatcttaatatataagtgtataagcttggaaaattccatgtaaacaatgaccaagtttcttttttaaaacaggaatgtcggcctggggtggtggctcacgcctgtagtcccagcactttggaaggccgaggcaggcagaccatgaggtcaggagttcgagatcagcctgaccaacatggtgaaccccgtatctacaaaaaatacaaaaattagccaggcatgctggcatatgcctgtaatcccagctactcaggagggtgaggcaggagaatcatttgaacccgggaggcagaggttgcagtgagtggagattgcaccattgccctccagcctgggcgacagagggagaccccatctccaaaaataaaaaaataataaataaataaataaataaataaataaataaataaataaataaaacagaagaagaagaaaagaaaaagagaaaaagaaaaaaccaagaatgttcagagtcttcaatttgttaatggatacaatgagtcttcaagaatgacaaccatttattgcgcacatatgaaatatggcatctcagcttaacaccagtaatcattttcacattattaacacttaggtaaagagttttcaaacagttctgaaaacattgtttcaaaaaaccacaaactattaaaccctacttgaacacatgaaatttttcctgatagaacacatagctggttaacactgagaagttctttctctgattattattcttacttatattttatcagtattcctagcaagcaacaaagaaattaacgaaacttcagccatttccataacccattgcttttccatttttaccttattctcctcttcccttataccagaatcaaaatgaatacactaaaaacccctcaagccagtaatataggtatacttccagaattttgtcccccaagtactatgaacttgaagcaacacaactcaaaaaatataagccacaatgattatggcaacaacaagaaaacctaaaagaaaatttgccacaagtttctactagcctatgaggtagagccctgggacacccatcagtccttgaatgtcagataacctattcctatcacagctcttaaactgtaagttcatgagtttttcaagtgctcaagttcctaagtacaggatgatacaagcagttgttttctgtgatgtgactcatttcctttattttgatgctatgctaccttttacctttcatattgactgatgacgctgatattttggctgatcttacaatgggctaaaccttaattattgtcccctacttaagtatccacttctgtagatgatcatgtccaagtttgagctccaaactatgcaagtggtaagactgaagaagaaattagtatcctcaaatcaaaatagtttacaagtatcttcaaacttgatttcatagaaaagtgttaggtttcagagataaattctgagtcttaaatttgattgactgaggagatggacactcctaagatgggtttcacagcaaaagcattacctcttctcacaatcaagaacaggaaaggattataattatctgaagatataagatcagttctatgatacaagcaagactttcagtcttcaaaactaaagaagcaaagagcattcaagcacagaattctagggaaaaaggcaaccttatggaaaagattacatatacatatggcatattaaagcaatgaggaaaattttcccaggcagcaggaaactttagaaagttttggaaaatatgtttggagaagtatttagagttcaaacaatatttatttttgaattgtaaacagcccctgaatgtattgaagagctcttaaaattttttggatttcaaaagtgatatgtactatgttaagaaatttatttaagtaagtacttgaaagatgtattaaaatatgattggggaaatttctaaagaaatgctaatgctaataagggctaaactagaatgcagaatacttgagtcaaaagaagagataggtgagtgaatgatatcatcaaaagtgaaaagcttgctatgtaagaactgacatttttatcatgtaagtactaggcttaatacctggggtatgggttgataggtacagcaaaccaccatggcacacatttacctatggaacaaacctgcacatcctgcacatgtaccctggaacttaaaaaaaaaattataaatttttttacaaaagaattttataaaagaaaatccatatgtggaagtaacattatcttactgattttacagatgaaggcatagtgagacagagtaatttgtccataatcatgtagggattcatattaactctgtgtgcttatccttgcctctctttaaaatagaaaatgaagatgacagggatagatgatgttgatagagagagagataactgatagatattgaggtatatttatgtatgtatgtatgtatgtatatatagtttcattttaacagatgactattagaaagattatacctttctacagttctgtttctacattgtgggcataagagaaaaatataaacatagaattaaattagcaaaatgtgagtacatttggagtgcttgtagtcacggcttgtcgaatgggggaaaggaggataagtaaccatgactccaatggaacatgttagcataatcctttttgatatgaagtcactagggtggacacaacatattttaggaaagaagagttcaggctctagagaaagactgccagggttcacgtttatcacctcacctgatgatctctgctgtgatgttggggaagtgcaactgaacttattatatttttgaaatgctaacgtcagtatgtagcacaagttaataactattaactatttggattattttataattttattttatcctaaactactcattaggatgcattttatttgctcatgaaagagaaaattatgattgttaattgtttttttctgctttcagatccatgtataataactgaagaaaacatgaataaaaataacataaagttaaaaggaagaagtgacagaaaatattatgcaaaaacaggggataccattgaatttatgtgtaaattgggatataatgcaaatacatcaattctatcatttcaagcagtgtgtcgggaagggatagtggaataccccagatgcgaataaggcagcattgttaccctaaatgtatgtccaacttccacttttccacttctcactcttatggtctcaaagcttgcaaagatagcttctgatattgttgtaatttctactttatttcaaagaaaattaatataatagtttcaatttgcaacttaatatattctcaaaaatatattaaaacaaactaaattattgcttatgcttgtactaaaataataaaaactactcttatattggacttcttatcaatgaattagtaagtatagagacagacagctgaatggctttctgcatattgtatagtatacctagacatagaaacaaaatgactttagattttatttggggaagtaataataccataaaattagatattaaaattgtaagtgaagataaacacactatagtattcccttattgtagccatggtcctctagatgcagttaaccaaatagggtcatttttattaaaagtagtgtttcctggcaaacactgacattacatcattatcatgatttaaaggaaatagtactagagaaggtgaattattatcattttcctgt

SEQ ID NO: 537 - DNA, 19275 bp, Homo sapiens; identical to SEQ ID NO: 536

SEQ ID NO: 538 - DNA, 12460 bp, Homo sapiens
ccagttagtacactgaaattcaaagtcatgctcataactgttaatgaaagcagattcaaagcaacaccaccaccactgaagtatttttagttatataagattggaactaccaagcatgtggctcctggtcagtgtaattctaatctcacggatatcctctgttgggggagaaggtaagttcaaaacagacctgaatatttagttcctttttcagatacatttatcggtttttgtgtgtatgcttacatatttttaaatgaataaatggatgaaaatattttaaatgagttataatattaatctattttatggaaatactttctaacatgcaattagcaggaaaatagaataaaattagttctctccatcctctaagttgcaaaggtaaatggccaccaaatagagaatgtaaagaggaattaaatgagggaaaacctgctatactaacggtggcaaggtgaagtattagtgtaattctgcatacactctgcaatgccactaactagaacaatcaatctcaaaaagatttggccaccttcaaaatgctttttggattttagtttcctagatttgatcatttaaattttaaaggtcattaaaatggaggaattcccatttcaattgaattatccttcaacagagggaaatatattttactgaaacaatagaaaatatcatttatatataaaccagtgaactgtcaagaaattgcttcttctgagctcttaaatgttgagaatgaagtaatgtatcacctctttattaatactacaaactgcttcttatgatattttataaacggtcccattttatttcatgttgaaattaaggccaccatatcaaaggaattgcaaacaaaatctctaccaaggtctaggatactaattaaactatgtctgtacatggagtttcgatcattatgctttaccctttgatttccaaaaagtttttactttactgtttggctgtttcctaatgtttccagacctttgaacttttatttgaacagtttctcatcagtcctgacataacagaacaacatgaacaataacatgctttcctttaaatatttgcccttagaaatgttgcaaaatattatttctattgcttgaaattcatttttttttgagatggactttcactcttgtttcccaggctggagtgcaatggtgtgatttcggctcaccacaacttccatctcctgggttcaagcaattctcctgcgtcagcctcccaagtggctaggattacaggcatgcaccacgacgcctggctaattttgtatttttagtagagatggggtttctccatgttggtcaggctggtctcgaactcccgacctcaggtgatctgcccgcctcggcctcccacagtgttgggattgcaggcataagccaccacgcctggcccttgaaattcgttttattttgttttcacttttagtgctgagttgtaatcacaggagtgtgattgtatgagtgtatttgatttttcttaagtctgtgtttatggtatttattaagtggcttatacacctattacacatggcattacatgaggatttctaaataggggggtagcagaggaaaataagtgaaaaatatgagagaaatatgtagaattttgacaattcctaaccctcctcccaccaaaaaaaagttcaagcttcaatccagtctctgggagaaacttcagtgaaattctatctaaaggttgcctagatgttaaatgatctgtaagtgtgtgttacactgtcatttaggtgtctactgagagacctgccaaacagcaaaaacaacacactgaagcaacacatttgtatacatagaaagctgcatgcttccagtagcaaaatatttatcaagcactatgttgtgcttcatgtagcaaagaagctggaagaaaatgacaaccctaaccacacctcactgcaacttacagtgtcctaaagaaaagcaaaatgtaaataggcaaataaattgcaaggctatatataggtgactgtgagtgagtgtgtgtgtgtgtgtgtgtgtgtgtgtataaacagtcatgcatcacttaatgatagggacactttctgagaagtgcgtccttaggcgatttccttcttattcaaacattatagagtggacttacacaaacctaggttttatagcctactaggtaactaggccatatggtatagcctgtcgctcctaggctgcaaacctgtacagcatgttactgtactgaatactgtgggcaactgtagcacaattgtaagtatatgtttatctcaatatagaaaagtacaataaaaatacagtataaaatattaaaaacggcagacttgtatagggcttttaccatgaatagggtgtgcaggactgaaagttactctcagtaagtcattacatgagtggtgagtgaatgtgatggcttagaacatcaccatacactactagaggtggtataaacactgtatacttaggctaaactaatttattttatttatttatttacttgaatagttttgggggagcaggtggtttttggttacatggataagttcttcagtgctaattactgagcttttgatgcacccaggatagactaaatttattttaaacttttcttcgataataaattaaccttagtttatgttaacctttttacttcatcaactttaatttttgtgtctttcgagataatatttagcttaaaaaacattgtagagatgtacaaaagattttttctttctgttcttgtgctataagcttttatcttttaaatattttacttatttatttactttttaaacctttttgttaaaaacagacacaaacacacacattaacctcggcctacaaagagtcaggatcatcagtatcactgtcttcttcccccgctcttgtcccactggaaggtcttcacggcagtaacaggcatggagctgtcctctcctatgataacaaaggtttcttctagaatagttcctgaaggacctgcctcaggaaacattaactgttttacagttaatttttttaatcaatagaagaagttaactataaaatactaataacaattatactatatgaaatacattaaccagtaacacttctatattatcatcatcaagtattacgtactgtacaaaattgtgtgtggcatatttttatgtgactggcaatgctgtaggtttgtttacccccggcattgccacaaatatgtgagtaatatattgcactgcaatgttacgatggctattaggtgataggaatttttcagctacactataatcttatgggtccactgtcatataagtgatcagtcattgaccaaaatgtcattatgtggtgaataactgtacgactgtatatatatatatatatatgtgtgtgtgtgtgtgtgtgtgtgtgtgtgtgtatcccagaagaaatgtattcacaatattctatcaaaatattgagacaataaaaattattttctacttttgaaattggtggttgtgtaaaggaggcttgcaagaagacattaacactcctagctagcaccattgcagatatgcacaatgaatacttgatgaatgtcatagaattctttctgaagcataggtacaatataaatggttgatgaaaaccaagttattctggatagcaaagaatatgtaggtacaaatgtatgaaaataaactactataattttggaggagtgaaggataattgaaagagttatggtaggttaatactatcaagacgggagtctttccctcaacacctttaccaaaactatctaatgtcaaattttaaacagttagataatcaatttcaggtttcacaaggtgaaaatatttcaaatattgtgcaacattaaacattacttctagatagatgaaaaagagaaatttctcttgatttgtcagcttaatttctgcacacatctttcaaataaggtgaaaaataaaattatttcttatgcagcagtactatattgcaaaaatatcttgacataaaaacaaagagcagtattatattgaggaaatatcttgagctaaatacgtactcaaagataaagcatatcaaacccatagaacgtacaacatcaagagtgaaccccaacataaactatgaactttgggtggtaattatattgacagtgagggagcttatgcatgtggtagggaagaggaagtggtatataggaaatctctaccttccactcaatcttgctgtgaaaaacctgtaaataaagtataaagtctaataaaaaatatgtgtgtatatatatgtatgtgtacacaaaaaaagagtaaaaagtatgaagatttcacccattttctacattgttttaatatatcttgcaccatagtgtgtatggatgtatttatacatatatacagtagtcctttagcatcctcaaggaattggttccaggacgctacccacccccagcagataccaaaatccaaggatactcaagtgtctaagagagaatggtgtagtatttgtacataacctgtgcatatcctcccatacaatttattttattttattttaattttttttgaggtggagtcttgctctgtcgcccccaggctcgagtttagtggcatgatctccgctcactgcaacctccccctcctgggttcaagtgattcttctgcctcagcctcccaggtagctgggatcacaggcgtgcaccaccacacctggctaatttttgtatttttagtagagatggggtttcaccatgttggccaggctggtctcaaattcctgacctcaagtgacccactcacctcagcctcccaaagtgctgggattacaggcatgagctaccacactcagccctctcatacaatttaaggaatctctagagtatttataatacctaatacaatgtaaatgctgtaaaaatagttgttatattgtatctttaattgcattatttttattgttttattatctttattgtttttttcaaatatttttgatctgcagttggttgaatcagacgaagtgaaacgagtggggctgactgtatatatatatatatatatatatatatatatatgtgcgtgtgtgtgtgtgttcacaagtataaatatataaatacaaatatacaaatacatatttgtatatacaacattaaccagaatttagctctaactttatcttgattgagttgttcttagtgattttcttatattccctaaattatttccactgaaactatattaactttgtaaccagaaaatattcaaaatgatattaataaacaaaaaacaaaactacatatccaacatctttactgcaccagaaaaaaaaataggacagagtttctggcagagacacctatggcagtcaatgagaatagagaaaataagtaaattgagagctaagaacaaccctatcacttttctactgtatactatgtagatcaggaagatttgctactcttacactctgtcttcattcttaaattgttgtgtgtgggttttattcttgaagacaatgcaggagagttcatatttcatatcactccaaaatataaattttatattcattaacaattacctcctcaaatagtcatgtactcctagttagtgatgcttttcattcctaatttgtacactggaaagcatttaagctaaaggcatttaagctaaatgaaagaaaaacactataagtgagatgattaaaatataatctagtgatttatttatgtaacttattatgtaattcttcagttttatgttattttcccagcaacattttgtgattttccaaaaataaaccatggaattctatatgatgaagaaaaatataagccattttcccaggttcctacaggggaagttttctattactcctgtgaatataattttgtgtctccttcaaaatcattttggactcgcataacatgcacagaagaaggatggtcaccaacaccaaagtgtctcagtgagtaaatgctctgttcattaaatggatgtcattcagtgaatagagaaggatatgccagacaagatcataaggtcttgataatcacagggacagtgaccaaagaagctggaaagatgggagatgtagtccccctattttgagatgcctcctataagaatcaatgaagaataaatatgtcaactgtcttgtgttacctggaaatgctctacgtgttgaaatatattaatttttttaaactgatctttaatatatttgactgctaatatttctttactaatattcatttcgcagcagcctgatcaaagttttccttttaaatgtcatttttatacatattctgttttgaatttaccattctttagcatattgaaaggaggtttagcattttcacttttatatttcaataaataatttctttggtccttcacagtgtagctatattaattctccaataaatgtagagagcagactccaatgataacaggtgtattaaaagaaaaaaaaattgggagacagatacatgaggcaacaaaggagatagcaatgatctttctcctaagaaacatttatgagagttaagagagaaatagatatatgaagaggttcttttgtccctaaaaggttgacaaacataaaatatttcattataaaaaccatagagcaagaaaatgaaatattttcttctatatatacatataaaagaaccaaaaatatgtttcatcatatatatagtagcatgagttaacttcttttgaaagtgtttatatttgatttcagctttgaaagctttcctttttaattttttttgttcgtttgtttgttttgttttgtttttgagccatctcaactcactgctacctctgccttctagattcaagtgattctcctgtctcagcctccagagtagctggaattataagtgcgcaccactatgcccgctaatttttgtatttttactagaaacagggtttcaccatgttggccaggcaggtctcgaactcctggcctcaagtgatccactcgcctcagcctcccaaagcgcagagattaccagagtgagccacttcacccggtttattaaaatattttaaaatgcagttgtactttttctttgctacttccatcttgtacattaatccgtttttggtccttaggactgtgtttctttccttttgtggaaaatggtcattctgaatcttcaggacaaacacatctggaaggtgatactgtgcaaattatttgcaacacaggatacagacttcaaaacaatgagaacaacatttcatgtgtagaacggggctggtccacccctcccaaatgcaggtccactggtaagtacaatgctgttctctcatatgctgttatctattataaagtttgagagaaataaatcttttttacaggttaaatataggttttgccacatacttttatctttattcatttgattttcagttccaattgtgtccaagtggatgttgaataacatagtttgcctacctatataaatcaaatgttctcaaagtgtggtcgctaaaccggtagcatcatcatctccttggagattgtttgaaatgaaaatacaattccataagctcattctagacacacggaatcaaaaatgtcgaaatagaaccctgaatctgttttaccaacccctccagggaattctatgcacacttctgtgtgagaagcattgctatagtctattatcactacacatggacctgaaactctctgatgaattttgcattgttcagcatagtatccttaatcattggcaattaaattatctgaagttatttttattattatagacttattttcttttatttttccacatctccaatttagatcctttgattaaccattcttcttctctactaacttgggtaattttcaaaatgtgtttttaaatctttgcttattcactaagaaaatgcctatttgtgtttatttttaagaggctaaaatgtataagcaggatgattgcaaacaaaaatctggtatcacataatctatttatgctgactttttgcattttataaattaatgttaaataaatagaactggtaatatttgtttactcaaactcaaagagagatatccaggaaaactttcgtttacactggcttccagaagggaaaaataaaggtctatcagtgttctagcgaaggatgaagaagaaatttaaaacatcaaagcttgtacctgacaaaaaatagtttcatgtcttttcttcaatattacatttaaatttattaaaatcaacaaaatatttgatgagattgtctacttattttaaattcgtcttgaaacatatttgtaactgtattagttgatttgctactcaaaatgaacactaggtggaaccacttcttttttttctactcagacacttcctgtgtgaatccgcccacagtacaaaatgctcatatactgtcgagacagatgagtaaatatccatctggtgagagagtacgttatgaatgtaggagcccttatgaaatgtttggggatgaagaagtgatgtgtttaaatggaaactggacagaaccacctcaatgcaaaggtagagtattatatttcttttaacattttgggggagtatagcagggttaaaatatgttgatttaaacaaaatgaagtcatttttattaatagatttttcaaatgcaaataaaatgattgatggtgcttaaaattcaattcttcctgtgaacagaacacaagtaatagggtgtattatttttgagaaagattcgaccaaattaaaagagttggaacctgaaaaacaatactttttaagcatcacaacacttagttccttctcaggaatacgtgtaataaaagatacattatgtgcatttgacagccataagtgatgtgcattctaagatatggaataggcagttgaagagagatcatagactgtgatataaatgtgggcatcttcagtatatggattatatttaaaggtgtgtgactgactgtatttataaaaagaagtccgagcacatagtcctgggtcattctaataaatagagatggagtaagggaaaccagaaaaggaaattgtatcttacttacctttatgttttaaaattaatgttgtcctgtgtttttttttttttttcactattttacttagactctacctatgtttattattgaagtgagtttttgtagacagcatatagttgggtcatgtttacatatccattcatcctttcatggcctgttaactggtgcacttggaccaattacacttaacataattattgatatataggacttaaacctctgtcatttatttgtttctgtctgttccctctgggtttcagtcctatttccctattcctccattccctgtagggaaaattattaaggagattaattttgattcatatgtattgttttccattgtatctctttgcatagcttttcttctccttttaaaaagttgttgctctagctaatactatatatatgtaataatatattactgtctactggcactgacatttaaatcaacaactggaatatggaaagcttactttcatgtagatccatttatactctccacattgtaagtataaatgccagtcgtattttctctgcatgcattgagcaccatattaaactcatttgcttcaaatatcaaacataattgaaaaaacttatgaggaaaaagatatcgtgttatattgactcctctttttatccattatatcgttctattttttcaggatcctgaagtctcaagctctttcttttatctgttttattttaatttgaagaattcctttagttatctttaggcataggtctactggagacaaattctcttggtttccctttctctgagaatgtctatatttacccctttacttgtaaaagatcgtgtcactggatatcaaatttggagttgacagttctttgaacacttgaaaactgtgccacatggttatagatgaaaaacttaccatcatttgaattgttgatcccctcaaggaaaagcatagtttttgtctagttgctttcaaggtatttttttctttttttaaagtagttttattttaatgtatattggtataaattccaatgtttttatcctctttggagttcactcagcttcttaaatataagtttatgccttattgtcaaaatgggaagttttcaggtatccttttatttattcatttttccagcccaatatcctttctcttctttttctgcatctgcattatttgttgttgtatttttctgaatgtctcagttcagttttttgttttcagtctattttcagagtgggtaatttatattgctgtatgttcaagttcatggatttatttgtctgtcagctccccatgtattattaagtatattcagtgtttttaaaaaatttttatcatacttttccattttataattcctacgggatttttaagaaccatcatcaatttcaaaacccgtgtcctcttagtgttactccaaagaatgttgaatatgaaataagaaactttctttgtcatagttttctatgtttagcatgtattcattcggaaagatatttcttaatcctgatctaccataagcagcaatatttgttaatgttttatgtgttccttcagtaaggagaaaagaacttaaatatattactttcagtttaaaggattaaaatttcttccaggactcatttcttttaccagaaatcacaaaactgttgatattatataaagtgctgtgtttgtatttgccttatttgaacttgtattttgatttgctctcacaataaatcaagtgatgaaatgatgttttttagattctacgggaaaatgtgggccccctccacctattgacaatggggacattacttcattcccgttgtcagtatatgctccagcttcatcagttgagtaccaatgccagaacttgtatcaacttgagggtaacaagcgaataacatgtagaaatggacaatggtcagaaccaccaaaatgcttacgtaagtactttaatattcacgtggctggaaaaatcagtgtgatgagtctgatattttgctgttggtaacaaaataatcacagattattgaacaaccattctgctgaatgcctgcctaccaaaaatttcttttagaaagtaaagtttagaaattttctctttagggctgggtgtggtggctcacacctgtaatcccagcactttgggaggccgaggcgggcagatcacgaggtcaggagattgagaccatcctggctaacatggtgaaaccccgtctctactaaaaatacagaataataataataaccggcatggtgacgggcacctgtagtcccagctagtcgggagtctgaggcaggaaaatggcgggaacccgggaggcggagcttgcagtgagccgagttcgcgccactgcactccagcctgggcgacagagcgagactccgtctcaataaaaacaacacaaaaaagtaatttttctctttatatttatattttattttaaagaatttagttgataaataaaaatatactttcatgtttgacaatatgctgttttgatatatttatgctacaatgattaccacaaattaattagcacattcttcatcacctatgcttagcattgggtgtaggtgggtgtgtgagtatgtgtgtgtgtgtttgtggtgaggacacttaaaatctgctttcttgccaattttcagataaacaatacaatattattagctctaaatatcactagatctctatgtttgattccaagttcttattcatattatagctgaaagtttgtactctttgaccaatatcttaatcaaacaaaagcagcaatgataagttctaaaatgcagggatcctaaaatgacaactgatgtaatgaatcattgataatacacccctaattctcatacattaaacataaaacctcattttcacatcgattaccattttaagtttatttaaatcaatatgatgtttttacatagtcggtttggacagtgttttgagaaataattcctgaaccatcatataacattctacttgaaaacctgaaagtctatgaagatttgcatactacttaatgttttatgtttactgttttttattttcagatccgtgtgtaatatcccgagaaattatggaaaattataacatagcattaaggtggacagccaaacagaagctttatttgagaacaggtgaatcagctgaatttgtgtgtaaacggggatatcgtctttcatcacgttctcacacattgcgaacaacatgttgggatgggaaactggagtatccaacttgtgcaaaaagatagaatcaatcataaaatgcacacctttattcagaactttagtattaaatcagttcttaatttcatttttaagtattgttttactcctttttattcatacgtaaaattttggattaatttgtgaaaatgtaattataagctgagaccggtggctctcttcttaaaagcaccatattaaaacttggaaaactaa

SEQ ID NO: 539 - DNA, 30701 bp, Homo sapiens
taagtgaccttaaagccctagctttgtggtagtgcacttaaattcagaatcacacttggtaactaataatgaaagatttcaaaccccaaacagtgcaactgaaacttttgcattactatactactgagaatatctaacatgttgttactaatcaatgtcattctgaccttgtgggtttcctgtgctaatggacaaggtaagttgaaagagatctaaacactcagcttccctcttaaatgtaacttcgtgtaatatctaacttcatatgtctataatttttttataaatctgataggatatattcactatgctagcagaagtagcatattttgtgagagtataacagaaattaattttatgaaaaaatatctcataatttaaagaaaaaatgaataatattttctttgttttacaaattctacagtgtaaaaagcatctaatattcattatggagatatatgaatatactcataaaactttaagtaggaaacatgtcattagatagattctaaccttaaaatgttcagaattttcttattcataatacaagggaaactttgggagtgattgatactttcataatcttacatacagtgattttttattgattcatatatcaaaacagcaaataaaatattttaaattatgccatttcttatatttctattataccttaagaaagctgctacatctaattaacattaatatgaatttaatatttcaacaagattagcaatatgtaaatcacaacatatatgtaatcaaaaagcagaatatatacttaacttacattggaatgacagtaaattttaatttgcatttctgagttcactagcaaatgttcaataaataaatacataaataattttcatagctttatgtcattgttctctgatatgttttctcctcgatagtcatgtattttctatattaactatctctttgaatgcaggccttgcatattaaagaactatattgtatgtaacattagcagtggaaccacatgggtcaaaaatcatggacaatcaaaggtgtgtcaccattaatgaagaaaacaaattttataattatccaaaactttataatattccaacaaatgtaatggaggataatattggaaatcccactatcaattattgagagtatcttttccctcagcctctcctctcaaagctatgccactttatttgattctaagtaaacagctttaggttttacagtattatctatcacatgattcgctagttttaattgctgtgcaaaatcaaccttgatttgtgccaaaatgaaaaaaaaggaatttctcttgttattccctttgttaactaaactgctacaggcacattttttaaaataaggattacatagattaaagtagaatgcaaagcagaaaaatagagaaaaacagtactattttgaaatgactgaaattagattagaataagctctactttcttagttactttctcaaaagcagtataagaaaagaatgctgacaaattctttcttatttgatattccagttgaaaacttttctcctccaatgaactctttgtaagagtaaacttgagaaaaatgtcttgtaaatttgggtcacacctatatttctcaaaggagaaagtaactcatttagtggaataacatcttgggtagtgagaaacatctttgtgaattcagtagcattggctcaactgcatccctccaaaatttatttgtaaaagtccaaattcccaatacctgagaatgtgactgcatttgaagaaggagagcttaaagatgtaattaagttaaaggtcaatgattcaggtgggacctactccaatataactggtgtcaataagaagagaaaataaggacacaccatatagagaaagaccacgtaaggcatagagagaatacaaccatttacaaggcaaaggaagaggcctcagaagaatgcagccctgttgacagccacatctcaaagtattagcctccagaactgtaagaaaataaatttctatgaaatctgtggtactttcttatggtagcactagaagataaatacaatgattttacacaatttattaaaagaatattaacttaaaataattttttactctttactcatggatacgtatatacccaccatacatattttagagggtatttatcagaatttgataattatatcttggctgtattgtcttcgctgagttttgtctagttgaatactttatgtttatatatacctgtattcatatctattcagaatctggcaaagcaaacctgagaaatatttttcatatgattaatgaaggacatactttgtgagttgcctatgctaagaaactttgtttttaatggtagttgatgtttcagttctgaataataattcttttggaagccacgctatttgaaagataaacttgacagaaaattagtaattgtaacctattataatgttcattgaatttgtattgagcattatttcttccatcaacttgtaagttatttacatttaatttaaaataggttgtcaggaaaattattttaattatgaatatccttttaaaattgtataaatatttcattcatctattagagttgccataacaaagtatcaaaggtgacaattagtattttagagcaggattgcttctaaatctctttcaaactagatcattttcaatacccagtgcattacactctgttgccattgtacttctttgggatgctcaaattagtttcaaatctcactaagaagctggtttctgtgtgtatttcacgtgcccccattaagctttcgcataacaaaaggttccaggctttccttgacttttcctactacacacccagttctaataacttctctatgaaactccagtgccttctagtgggagaaacgatttttagaaatgaacctaaactatgaaaacctcacttcaggttcgaaaatgtcgtttattaagaaaaagaatttttggccagtcatggtggctgtaatcccagcaatttggaggccaagtcggggagatcacttgaggccaggagtttgggaccagcctggccaacatggtgaaacactgtctctactaaaaattcaaaaaattagccaggtgtggtggcaaacacgtgtaatttcagctactcaggagcctgaggcaggagaatcacttgaacccgggaggtggaggttgcagtgagccaagatcactctactgaactccagccttggcgacagagcaagactgtctcaataaataaataagtaaataaaatgatttcctttagtttacgtctctttcttccttggactaaatatcctgcaatcataagaaaatgtaagagtatctcaggatgttacacagagcagggatggttagattttccaatacggaggagacactcagcaaaaaactgtgcatccgtgcttgacggactgggtcagagaagctgtcatgcgtcacccaacaagcctctggagccagttctgtaactagcaaacgcctcccagaaagtaaagatgtcacttctctgaacttagtcttctcatctacacactaaagctgttgtgtcactagcctccttccagttctctctgatttatgatgattcaaacttaatttttctttagttatattcttaagatttcataacaaatagaacgtaaatattaatttctctcatgtttcagaattataaagaacttgatataaagaaacttgtttcaaaattataaagaaacataaattatttgctatttaaattgtggtagtgttcaatgttctctttgtatatacatatacatatataaatatacatatagaatgtatgaatatatatgtatattcgtgtgtggacctatatttttatatcaataatatgtctcacctgatacatgaattctaactatggtaagaatgtatgccatctaatacaaacaaaatgccacaaaactcaacaaaatgttttatttctggagataatttgctacatttcagattttttcttatgttatagtaatatttcttttctctattttccaaaaaacaattattgctaatgtgtgcacctgaactgacagctttagcataacttggtatagttttagataagctgagtttaaattaacgctgataaaatttccagaattgccgaagagaccatactacgtaggagaagtggataaagtggaatgaggttcttcttgtcttgttagctgatttgggagccactaaggattttaagtggagcaataaaatgaccagatgaaggatcactaatttatacacaggaaaatagattataaagatgagaggtcaggatcaggaaattagttatggttgctgtaatcccagaagaaaatggttgagagaagatgatatcaaagattattggcagggtttttttgtgcctgttgtgtttgtttgtttctttgttttgatagaaaaattgagtgaaagggaacaccacaaatgcagaagttcagttaattttgagagaggtaatgagaatgattaacatgaatttcccccaaaaaaagttctgtcaataattaccatattatgaataaatagggcatgggttatttttgcagctgactcagagaaaatagctatcacagcaaacctatgtctatattgaaattcatatatacatttaaagaatattattctataccatttatctcaagagaactaatcttcaaaggaaataaaatcagcaacatatttttaattaaaattttaacttctttcaaaaatgcctttattatttatctgttaagaacagataaatcattcatgaagcattcaagtcaaaaagaatttttatttttttgttggcagatttacctagtggaaacaacatgtgtatttagctttaaaaagaaaattccattaatatcagatgaggaaacattcaactaacaatgcagttaagtggaagaaaatgaagagtttcattaataaccctaatattaatggacaatggtggtactgagaggaacatctatctcttttaggcttcataaggaaatggtgtttttcagtgtcaacaaattaatctccactgcgtggttcacccaccaaatagcatatctgtaataatatattgtacttagtctaccacgttttaaaatgattggtttcaaactatcacagcatagaagacaatatatagatagttgaagagttaaagaaattgtagcgtaagaagcatgcaaaaagatagagttatagcgttataatgactgtcttgagatatttcaaaacacttacgaaggggagcaagttagcttttgatgaggactgtcacagtcagtgaagcaggtaacagtattatccaacatcgaatcagaggtcgagtgactttctaaaagggtgacctttacagatattgccatatgttgctgggatgggggttggtggtagaagagttgatctattctgagccttccacattttaagtggtatgattcaaaattacacatacaaactttgttttaattatactctattttaaaaactgcaattatcttttgagttgattttataatttatttttcttttaatttttgacttaagctcacaagcagttccttggaaaatatatttcactacacaattgagcgatcttcacttataagcactgttaagaaaatatgttagaaagaggttaatgaacacaagaaaatgataacccacattagatttatgtttggctgatggtatgtgtaataccattgtttgtcttcagatgtaaaagatttaccaacacaagaagcagatttgcttgttatttgggaataactgtattcccaaatctcagtagcttaataaaccaaagtttatgtcttgttcacactttgttttcaatgtagcttagaagggaattttgtttattacatgaattctaagactcaggtgacacagacctaatctctctatgtgcttccatgataactcttaacagctgggaagataacacaaaaatttctccaatggtttcttaaaattcctccgaagctgaatattaactctcatttacacctattatatattacaacactctcagttaaattgcacctgcttaacttcgctaatatagaaaaactgctctatccccccttttccgttgttaatgtcacagaatttcatctttacacatcatgtgcccaaaacttaataattcacttaaatgcattggtttcctaaattatgtagaaaatgaaatatggagttttaaaccaaagttacaacaataaaagcttttaggttaataattgtttttctaaacttcactggtctcttaaatcatatagaaaaacaaaaaatggagacaaaaaccattgttaccataatgctagcctttttaaattgcccatgtatttacctttattgaggtcattatttcttcctgcaatgtccagttactgtctagtattatttcactttacccttcaggactctattagacatttcttgaaaggcaagtctagtggtctcaaactccctcagcttttgtttatctgggaatgaattaatttctccttcacttttgaaggacacttttgacagatatgggattcttagttgaaagacgttttttttcttttagcgttttgaacatattggcccaatgcctctggcctataaacttctgatgagaaatctgctaataatctgactaagaaatacttacctgtgagaaattgcttctctcttgctgcatacaagactctctctgtgtctttgctatttaaaaatttgattatgaccaagtatagtggctcattcctgtaacgccagcactttggaagactgaatggggagagttgcttgaggccagaagtttgaggtcagcctggcaagcatggcaaaaccctgtctctaaaaacaacaacaacaacaacaaattattcaggtatggtgaaatgcacctgtagtcccagctactcaagaggctgaagtggaaggatcacttgagcccaggaggtcgaggctacagtaaggtgtgatcacatcattgcattctggcctgggtgccagagcatgaccctgtcaaaaaaaattatattaaagaaaaaagttagcctgatatagtagagcatgcctgtagtccttacaattcaagagactgaggcaggaggattgctttagactaggaatttgagattgcagtgagctatgatcacaccactgcactcctccctgggtgacagagcaagaccctatcactacaaattaaaaaacttaattaaattaaagtttgattataatgtatcttgatatctatctctttgagttaatctcattaagttcattaagtttattgagggtctctattaatgccattatttcttcaaacattctctattcatctttctcttctccttccgaaatccactttgtgtgtgttggtctgcttcctggtgtcccatgttccttagattcttttcactttatactttaatttctttttctgttattcagattcaataattttggtttttctaaaattgttaattctttcatctgcctgctctactatgcctctgaatctcttttttgatttttttccttttaattattgtactttcagaatttctttttgtttccttttcaggctttctatccctttattcatatttccattttgatcatacatcattttctttcttcacatctttctttacttctttcagtatctttaatacagttattttaaagtttctaatagacctaccatcagagctttttcagggaaactttcagtttattttttttcttttaataggccatactttcctatttctttgtatgacataatttttttgttgaaaactgaacattttagtctaataatgggtaacaactggaatcagattctcctccttctacatgtttgttgaggggcttcctgcattgttttcatttattgtttttgtctgaatgttgtaggctatgtctgtgtcacaaattagccggtagtatagactttaggttgtctccagtgttttccaagcctgcactttttgctaagtgttcatagtcattttctaattttccccattcatgcagttgctttggaacatcctagtgtttagtgtctggctgccaaaatattctttttgtggaaaactgaactttttaatctaataatgggtaacaatgggaatcagattctcctccttctacatgtttgttgaggggcttcctgcattgttttcatttattgtttttgtctgaatatagtaggctatgtctgtgtcaagaattagcctgtagcatagactttaggttgtctccagtgttttccaagcctgcactttttgctaagtgttcatagtcattttctaattttccccattcatgcggttgctttggaatatcctagtgtatctccccttggacaaattcacatcagccaaggggaggggcttgcaacaatggagaaagccgaaaaacaatggccgcctatctttctgtctgcatctctgtgatcaaagaacccagcaatcagagcacaaatctcaaatatttgaagaatcgagttgttttcgacactctggctccccgctgctatgtgcaggttgctccataaatacacatacagctgcctgccatgtggctaaggagcgtggtatgaacatatgacactgtgctaggagctaaaattgactgaatgtgagtgcaacttacgatccaagtcatccctagaagttgtagggcttcaatagactccaaaaatagtacaatcagacaaattctggccatgcaactgtaaaggtgaggagtcagattccaggtgtttcctcctccgccatcttcccagatttctttttctatatttcttagattgctttcagtaaatagaataacaagctaatgaatttaatcttttttattattattattatactttaagttctagggtacatgtgcacaacgtgcaggtttgttacatatgtataaatacgctgtgttggtttgctgcactcatcatttacattaggtatcaaacataaacactactagctccctccattgagtcgttctgagaagaaaaggcagggctctgaattccgatggaagggaacagaaagaaaaaaagaaaaggactgaactggtgaaagcacctttgtctttcaatcaagatgaaatgggggagttccctgattcccctcgcaggacgtgcgagaggggtgttatctgctttgtcgccccgcagctcaaacccctaggggcagcttgcagacgggcaggtgcagaggccggcatgagtgcttttgagctctggccccacggcagcgtctagggtaggcgtctgtgagtacagacgcccaagtggacgcgtgttacaaaactcagatttgctgtctgcagacggcttgtgtgttaatccgctcaatggaccctctgccttatctcaagagcctggggccagtgtgacagacttctgtatcctgagctcttgcccagtggtcctaaagaattggatcacatgcgggctcaaaggatgactgcaaggttttattgagtgatggcggtggttctcagcaagttggatagggagcccgaagtgggggatggagtgggaaggtggtcttcccctggagttaggccacccagcggccagatttttctccgacctcccctagcggaactcatttccctcggcatccagacattcctgctcttctctctttctctgctgccttgttccgctgtgattgttcagccgcgtatgtgtgcccgctaaggtgttgggtttatatgggggctggatgaggagcatggagggccaaaaggcaacattttggacaggaaaacagacatgcctgtcctcatttagggtcggggtggggcctttgacagggaatcgccctcttctaaccagtatttgcctgtctcctttccgtatcaaagactctcactaaatcaaccagagctaagatatgtgtactcaaggagaaaagctgaaagacttctgtgtggaatacatggatggttaacactgtaagtccttactcaggccttccttatttgcatttttactgtgtttctagcaagaatgtactttattttaatgggtagtgatttctacatagtccacacagccgttttcttttcagaaaaaaaaaaatgtaatcctccttatattcaaaatgatgtctacacacctgaaaagacaaaacacagaattgaagatttaatcatatgtgagtttatagatggcttttatcctacaacccagggaaacagggcaaatgcactagtagtgggtgggtacctacgtgctccaggatgtagcagtaagttccagtccatatactgacttacatttaaaatctgaaattactttctcttaaacacaaaaaaaggggagacaataaatttcaatattttagtatatggagttttgagaagtctttgctttccaaagtagataattctaagtagaatttaaaacaattattgtaaactaaaattctctttaatgtttgctactcagaattatacagatggatgtgtgtatatgaatagatatttctctattcttccaatgtccaaaataatacactgggtgagactagcaccctctaaagcctagtatattagttatgtatggttgtgaaacatattttgctaaaaacatatttgcttaaaacaataaacctttattttctcacagattttgtgggtcaggcatttgggagtgactttactgtttagttctgtgtcagatgctctcctgtgtcgttgccaaggatgttggcctgggctgcagtgacctgacaacttggctgggctgcaggatctgcttccaacatggctcactcacacagattttggtaggaggtcccagtaccttaccacattgtcccctccacaggttgcttgaatggcaactacatttctccagagctaaagattcaagacagagagagtgaggagtaggaggaagccttcatgtcatttatcacctagtcacacactctcacctgagccatatttattcttcagaaatgagtcactaagtccagcacacaacaagtggaggagaattaggctccactattttgaggaaggagtattgaagaatttgtggaatttccacaatcatcaaatgtagcaaaatgtctctcacgtcaatagggtgttttatttctatgatggttcctttgcctttttcaagattttttctgtctctacaaacatattcttttttttttctatcttgcagtgcattgtaaaggtgaaccatacttaaagtggatagtccatgacagaaaaatgttctttcctcttctttttaaaacaaggtcttcctctgttgcccaggctggagtgcagcagcgcagtatacgtcgctgcaatcttgacctccttggctcaaatgatcttcccactgcaacctcctaagcagttgggaatataggcatgtgccaccatgcccagttacttttttatttttattctgtagacacaaggtcttgctgtgatgcttaggctgatctcaaactgggcctcaagcagtcctcccaccttggcctcccaaggtgttcggattatcgtgcccaaacccagatgaattgtcaaaagcatgagttcttaagaaaggtagctattgtaactgtgaaaccaatttcactgtgcataaaaactataaggtaaataaataattattctatagttggcttatgaaaatgctagatcagcccaaatgcttctggaccaactgaatgccagctatatctggttttctgcaaaagtatttcgcaagtgaccttctgaaatttgtgtggaaaagatggagaaattgactggtttgatgatttatcaagtagtttgcagttttattaaatgttttacctgattatcagatacagcattttattctcaggcttcattactcttttgtgtctgcccatagtttaacggtttaggagaaatgcagtataaattcacaaatgaaatgctacagcagatggtgacagtgaatctgcattagtatagattcataattccagaagaatcctacgtgcaaagctaaatctaaaaaaattaaatttagtagtggtaactgtaagatcctggtcttgggtcaaaggaatcagcagtactagtacaaacagattagcaaccactataaaaattagtgagtattttaatcaacgttaaggtcagtttgagttaacattgtgatagaaccatcataactgcttgtgagtctacaattcacatggtagaagactaagaaatagaatgaggctgctctaagttctgctgacttcagtgccaatcagatcataggtggaattttttttttttttttttgctttagagaactaccatatgagaaagataaaaatggtttaaattttctcagtaaaaaagaaaagtcatgaagtggctcaagcttgtggtattaatgataatgatagctacttttaattatacttcctttttgattttttgaaaagaaatctcagcagactatgttatttacattctatgaaacaccatcatgagatagataactatacttgttctgaaatcagaaaactaaagtttaaatctctgctctaccacttaatggaaattttaattgagttttttaaggctcacttcctgcaaatccaaagactcaagcttgtccaaggtggaattagtgttaaatgatctatgttgaagtatcataatgtatcatgatgaaatttgcaaagttcaaaggtaaagagaaaataatacaaatatccaaacagtggtcggggggaaacaacagaatgtaacatagaaggaatgaaactaaatgaggcattttaagctcaactttggaagttcaaaaaatggggggcaaaatctatcaacaatgagagatatggatataggccaagaaactatacaaagacaagttattgttcccaggtctttgttaaagacatttacaacatgcaaggattcaaagttataatcggcataactaatctgtagaaaccggttgaaaaatttttctaatcaaacaaaaagaaatagattgatgaacgccagatgtgttaaagacaaattattcatctgacacttgttaatatgacaagacagattttatttgactattgcaataggggaaagaagtcttgagctaagcttcaaaaacagcacagctgaggatttataccctaaaatcagagtaattaagatgctatttataagcaatgaaactgaatgaatatttgaacttccacattggaagtttcaaaaatgtggcaaaaaaaaaatggtgaagagaaatatggactgtaggccaagaatctatacctagagaagttactcacgtatcttttaaatgaagatacttaagagatgcaagaattcaacatttataatccacaaaacaagactgtagaaactgcctgaaaatctcgctaatgaaaaaataagaaagaaagacaataaaccagtggactaaagaataatggagataataaacaatattgtgcgtgtgtgtgtggtgcatatgttggaattttttataatgtgtagtataaggtttcttgaacaatgatcatatttcatagaaaaaatgaatattcttctggtattacaagtagtaaattatctccgaatcatcccatggaaatggaaactttttttggaaatatcaagtataagccttataataacatagtgcttaaacatatatgtcaaatattcaatatacacaaattcctcaataaactgtaaatatactgtaaaaaatattgtatataaaacattaaaaacatcttattttctaatcaaaattaaaaattaataaaaatgcttattacactcttagatatttagatattaagaaatattcctagttcattttcctggttaaataaaggatagaaatcttgtcttaataactggtttgagacatgaattagcaatattattttgttgtgtgatgtgatcaatgagaaattcctgtttctctgtagtttttacattccttccagtcaattttttaaaatcctcaaaaaactactatctcccactctagagttggtctgagaagaacaggcagggctctgatttctgatgggatggaacagaaagaaaaagaagacagatgagctgaatggtaaaataagcgccttcatctctcaaccaggaagctcactaatcaaccagggctacgatatatgtactcatggagggtacattaaataggtctgcacagttttcttcaatcttcattagcaaacagctcttcacatatctaggtcattggatttctgtaacttttcttgccctaaaacccctaattcattacactaagaagagaatataatttattgatcaaaaatgtcatatatgattatctgttatagaaaaacattatttatactgttttttgttttttattacaagaagtgaaaccttgtgattttccagaaattcaacatggaggtctatattataagagtttgcgtagactatactttccagcagctgcaggacaatcttattcctattactgtgatcaaaattttgtgactccttcaggaagttactgggattacattcattgcacacaagatggttggtcaccaacggtcccatgcctcagtaagtaaacctctttacaagaatatgtgcataaaacttgaaaagagtgagagaacagcaaataaatgattatattgtcttatataacagaaataggaccaaaggaagagttgttcaagcaaaaagaccaaaatggatcttttttgttatgagatcttcgtgaaaattacatgagaaataaatgtggcaactttatgagaataccgatataatttaaacatattttatcataaaaactaaggttaagtaacattgaatactgacttttttgtaaaaacatttagtagtagctttagtttttcttgagtcatacatcattttcagtattgatgcagtcttatttaaatgttccaaaaattattttaatatactattttgatcaaattcatgtctctaatttacctttaaatcattttatggtccttaggacaatgtattttcaattatttggagaatggatataataaaaaatatggaagaacgtatttacagctggtctcctcctcccagatgcattcgtgtcagttagtgcactcatttgagatcccagtatgtccgtaactgtctaagatctagatatttaactggaaaattttgtacatcaactctgaagccgaatttatgtctttttattttaaaacagaagcctatctagtttccagttccaaatgtgtctgaatacatttaaaatttctggataattagtggattctgtcacttaatagggccaagcagcaatagaaatataagtcaggggccaggcgcagtggctcagtcctgtaatcccaggactgtgggagaccgagacgggcagatcactttaggtgaggagttcaagaccagcctggtcaacatggtgaaaccctgtctctactaaaaatacaaaaattagccgtgtgcagtggcacatgcctgtaatcccagctacccaggaggctgaggctggagaatggcttgaaccagggaggcggaggttgcagtgagctgagattagaccactgcactccagactcggtgatagagcaagactctgtctcaagaaaagaaaaaaacacatatatatatatatgtatatatatacacacacacacatatgtcatgaagatcacaaaatacactaaatacacattaaagtaacactgcttcagtatttatatcaaagtgaatgcattgatttaagtagattataaaattatagcattaattaacaatgcttgcccaaaggtcacttgtacatctctcacaattatatgacatctattcttatagctaatgctcatgctctgtcgctttaaatgaagacacattcagttatagctgactttcactttttaggtaaaggggtctctgaaagttgtttgtgtgtattgtttgcaatttacaaaacattccattatagaaactatatgataattaggatacaatagagataaaggacaatggtaatcttcttacacattcatagaagcactgccctcaacaacagcctaagcctctggaagggaagtcccttttgctcctgccataggcaccaactctgtcattaatccacttaacaaatattgttgtgtgtcaagtgcctttataggtatcgaaaataaaattgtttacgagagaaactgaatactgtagtttagagactggaggagattaatcgaaaagttgacaagaatagatcagaaaactcatgattatgacaaatgctttattataaacatgtatcatctttaacatgatttattttcctttcagatagtaaaattggtccatttacatttttttctaattactaaccaaaaaagaacatacacattattaataagttagaacatacgcattactaaaataattactaccttatacatatacccattagtaatgtatagaacacatacattgataatatataaagaacatatacattactaatatattagaacttatttttgctatcttgtttgttttttcctgcttacatttccacatttctctcaaacaccatggctatatgggtttaagcatccacttaagatgacaactattttaaattcctggagacaaaagatttacaaatttatttccttgcctgtggtagcagtgtgtactgtatctttgcctgggaaatggcatttgactaaatgaagtctaagacctcttaatagcaccagaaaggttcaggttattgcaaagtagccagaaactcttccaaataattatagggaattgagagtctgctagatctgcattcctcaaggcctgccagagctctgttgacagtctcaaagattctttgcttttattctgcccttccctgtgttttcactattttctttcaaaattcacagatgtctaggaaacttccagttttgctgttttcaattcattaacagatgtttcattgtttcaccatactgccatgtttttacttgttcccttctataaaagaagtattcaacaaatatttacttttttctctactttttctattttaggaacatgctcaaaatcagatgtagaaattgaaaatggattcatttctgaatcttcctctatttatattttaaatgaagaaacacaatataattgtaaaccaggatatgcaacagcagagggaaattcttcaggatcaattacatgtttgcaaaatggatggtcaacacaaccaatttgcattagtaagttatttacatattcccactcagtttctgtcaacttctttcctctctttgaggtgatagtgttttacagaaaaagatagaaaacacttttaggagtaaagagatataaatacttctaacatcatctaacattctgtgccaaactaagtcttttttgcctttttagagtaatggctacttgggaagatgatcattccatctctctcaattcaatttgcctttacgtaaaagcaatcccatcaggtacagactagttagggagctgcatgggaatatcagcacaatgtattacttgtcaataaaaactttgttcttttccctttctttgtatttcaaaattatcaactgcttgtattgtattccttgctcacactcttaagatgtacatgttagggaagggatgagtgcttaattctgagtttctgctagcatcaggaaaatgagacttcaataatttgtatcaatgatgcaactgaggagaaccaactcaaaaaattatttccagcttattgtctagtacagagaaaacaagtaaagaaaaagagtaagtgggtgggctgaatgtttacaaacctcatacttggcaatggattccttacaactaaagttctctaaaacattcccaacttgtaattatttattaataaagagattgcataatgaacaatggaaaccttgcagtggcaaaagtttatcttttttgtctttcctctttaggcattcaccaagatttgtaaagataaatcatttaatgtatttttaacacacatattgatatataatttacatactgcaaaatccacttcattttcaagggtacaattcaactatttttagccatgagacgaaatggaaaggactactgatatgtaattgaacatggatgaatctcaaaaatattaatctaagtgagaaaaaagaaaatgctacacttagaaagtgattatctcaaagttactctgaggtttgggagctataaaatatcaattcgtacatttctagaatactgttttcaatttctatgcttatcacgggctctgcaaaagacaaagctgtacacttcaatctgatttgaccagctttgataaatgatctaagatttgtaaaataaaagatgctttaaaatttttatagaacgtatatccaatgaatataattttaatccaacttataaaccctgtcagtaaactgagtacataaatatgtacattaacttttaaattcacaaaattttatcttctttaaaataatacattatagtgataaaggtagactgtaataacagtcaatgaggtgttcacaaataaaaatagatctgactaaatagtcttaatatgtttttcatagggtttgaataatgagaaggatcattatagggaaatgtatttttctcttgtaattaactgttatagcacaaaaaaaacactgattgtcggactatttttaatagtactcaatttattagcacacactgattggtaaattttattcctacaatgggactttcttagtcgagttgtacatcatatggcatagaaaagcaatcctcaattttattttgtttcagaattttgtgatatgcctgtttttgagaattccagagccaagagtaatggcatgtggtttaagctccatgacacattggactatgaatgctatgatggatatgaaagcagttatggaaacaccacagattccatagtgtgtggtgaagatggctggtcccatttgccaacatgctatagtaagtattttattcaagtatttctttttactagaattaaacaaatagaaacatacatatgtatatgtacacatatgtgtatgaatacatatgtgtacatatacatgtagtcctcatttgagtgtgaattaccttgaaacttaaaaaaaaaggttgaaaatacaaatgtcttcctaagaaatcaaataagatacatttaagagtatataaaaagctttattcagaaagtttccaataaaactgttgatttttccccaatgtaaagtattttttttcagattcttcagaaaactgtgggcctcctccacctattagcaatggagataccacgtccttcccgcaaaaagtgtatctgccatggtcaagagtcgagtaccagtgccagtcctactatgaacttcagggttctaaatatgtaacatgtagtaatggagactggtcagaaccaccaagatgcatatgtaagttcttaatattctggatctgagaaaattagagtaataactttgatccttgtttatttatactaaaatttttatgggttattaccctagaactgtgttcacaaacagctattctgctgaatatttgcctttcagatcttaatatataagtgtataagcttggaaaattttatgtaaacaatgacaaagtttccttttaaaaacaggaatgttcagagacctcaatttgttaatggacacaatgagtcttcaagaatgatatccatttattgcacacatatgaaatacagcatctcaccttaacatcaataaccattttcacattattaatacttaggtaaacagttttcaaagagttttgaaaacactgttttaaaaaccatggatgtggaaccaacccaaatgtccagacccaaatgacagactagataaagaaaatgtggcacatgtacaccatggaatactatgcagccataaaaatggatacgttcatgtccatgtcaaaagtgacatggaggaagctggaaaccatccttctcagcaaactatcacaagaacagaaaacctagcaccacatgttctcactcagatgtgggaactgaacaaggagaacaggtggactcagggaggggaacatcacacaccagggtctgtcacaggatggggagctaggggagggatagcattaagagaaacacctaatgtaggtgatgggttgatgggtgcagcaaaccaccatggcacatgtattcctatgtaaaaaaactgcatgtcctgcacatgtaccccgaacttaaagtataataaaaaccatgcactattaactaaaatcctacttgaaaacctgaaatgcttcctgatagagcacatagctagttaacactgagaagttctttctctgattattgtttttttcttacactttaccagtatttctagcaagaaagaaagaaattaacagaaagctcagccatttccaaatgccaatgctttctgttttcaccttcatctcctctcccctcgtcccagaatgaaaatgaatacactaaaaagccctcaagtctgtaatacaggtatactcttagaattttgtcccacaaatcctatgaacttgaagaaacacaattcaaaaaatatgagccaaaataattatggcagcaaaaagaaaacctaaaagaaaatttgccacaaatttctactagcctatgaggtagagaactgagatacccatcaggccttgcatatcagataacttattcctgtcacagctcttaaactgtaaactcacgagttttccaaatgctcaagttcctaagtacaggatgatacaagcagttcttttctgtgatatgactcatttcttttattttgatgctatgctaccttttaccttttatattgactgatgatgctgatattttggctgatcctatgatgggctaaaccttaattattgtccctatttatgtatccacttctgtagatgatcatgtgtaagtccgggctccaaaccatgcaagtggcaagactgcagaggaaaattcgtatcctcaaatcaaaatagtttacaagtatctttgaacatgatttcataggaaaaatttagtattaggtttcagagataaattctgagtcttaaatttgattgactgaggagatggacactcctaagatggatttcacagcaaaatcattacctcttctcataatcaagaacaggaaaggattataattatctgaggacataagatcagttccatgatacaagcaagactttcagtcttaaaatctaaagaagcaaagagcattcaagcagggaattctagggaaaaaggcaaccttatgaaaaatattacatatacatatggcatattaaagtaataaggaaaacattccagaacagcagaaaactttagaaacttttgaaaaatatgtttggagaagtatgtagtgctcaaataatatttatttttgaattgtaaacagcccctgaatgtattgaagagatcttaaaaatttttggatttcaaaagtgatatgtactatgttaagaaatttatttaagtgcttgaaagatggattaaaatatgatttggggaaatttctaaagaaatactaatgttaataagggctagacttgagtgcagaatacttgcatcaaaaggagagaagaggagtgaatgatatcatcaaaaatgaaaagtttaccatggaagaactgggcttaatacctagcgtatgggttgataggtggagctaaccaccatggcacacatttacctatgtaacaaaccttcacatcctacacatgtatccagggaacttaaaaaataattataaaatttaaaaaaaaatctaaaagaaaaccagccaggcgcggtggctcacacctgtaatcccaggactttgggaagccaaagcaggtcgatcacctgaggtcaggagttcgagaccagcctgaccaatatggtaaaactctgtgtctactaaaattacaaaaattagatgggcgtggtggtgtgtgcccatagtgccggccactcaggagactgaggcaggagaatcacttgaacctgggagacggaggtcacagtgagcagtgatcgcaccactgcactccagcctgggagacagagcgaaatttcatctaaaaaaaaaaaaaaagtaaagaaaaaaaaaaacattatttggaaggtaacataatcaaaacagtcatctcttatatcattgtctgttacagtgaaacattatttatactatttttgttttttgttacaagcaatgaaaccttgtgagtttccagaaattcaacatggacatctatattatgagaatacgcgtagaccatactttccagtagctacaggacaatcttactcctattactgtgaccaaaattttgtgactccttcaggaagttactgggattacattcactgcacacaagatgggtggttgccaacagtcccatgcctcagtaagcaaacctctttacaacaatatgtgcataaaacttgcaaagaatggagagagaagagcaaacaaatgattacattgtcttatatgacagagatggtaccaaaggaagagttgttcatgcaaaaacaccaaactagatcttttctgttatgagaccttcatgaaaatcacatgagaaataaatataggaaccttatgagaatacctatataatttaaacatattttatcataaaaactaaagataagtaacattgaatactgacctttttgtacaaacatttagtagtagctttagttttccttcagtgatacgtcatttttgtgtactgatgcagtcttatttaaatattcaaaaaattattttaatatactattttgatcaaattcatgttcctaatctaccttttaatcattttatggtctttaggacaatgtattctcagttatttggagaatggatataacacaaaatatgaaggaatatctttacagagtcaatctgtaaaagttgaggatatcctggctacagtctttcaaatgtgcagaccacagttccatgtacagaggatgaatggtctcctcctcccagatgcattcgtgtcagttagtccacttgtttgagaccccagtatgtccttaactgtctaagatctacacctttaactggaaaattttgtatatcaactctcaagctgaatatatgtcttttttatttttaaatagaagcctagctagctttcagttccaaatgtgtctgaatacatttataatttctggataatgagtggattctgtcacttagtagtcaagtaacaatagaaatataaatcatgaatagcacaaaataaatagactacggattaaagtaacattgcttcagtatttatattgaaatcatgctaaatgcattgatttaagtagattataaaattatagcattaatttaaaaataaatataatgcttgcccaaaggtcactgctacatctctcacaactatgtcatatctatttttatagttaatgctctgttgctttaaattaaggctgatcttcagttatagctgactttcactttttaggtaaaggggtctctgaaagttgtttgtgtgtattgcttgcaatttaccaaacattccattatagaaaccatatgaatattatgatataattgagatgaaagacaatgggaatcttcttacccctttgtaagagcaactgtcctcaacaataggcctaagccactgaaagaaaagtccctttttctcctgccataggcaccaactctatcattaatccacctaataaatattgttgtgtgtcaagcactttataggtattgaaaataaaactgtttacaatagaaactgaacactgtagtttagaggctggaggagattaataggaaagtaggcaagaatagatcagaaaactcatgattatgacaaatgctatattataaatatgcatcatctttaacatgatttttctttcagatagtaaaattagtccatttacatttgttttctaattactaattagaaaagaacatatacattactaatatcttaaaacatatacattactaaaataattactaccttatacatatacccattagtaatgtatagaacacatacattactaatatataaagaacaaatacattgctaatatattagaacttatttttgctatcttatttgctttcttttttctgcttacatttccacatgcctctcaaacaccacgtctatatgggtttaagcacccacttaagatgacgaccactttaaattcttggagacaacggatttacaaaattactttcttgcctatggtagcagtgtgtaccgtatctttgcctgggaaatggcatttgacttaaggaggtttaagaccccttaatagtaccaaaaatactcaggttgttgcaaagtagccagaaagtcttccaaaatatcattagggacttgagagtctgctagatgtgcattccttaaggcccgccagagctctgttgacagtctcaaggattctttgcttttattctgcccttccctgtgtcttcaacatttccttcagaaattcgtggtttcctttaagaacacggatgtctaggaaacttccagttttgctgttttcaattcattaacaaatgtttcattgttttgccatattgccatgtttttacttgttccctcctataaaagaagtattcaacaaatatttacttttttctctactttttctattttaggaacatgctcaaaatcagatatagaaattgaaaatggattcatttctgaatcttcctctatttatattttaaataaagaaatacaatataaatgtaaaccaggatatgcaacagcagatggaaattcttcaggttcaattacatgtttgcaaaatggatggtcagcacaaccaatttgcattagtaagtgatttacatattcccattcagtttctgtcaacttcgttcctctctttgagatgatagtgttttacttaaaaatatagaaaacacttttaggagtaaagagatacaaatacttctaaaaccattcaacattctgtgccaaattaagtcttttgcatgtttagagtaatggctacttgggaagatgatcatttcatctcttacaactcaatctgcctttacataaaagcaatcttatcatgtacagactagttagggagctgcatgagaataacagcaaaatgtgttagttgccattaaaaacttcgttgttttccctttctttgtatttcaaaattatcaactgcttgtattgcattccttgctcacactcagaaaagttgtacatgtcgggggagaaatgagtgcttaattctgaatttctgctagcatcaggagaatcagaccgtaataatttgtatcaatgatgctactgaggatatccaatcaaaaaattatctctaccctattgtttactacagagaaaacaagtaaaggaaaagggtaggtgggtgggctgaatgtttacaaacctcctacctgccaatggattctttacatgtaaagttctctgaacatgctcgacctttacttattatgataaagagattgcataatgaacaaaggaaatctttcagtggcaaaagttgattttttttctttcctctttatatattcacaaagatttttaaagataaattgcctaatgtatttttaacccagatactgttgtataatttacatactcccaaatccacttcattatcaagggtacaattcaactatttttagccatgagataatatggaaccttgatacataatacaacatggatgactctcaaaaatactaggctaagtgagaaaaaagaaagacacatttacaaagtgattatctcaatgttaccatgagttttgggggctatatcaattcctacatttctagaatactgttttcaatttctatgcttatcatgggctctgtgtaaagaaaaaggtgtatacttcaattttactcagctttgataaatgatctactttaaaacttgtaaaataaaagacaggatgcttcataaatttttatagaacttatatccaattaatataatttttatctaatatatacacccttactgttagtaaatcgttacataactacataaatggtttcgttaacttttaaattcacaaaattttatcatctttaaaataatagattgtagtatcatagtagtagactttaataacagccaatgagatttttcacaaataaaaataggtctgaccaaatgtttctaatatattttcacaggatttgaatgataagaaagaatatacagagagaaatatatttaactattgtaattaactattatagcacaaaaagcactgattgtcagactatttttaatagtactcaatttattagcacacactgattggtaaattttatccctacaatgggactttcttagttgagttgtgcatcgtatggcatagaaaagcaatcctcaattttattttgtttcagaattttgtgatatgcctgtttttgagaattccagagccaagagtaatggcatgcggtttaagctccatgacacattggactacgaatgctacgatggatatgaaatcagttatggaaacaccacaggttccatagtgtgtggtgaagatgggtggtcccatttcccaacatgttatagtaagtattttattcaagtattttttattagaattaaataaaataatagacacctacatatgtatatgtacacatatgtgtgtacatatatgtacatatatatgtagtcctcctatgagtgtgaattatcttgagacttaaaaaaaaaaaaaacaacgttgaaaatgcagatgtcttcctaagaaatcaaataagatacagttaagagtatataaaaagctttatttagaaagtttccaataagactattgatttttccccacatataaagtattttttttcagattcttcagaaaagtgtgggcctcctccacctattagcaatggtgataccacctcctttctactaaaagtgtatgtgccacagtcaagagtcgagtaccaatgccagtcctactatgaacttcagggttctaattatgtaacatgtagtaatggagagtggtcggaaccaccaagatgcatacgtaagttcttaaaattctagatcctgagaaaatcagagtaataagtttgatatttgcttttttatactagaatttttatgggttattaccctagaactgtgttcacaaacagctattctgctgaatgtttgcctttcagatcttaatatataagtgtataagcttggaaaattccatgtaaacaatgaccaagtttcttttttaaaacaggaatgtcggcctggggtggtggctcacgcctgtagtcccagcactttggaaggccgaggcaggcagatcacgaggtcaggagttcgagatcagcctgaccaacatggtgaaccctgtctctacaaaaaatacaaaaattagccaggcatgctggcatatgcctgtaatcctagctactcaggagggtgaggcaggagaatcatctgaacccgggaggcagaggttgcagtgagcggagattgcaccattgccctccagcctgggcgacagagggagactccgtctccaaaaataaaaaaataaaaaataaaaaataaataaataaaacagaagaagaagaaaagaaaaagagaaaaagaaaaaaccaagaatgttcagagtcttcaatttgttaatggatacaatgagtcttcaagaatgacatccatttattgcgcacatatgaaatatggcatctcagcttaacaccagtaatcattttcacattattaacactgaggtagagttttcaaacagttatgaaaacactgtttcaaaaaaccacgaactattaaatcctccttgaaaacatgaaatttttccggatagaatacatagctggttaacactgagaagttctttctctgattattattcttacttatattttatcagtattcctagcaagcaacaaagaaattaacgaaacttcagccatttccacaacccattgcttttccatttttaccttattctcctcttcccttataccataatcaaaatgaatacactaaaaacccctcaagccagtaatataggtatacttctagaattttgtcccccaagtactatgaacttgaagcaacacaattcaaaaaaatataagccacaataattatggcaacaacaagaaaacctaaaagaaaacttgccacaagtttctactagcctatgaggtagagccctgggatacccatcagtccttgcatgtcagataacctattcctatcacagctcttaaactataagttcatgagtttttcaagtgctcaagttcctaagtaaaggatgatacaagccgttcttttctgtgatgtgactcatttcctttattttgatgctatgctaccttttacctttcatattgactgatgacgctgatattttggctgatcttacaatgggctaaaccttaattattgtcccctacttaggtatccacttctgtagatgatcatgtccaagtttgagctccaaactatgcaagtggcaagactgaagaagaaattagtatcctcaaatcaaaatagtttacaagtatcttcaaacttgatttcatagaaaagtgttaggtttcagagataaattctgagtctcaaatttgattgaatggggagatggacactcctaagatgggtttcacagcaaaagcattacctcttctcacaatcaagaacaggaaaggattataattatctgaagatacaagatcagttccatgatacaagcaagactttcagtcttcaaaactaaagaagcaaagagcattcaagcacagaattctagggaaaaaggcaaccttatggaaaagattacatatacatatggcatattaaagcaatgaggaaaactttcccaggcagcaggaaactttagaaagttttggaaaatatgtttggagaagtatttagagttcaaataatatttatttttgaattgtaaacagcctctgaatgtattgaagagctcttaaaattttttggatctcaaaagtgatatgtactatgttaagaaatttatttaagtaagtacttgaaagatgtattaaaatatgattggggaaatttctaaagaaatgctaatgctaataagggctaaactagaatgcagaatacttgagtcaaaagaagagataggtgagtgaatgatatcatcaaaaatgaaaagcttgctatgtaagaactgacatttttatcatgtaagaattaggcttaatacctagggtatgggttgataggtacagcaaaccaccatggcacacatttacctatggaacaaacctgcacatcctgcacatgtaccctggaacttaaaaaaaaattataaatttttttacaaaagaattttataaaagaaaacccatatgtggaagtaacattatcttactgattttacagatgaaggcatagtgagatagagtaatttgtccataatcatgtagggattcacattaactcctgtgtgcttatccttgcctctttaaaatagaaaatgaagatgacagggatagatgatggtgatagagagagagataattgacagatattgaggtgtatgtatgtatgtatgtatgtatgtatatatagagagttttattttaatagatgactattagaaagattatacctttctacagttctttttctacactgtgggcataagagaaaaatataaacatagaattaaattagcaaaatgtgagtacatttggagtgcttgtagtcacggcttgtcaaatgggggaaaggaggataagtaaccatgactccagtggaacatgttagcataatcctttttgatatgaagtcactagggtggacacaacatgttttagggaagaagagttcaggctctagagaaagactgccagggttcacgtttatcacctcacctgatgatctctgctgtgacgttggggaagtgcaactgaacttattatatttttgaaatgctaaagtcagtatgtagcacaaattaataactattaactatttggattattttataattttattttatcctaaactactcattaggatgcattttatttgctcatgaaaggcaagattatgattgttaattgtttctttttctgctttcagatccatgtataataactgaagaaaacatgaataaaaataacatacagttaaaaggaaaaagtgacataaaatattatgcaaaaacaggggataccattgaatttatgtgtaaattgggatataatgcgaatacatcagttctatcatttcaagcagtgtgtagggaaggcatagtggaataccccagatgcgaataaggcagcattgttaccctaaatgtatgtccaacttccacttctcactcttatggtctcaaagcttgcaaagatagcttctgatattgttgtaatttctactttatttcaaagaaaattaatataatagtttcaatttgcaacttaatatgttctcaaaaatatgttaaaacaaactaaattattgcttatgcttgtactaaaataataaaaactacccttatattggacttcctatcaatgaattagtaagtatagaaacagataactgaatggctttctgcatattgtacagtatacctagacatag

SEQ ID NO: 540 - DNA, 30701 bp, Homo sapiens; identical to SEQ ID NO: 539

SEQ ID NO: 541 - DNA, 30701 bp, Homo sapiens; identical to SEQ ID NO: 539

SEQ ID NO: 542 - DNA, 101829 bp, Homo sapiens
cagtaactgactacttttctcccttctctagggtcctagcacagtgtctgatggagctttcctaccagaccctgaaattcacgcatcaggcgcgggaagcggtaaggaacgcatatataaaacatgattataccaagaacccctctcctactgttgctgcgggacgattccgagtctccggttgctatggcgacagagtccgctactagagaagcgcaaacgcagtgagaggcgctcggccgaggtggttaaatcccgggctgggcttgcagccgtgatggagggaaaaataaatgagacacaggcgggtttgggggtgacaacgggtcggatgaaagggacggcagggtcggttcctgattgaggaaatgaggtattgacggggaggtgttattagactctggatcttgattgggtgaatggatttggggagtggtcaaaattagattgttgaaagacaggaaaacattgacctgggagttagttagaatattggcttctgatcctgatttgccatcactaaggcgagagatcttaggcatttaattcccctcttgggcttcagtttctccatctgaaagtcagggaattggactgtaatctttttcacacgaagattacatgagctctacaatacattaagtggtttaccgtggtctgtatcacctgctactggccagcaattctttccacagcgatgaacatgaattgaggacacatttgtctgccaggcactggggagataaaaacaacgtgggggcggggggaaggaaaaataaaaataaagttaaaaaatacttctacctggatctcattcctagaggttcagaattactggcttgggatgagttctatgcatcagtatttttagaaagctcaagaggtgattacagtgtgtagccaaggttatgaaccacagctctagtatctcctaccttttaaaaactaataatacacaaaaaggtaaccctctggcttcatacccattatggttaccagcctctgtttatttctctccatcttctagaaaaggttggctacacatgttgttgctaattcctcacctccggattgtacttaagcctattttaatctcagcatgaactacccgcctcagaatcttttgggttaccctttaatagagcagattcttgggcctcatgaagacactgaatcagaaacccccgggatgatttcttgaaacttgcactttaagcacgaactctacgtttgaaaaacacagccgtaaacgttctcatatattttcatgacttctagtactatcttttaaaaatttatctttttggagacagagtcttgctctgtcgcccaggctggagtgcagtggcatgatctcagctcactgcagcctccacctgccgggttcaagtgattttcctgcctcagcctcccgagtagctgggactgcagttatgcgccaccatgcccagctaactttttgtatttttagtagagacagggtttcaccatgttgcccagtttggtctcgaacttttgagctcaggcaatcttcccccctcagcctcccaaagtgctaggataacaggcatgaaccaacatgcctggccgacttcttcttcttctttttttttttttttgagtcggagttttgctcttgttgcccgggctggagtgcaatggtgtgatcttggctcaccgcaacctctgcctcctggtttcaagtgattctcctgcctcagcctcccgagtacctgggattacaggcatgtgccaccatgcccagctaatttgtttgtttgttttagtagagatggggtttctccatgttggtcaggcaggtcttgaactcctgacctcaggtgatccgcctgccttggcctcccaaagtgctgggattacaagcatgagccaccatgctcggccaaacttctaatactatctatataccaaaaactcccccaacctacctcaactggacttctttgttaagccccagaccaatgatccagaagataaaatatgggtaggacaatggatcaactgattacttgacatatctactggggtgttgcaagtatctgcattgtgtgtgtgtgtgtgtgtgtgtgtgtgtgtttgagacagggtttcactgtcattcaggctggagtgcagtggtgcaatcatggctcactgtagtctcaccctgctcaagggatcctcctgcctcagcctttcaagtagcgggaactacaggcatgcaacaccatgcccggctaatttttctgtatatttagtagaaatgggttttgccatgttgtccaggctggtcttgaactcctaggctcaagtgatcctcccacctcggcctcccacggtgctggaattataggcatgagccactgtgccttgcatcttaacttgtttaatgcctaactacttctcctccttctccttttccttttctccttctccttcttcttttcttcaacagggtcttattctgtcacccaggctggaatgcagtggtgtgatctcagctcactgcaacctccgtctcccaggctcaggtgattcccccacctcaacctcccaagtagctggaaccacaggcatgtaccatcacacgtggttaaattttgtattttttgtagagtttcaccatgttgcctgggctggtctcaaactcctgggctcaagtgatcagcctgccttggcctcccaaagtcctcggattacaagcgtgagccttcgtgtctggcttaatgcttaacttttgaatgtcctctctaaaacctgtacctttcccagtctttccccataggggaagccaccccagtgaaaccaccattcatccgattgctcaaatcgtaattctgggggttatccttagctccttctttctcctagtccctctcctctgtcctctacaagaggaagacatcagcaaatcttattgattctacttctatattgtatctttaataatccatatattcacatccacctcctgatctaaacctccatgccctgtcactggaaccacattaatagcatcttagctattaccccttggtttttgcctctcttcagtccaaccttcatccaatgatcagggtgattttcttaaaatagtgccactcttttaatgggatccttttaatgcctttccattacacttgggataaaccctccaaatcttgacaagacctacaaagcactgcaataaagcccaacctctgcctccatgcttttcctctccattttctgtgttgcctctcagtgctccagccacattctccctaatctaacgtctgacaactccatagcatttatgccataaatttagtatttaattggattaattatattgttatctgttgcttgcatgtaacagataatataaatttcttggaacttgaaagcaaggcaggaactcaagccttattttttgttttagtccctagatggcgctaagagcaatatttaggtatgctcactgatggtttgatctcttggggtctatgtgcaaggaattgtgctgagtaggggtctggagaagctggaggaggggatgtgatccagtgtgttagatataaagaggactgcacgtccacaagacattctgattacctacatcatctactgtattgggattttcagaatattttctttgtatttggtttatttttgttgtttcaaattatttatttacaaatatattttcagtttttaatttttaacaaagtaatggcagcacatcacttaaaattataatagttcaacaaaatttgaaaaaaaacgaatctcctgcttcacctcaactggcccttacttaattactgctccccagaagcaactgcttcgacttgtagcagcttcttcaaaataacatgtttatactctttttctttttttgagacagagtttcactcttgatgcccaggctagagtgcaatggtgtgatctcggctcaccacaacctccacctcctgggttcaagcgactctcctgcctcagcctcctgagtagctggggctacaggcgcccaccaccacacccggctaattttgtatttttagtagagacggagtttctccatgttggccgggctggtctcgaactcccaacctcaggtgatctgcctgcctcggcctcccaaagtgctgggattacaggcgtgagccaccgtgcccggcgatgttcatactcctgaagcttgatttttcattctcagttatagtcgactcacttttatgaagataagcactgaactcccttctacttctccctgtccctggcctcctcccaccatcagtatgtatttcccttccctcattctctcaacacggagagaaattctatcataattttcattaaatcaattttcagtattaatattaatccgattgtataaatactatttagagctgagccatacagtgcactttggttatattttatattttatttaacttttgggacaagactcaatcatatattaaccaatgcattcttctttggtttacttttctgtatatttgataccacttccttcctagactttccaacagaactgtaaaattctcaatgtggggaagctaatcaggtaatttctaagtctgattttttttttttttttttactgggtggtatcttttctggatctctgagattctcctgctgtgtcaactcattgctctttgggcgtactatacagctttttttttttcctaggaaatcccttcctcccttccctgtgttagaaatcctgcttcctgggctccatgtcttccccttcttgccctatatccctcttgtagtgaaacatatcaaccaataactatctgagaaaagatatatgggaggtaaagttttggaaacaaagtatctatgaaacttctcctctcaccttgattggtgatttggctcaggttaatactctaggttgggactgatttcatctcaatggagaaggcattgctccattacttttttaattaattaattaattattttgagcagggtcttgctctgtcagcagtggcccgaccttggctcactgtaacctccacctcccgggttcaagctattattcccaggcctcagcctcccaagtagttaggattacaggggtgcgccaccatgcccggctaactttctatttttagtagacatggggtttcaccacgttgcccaggctggtctcaacctcctggcctcaagtgctccacctgccttgacctcccaaagtgctgggattacaggcatgagccaccatgctaggccccagtttctttctttcttttttagagacagacaaagtctctcccaggctggagtgcattggcatgatttagctcattgcagccttgaattcttgggcacaaatgatcctcccacctcagcatcccaagtagctgggactacaaatgtgcaccaccacacctggttaaatttttttattttttgtagagacagggatctcactatgttgcacaggctggtttcaaacccctggcctcaagtgatcttcccccacccaccacctaggcctgctaaagtgctgggattataggcatgagccattgcactcagcctgcaggtatgttttttttttttttttttttttttgagatggagtctcactctgtcacccaggctggagtgcaatggtgcgatgtcagctcactgcaacctccgcctcccgggttcaagcgattctcctgtctcagcctcccgagtagctgggactctaggtgcgtaccaccacgcccggctaacttttgtatttttagtagagacggaagtttaaccatattggtcaggctgatctcgaactcctgacctcatgatccacctgcctcggccttctgaagtgttgggattacaggcgtgagccactgcccctggcccaggtatgttttttattgatggttgaatgttcctttttcactgtatcctgttcttgcaagatgtcatgctttctttcgtctctctgaggaggttttcctttccttcctgcctgcctttctttttctttcttttgtttccttcctcccttctctttgtttccttccctccctccctccctgcttccttccttcttttttttttttttttttttttgaggcggagtctcgctctgttgccgaggctggagtacagtggcacgatctcggctcactgcaacctctgcctctcaggttcaaccgattctcctgactcagccttctgagtaactgggactacaggcatgtgccaccatgcctggctaatttttttaagttttagtagagacggggtttcaccgtgttagccaggatggtctcgatctcctgacctcgtcatctgcccgcctcagcttcccaaagtgctgggattacaggcgtgagccaccgctcccggcaccttcctccttttctttttctttctttcttctaacattttctctgtttccccttatgttcctttttgcattttttaatttgtggttttgtctttcatgtgggatattttcctcaaaagtcagtgatacagggttgtccatttatttttaagaatgagtcatctaggctgggcatagtggctcacaccactaatgccaacactttgggaggccaaggcaggcggagcgcttgaggccagaggtcgagaccagcctgggcaacgtgatgaaaccctgtgtctactaaaaatagaaagttagctgggcatggtggcaccacccctgtgttagaggtgggaggggtgcttaagtccaggagtttgagaccagcgtgggcaacatagttagacctcatctcaacaaaaaataagcaaaatgaactgagcatggtgacaagtgctggtggtctcagctacctggagggctaaagtggcaagatcacttgggaccggcaggttgaggctgcagtgagccgtgatcacaccactgtactccaacctaggcgacacatggagaccccgtctcaaaaaaaaaaagatataaaaaatgagacacctaaaatttaattagaatttttgtgttttagaggaggcttgtctcacaaagacagtttttctgtaggataatcaggtaccagggcccttttcattgggggatgccaaatgtcagttatgtgtaggtcttttttctgaggccttccatttctatgctctccttcagggaataagggcaaaataagtttggttgccagcagtgttggagagaacagaggaagactttgtgggggtgaaagcagggaatggaaggtggggtttcacctctctcttcagtatatacgcttccactgaattatccctttcttcaggtagtccaggtagtcctggtagtcccgtcttctgcctgggtaggggaggaattgtaacctgattggagaaggggagggaatctgcaataccctgttcagcatgctctttatacctcacttctgcccttggaggtgcctgatgactccagaggaacctggtgtccccattcctgtaactttctagggttctgttatatgttttcttctccttcttcttcttcttcttcgtcttttttttttttttttttttcctgagatggagtcttgctctgtcaccaggcgggagtatagtggcatgatctcggctcactgcaacctctgcctcccatgttcaagcgattctcctgtctcagtctcctgagtagctgggactacaggtgtgtgccaccatgccaagctaatttttctatttttagtacagacagggtttcaccatgttggccaggatggtcttgatttcttgacctcgtgatctgcccaccttggcctcccagagtgctgggattacaggtgtgagcccccgcgcctggcatcttcttttgttttttgggtttttttgagacaaaagaagtctgacttgattgtcacccaggctggagtacaatggcgcaatttcagctcactgcaacctctgcctcctgggttcaagcaattctcccacctcagcctccagagtagctgggactacaggcgtatgccaccacacctggctaattttcgtattttatttttatttttggtagagagggtttcaacatgttgaccaggctggtcttgagctcctgacctcaagtgatccacctgcctcggcctcccaaagtgctgggattatagacatgagccactgtgcctggcctctgcttcttattggcttctttccctgtaggtgttggttttctctatttttggttttctttgcttttggctttctttgctttaagtcagctggtgtttatccatttgcttcccctgtgtcaatttccttcctccctcccttcctccctccctcccttccttccttttgtctttctttctttctctctctctttctttctttctttctttctttctttctttctttctttctttcctctctctttttctttctctctctctctgtctttcttttttttttttgagacaaagtttcactcttgttgcccaggctggagtgcaatggcacaatctcagctcaccgcaacttctgcctcccaggttcaagtgattctcctgcctcagcctcccaagtaactgggattacaggcatgcgccaccacgcctggctaattttgtattttttttttttaagtagagacggggtttcttcttgttgatcgggctggtcttgaactcctgacctcaggtgatccgtctgccttggcctcccaaagtgctggaattacaggcgttctaccgcgcctgacgcttccttccttccttccttctttatttctttcattctttctttctgtgtttgtttggaaacagggtctcaccgttttgcccaggctggaatgcattggtgccatcaaggctcactgcagccttgggctcaatctaccctcctgcttcagcctctggagtagctggggccacaggcatgcaccactattcccggctaatttttaaattttttgtagagatgggggtctccttatgttgctcaggccagtcttgaactcctgtcctcacacaatcctcccacttcagccttccacagtgctgggattacaggtgtgagccaccttgcctggtttgggtcatagattttttattcctttatcatcattttaataaggctttgggagggagcagagataagtgatatcaagaacactttttatttagatatttattgagtgcctactgggtacaaagaatcctactagttgctcttgcagaggttggtttcagagaagtgaatatttaaaaaattgactaacatatgattcatatctaaaatatttttaaaattgatttcaagctaggcatttgtcacacatgtttatatattcaaatttagttttcaatatggttatttctttggatattgtagggtctggtggctgagcatgagagtgggtattagatgcttttgaatttatatcttggttttcaccgattaacagtaaggcaaatatgcatttattcattaactcatacgataaacgcaatttagtgcctgctttctgtacaacatggtactggtgttttgagatttgcctaaatgggattagtgacactaacactactgattatttttagaaaggccattttctcttggttttcatgatactaccgtctctttgtttcctacatttctttctggtctccttgatgagctgctctctctctgccccttaaattcttgttctttaggatctaaatttgtcttttctgaccagcccctttaccaatttaataaagtgtcccttcttgattcagggagtagatatcaccacaccattcttatcccaggaaattatatttgaatgtttactggttgctttcttccccccatcccagtagactgtaggctccttaagagcaagaactctggcaagtttcttttctgactagcaaattgatcttgcttttgcagagcttctcagtctttagtgtgcacattaaacacctgggaggttttgaaaattcatatgatgaggccaggcatggtggctcatgcctgtaatcccagcactttgggaggctgaggcaggcagatcacctgaggtcaggagttccagaccatcctgaccaatatgatgaaaccccatctctactacaaatacaaaaattagccaggcgtggtggcatgcacctgtaatcccagctatttgggaggctgagacaagagaattggttgaacctgggaggtggagtttgcggtgagccaagatcatgccattcagcctgggacacaagagcgaaactccgtctcaaaaaaaaaaaaaaaaagaaaaagaaaattcatattctgatccagaagttttggagtgggactgctttgccagttaattttatgtgtcaacttgactgtgctttggggtgcccaggcatttggtcaacattatccttgactgtctgtgaaggtgtttcggggtgagactaacgtttgaatcagtagattgagaaaagcagattgccctcttcttttttttttttttttttttttttgagacggagtctcgctgtcgcccaggctggagtgcagtggcgcggtctcggctcactgcaggctccgccccccggggttcacgccattctcttgcctcagcctcccgagtagctgggactacaggcgcccgccacctcacccggctaattttttgtatttttagtagagacggtgtttcaccgtgttagccaggacggtctccatctactgaactcgtgatctgcccgccttggcctcccaaagtgctgggattacaggcgtgaaccaccgcgcctggccttttttttttttttttttttttttttgagacagagtttcactcttgttgcccaggctggagtgcaatggcacgatctcggctcactgaaacctctgcctcccaggttcaagcgattctcttgcctcagcctcccaagtatctgggattacaggcatgtgccatcacgcctggctaattttgtatttttagtagagacagggtttctccatgttggtcaggctggtctcaaactcccgacctcaggtgatctgccggcctcggcctcccaaagtgctgagaatacaggcgtgagccaccgcgcccagcctaattattgtatttttagtagagacggggtttcaccatattggccaggatggtctccatctcctgacctcgtgatccatctgcctcagcctcccaaagtgctgggattacaggtgtgagccaccgcacctggccagattgccctctttaatgtggattggcctcatccaatcagtcaaaggtctgagtagaataaaagactgaccctcccacatgtaagagggaattcctactttctgactgtctttaaactgggacagcgttttgttttttttttctgcatttggactcaaactgaaatattggcttttcctgagtcttgagtctggctgcttttagattagaaccacaccatctactctcctggttcgggggccttcagacttggactgaaactatatcattggctcttctggttctccagcttgttgactgcagatcttgggacctgtcagcttctataatcacatgagcgttataataataaatccttataattataaattccctataataaatctagtaaataataaataatctagtacaaaataatctagtaaataataaatctagtaaaaaaatacacacatatatttatacatacacatgtgcatgcgtgtgcgtgtgtatgcatgtttgtataatttgttctgcctgtctggagagctgtgactaacacagatttgtatcacaagcttctatgttttatttctgatgctgctggtgatcttctggtagcaaagatatgaaatagagatttttctccaactccgttttaaatttagtgtttaatacaaataagactatacgtaatctgtatacctctgccactttctttttcttaacctgaatgtaagaatcctctataatgctctaaggccaaagaattatgtcattgtttttaatttggctgcacaattaaaaacaaacaaaaaaataattagagtcaatgcacgataatggtttttggaaaactggaattgatccacacattcatgtgtatgcacaaaagaatcctaaaacaaagtcatgtttgtttattctcatgtgtcattatacgtacttttcaaaagttactactctgccttggtgaaccttttatattacaaaatatcgactgtgttagctaattaataaggtcattgactagtttttaaaatgagtgttgttaaaatgccttagtttttattaatcgcatgggctcctaaaaaaagagtaattgaaaatttaattacatcagtgcttttcttcaaataactgaagcttattaaacttcaaatgttcaaacatttaagcatctattgaaataccaatagctataaaaaatgtgcagttctaaacactaattaaacaaactctaaataaccataaagctaagctgaattttaaataactcttacgttttaagtgctctgttccgctcatatacaaggaagattaaccccttcaattctgaccactgctacagccctgtgggcatctcttaaaatgctgtggctgctattgaaccactttcttcttatacttggaccaaaaaggagagactaattagacaacctggaacatgttgctaatgccacattagtactcttggaaccttttttttaaaaaaaactaactgagaatatacagacataaatttgtgtatttcatgttttgtgtgaaaacatacttgctttcttttgtaaaaataatgtttgttaggttttacttttaatttaattttttttggagacagagtccctctttgtcacccaggctggagtacagtagcaaaaccttcgctcactgcaacctccgcctcccaggttcaagtttttctcctgtctcagcctcctgagtagctgagattacaggcgtccgccaccatgcccggctaatttttgtattttttagtagagatggagtttcaccatgttggccaggctggcctcaaactcctgacttcaagtgatctgcccgcctcggcctcccaaaatgctgaggttacaggtgtgagccaccacgcctggccaggttttaattttaaatactcaaagtataaatttcaccacccaaatacatcctataaacattttaaaaaattgatatgaccttctactttcaactgagatggcataattggcaccagaccaggtctcctgtaagaaactggaaaactggactaaacatatgagtaaactcttttcaagcattggattatgtgatttttggacaacgtaattatgagagaaggccttctatttggaagcaataactagattctggttctggaaggagaaccccaaaaaagcggctgggcactgtggctcatgcctataatcccagcactttgggaggcccaggtaggtggatcacctgaaggtcaggcatttgagactaatctcaccaacatggtgaaacctcatctctactaaaaatataaaaaattagctgggcatggtggtgggcgcctgtaatgccagctactcgggaggctaattgcttgaactggggtgggtggaggttatagtgaaccgagattgctccattgcactccagcctgggcaacccaagagcgaaacttcaaaaaaaaaaaaaatgaacagcagttttgctaagatgaagcgatagagattggagtttgggaagactgagttgcttagaactgggagggaagagtttcagagaggaggagctatgcaaaaaaagagctccacaattattgatttttggctgaatactgagctgcacatacatagaggaaaaacatatgaagctgctctcataacatttagagacatttgcattatgactgacttaagtggagaaatcttgtgggacagaagagcatttagtagagctccaagtaaggctatgcataagagtaagcaaagccaggcacagcctagaataaaggctactttagatatcccttacctaacaaagcttaacaacaagctctgatatgaagaaactgatttgcaagtaactaaactgtagagggacgagacgcggacaaaacccctcagacaccgggttaaagaaggaagtggctttatttggctgggagtgtcagcagacttgcgtcttaagaactgagctccctaaaaaagaaattattggcccttttaagggcttacaacactaaggggaccacgttaaagggtcatgatagatcaagcaaacatgggggacataactaagggctacatgcattagctaatacaacagaaagttttgcaatgcttcctcatacaatgtctggaatttacagataacacaagtagtttaggtcaggggtagattttttaatttttttctttaactacaaggaccaggtggtggctccaggccatctggctatttatcttacttttgtttccttttaacttttcgctttctccctttcctcacgtcttaaaaactaggcaaggtggcaggggcggtgggggtgggggtgggtagcaggagaagtggtggtccccacctcatttcccctgtagagaatctcacttattatggggagttctcactttcatcatcagtttttaagtctctgtacatgatagagtgacagcgattcatgtaatacacttgtgttgaagttttctgataaacaaaggtagcaacaaaaacttttatcatttgtaggagcaagggtaatacacaggggaagagcaagcaacttcctattactagcaataaacttacaatgagggttttaaattctcccctagctgaaagacatttttcaaatacagacataggattaaacctctgccaaacctatacaggcatatgtgccaacgttgtcacatccctgaccatatttttgaccaccaatttttgaaaatctattggcagacagcaattgctcaagttgaatttttcacagacctgatattcaggtgagagaaaatagtccaaggccagtctattttgataaatggcatttttgatttgggctttctgctaggtaaaaaagtcaaaacactgccagttttgtcagtgattatttttaggagggcctgcaaccgtatgatatgattgagaatgtagatgggggtttgctactaagaatataagtttttaagagctacacacttgaatttcagggagtctgcggaaagagctacagttatcttcaggcattaacatttttcctttctaagtctactggtcttgtatgttagtccttccaaaaatataatatgaggaaatgcataggctgctggcactattttcagccacttgagcaaataggattttggctcagccctctaagaagctgggaccacaggggccgtgccaccacgccgggctcattttggtatcttttgtggagacggggtttctccgtttggcccagcctgttctccacctcctgggctgcagcgatctgctttcctcggcctcccagaggaggatggccgacgattacaggatcatgcccggccttttccctaaaagaaaacaccaacagcaacaaaacattttgcgtagtcggagttatcagtgtcaactggtggattgagagtttgtgtctaagaagtccttccttatgcactggatgatttcaaaagaaaggagaaaagacaaaagggaatctcacatcttgtacctgatttatgattgcaactagggcgttatttaaaagacgatcagtgaaccaccaaagtagaattgatccgaatgcgttcataatatcttctgaattctgaggtgtcctccaagcagggaggcagtggctgggtgtgggaggcaaaaatcacagggccagcacttgacacctgcaggattcggaggctcaactttgcaccaagccaagggttctggtgtccgtcgcaagtttcgttccccaacccgcattgactttgcattggccctcctccccccagattttatccgtaaggcaagtcctgagtttatcgtcgggagaatcttcccttgtagtctcgaattgccttggccatcagcggggccactttcttggcagcctgttttcgggttttgtccgcgggcgccgcgtgccggttgctgctgccgccgccgctcacgctgccgccgtcgccgtccccgaggccggagggagcctggctgcttcctgcgggcttgggggctggctccatctctccatttccggggtcagcggctcctgcagacttctcttgcctcctggaagcatcataaggcgtcttggccacagagttgaaacagatcatctttgtctgtcggccgctgggtttgttttcacgtgcggatcggattttcgtggtcactactcgcagccgctgctctcgggcgtcccgaagccgcaggtacagctcccgccaagactcgtgctcctgtggcttttcttccttgaagtcctggaggcaatgaatcctccataattcatctgtctctcgagcgagtgcggcattgtctttctctgtgcggtacggctgatcgggcgtccacccttccagaacgggttcaagagccgagtaggggaccccttccacgtcgccgagggcgtccggattgttcctaggcacccggaggcactgctggcgcagcgtcggcacctggagctggcaggcaggcctggagcccgagtacaccggcatcttagcgttcactctgcgtccagggaaagcagcttcctcctggagcgttggcgcggagagtgcttctgggtttgcctgggaggtcatggcctcaaaagcggacagcagatcgtagttggcctgcatccaggcctctgaggggtcccagagctccgagaagacatggctgggcaccgttttcggcccggcggaatcagcgacggccgcctgcagcctctctgactggctttcctggacaggaggcgatttctgagccgaagccccgcgggacgatttgtgccccttgctgtggctccccaccgcttccccctggggttggccctggcagccttgacccagcagaggcccgccctgagcggcgtgagcgtggcctcttccgggttgctccccgggcacagcgggctcagggccctcgggcatcgggaggggagcggtgcgcgttggagggtcccgatgggggccggaatcagctggggccattctggggcgctttctctcggctctgggctcgcgactgggagacctcgggtgaggtctctgttgccccggaggtgttctgcgtgctgtccgtctgtgctcagggctgtgagatgggctcctgggggccgtcgcgttttctgggaagccccaggccttttcccgctcctgaagagcctccccgaagcgctgtcgggaagcgctctcctcagggtcctgcgggtcaggcccggtgtttcggtccacgagcaccagcttcttccaccgggccgctaagtctctggcaaagtcgcccacgtgctggtgcttccgcaggcgcttcaccgtctttctgattccagtctccgccaggatgtctgcggtcatgggcaaggcggagagtttctgcaaatatttctctagctttttcggctccgtcttagtggccagacgcacctgcagcttccccactgcgcgcagcgtagtggaccctgccgccatctcgccagagctgtgcaggcgtcgctgtcctcgcggtcgcggctctgtccgagctcggggcggcggcacaggcagtctggggtggccggtcctcgctgcccggtcgccaggcggcgacctcgggatgtggagtcacagcctggagcgagctgggtcctcggagcagcgggccacttggtctggaacgccggtccttgcagacagctgagcaggcccgcttctgttcctcgggatgtgcggccgcagcctggagtgtgacctgtgcggtgcgccgtccaaggcggagtgaagctccgctgccagagcccggccttatatagccagccccgggcccacccagggctcaagccctgacccccctgggcccctgggctgccccgccccgataggaattcattccgtcagcccaacgcagccaatcggggcggtccacgccaggtggactgctgtgccccgcggggtcattaggttaattgcagcctggacacaccccactgagttctaccgttggccctccatgtacccagcttccacatctgtggattccaaaagacacagagagaatcttcttgggagtaaaagcgaaaataacaacaccgcaagacagaatcgtaggaagaagaaccaacagaggatgacaactctttacctgggattgacgttgtgtgaggggacttggaaacattggtagaaaagtgggattaagggagagagaggaaacaggcgtattttactcctcaacctcggctccatcagcatcaagacccttctggaagcagtgtcttttccccgccgtctagcccatcccttaaagcccccagggtcctgggaatttaactatttccatgcaatcttttttccattgttaactgaagaaaactgggtgccccttacaggttttccaagacaaggaaacaaagagaagtcagcaggcgccaaatcaggattgtcaggtggacgcctcacggtttcccatggcaagtcttgcccagctgcccttgttcgaagaaaggcatgatcaggaacactgtcgtggtggagaagaagtctctggtggggaccttcttcgctccagctttggctaactttctgaaaacgctctgctagcgagcagatgtgatcagggtttggccctgcagaaagtcaaccagcagaatccctctagcatccccgcccccccccccccgcccccaacggtggccatgacctctgctcttgactgctcctctgcagcttcgactggagcactgccacctcttggtagccatggcttcgtgcttggtcttcaggatcctgccggtagagccaggtttcatctcctgtgaccaatcttggaagaaatgcttcaggatcttgctcccaccggttgtttaaaatctcctcggaaaggcttgctctggcctgcagctgatactggtgccacggtttgggcagccgagttccactctcacctttcagtccaaatgaggaaaacagaaccatttgaagtgtctatggtgtcggctattgtttctgctgtcggcggcgatttcgcgtaatgtttacattctcacatgactttctctctctctctctcagtgtgtgtgtgtgtgtgtgtgtgtgtgtgtgtgtgtgtgtgtgtgtgtctcttctgcagaaagataatcgttatagcctgagaatcggggaatggggattcgggtgttaagccttttctgagaattaccctccgtgttgtgcagagaaataagtaaatttgctgtgtttccagacttccagctgcctcacgaagaggatcgtagtgcaatactggcgatgcctccagagctccctgaatgaggtttatcttgtaaataggtgggaggagaattgagctgtcctgggtcagtgtagtaatgttacagcaggatccttaggttgatgctgaattctatctggggtagatttatattttgtgcgggggttgtttcctttctgtgttttcgagcgggattgtcgctgtgggagcagggatctgctaaggtttgtctcgttctccagtaatgaatgagtttaatgggtgcagccgctgttttcagtagcatgccagtgggggcatcgatgagctatgaggggctagagcttgctcggattgtttccttgtgtttgtgttttgagatgcgtttgcttgtgtcatgtttgttttccattttggcaggggaaaggttttccaggaagaaaggttgttgccagtggatttggttccgaggggctggggtttctggctgggagtggggaggggctgcacggtgatcggtggctactccacctccagaaagagcgtgtggcttctctgcctcggggaggatattctgctctcttgtgagttttgcaagccacccgagattctctcttgaattgctgtcaagaaatagagaccggcgttgtctctggccctcgctggggaagcttttctgaggttttgtttttttaatttgagacggagtttggcttttgttgtccaggctggagtgcaatggtggcatctgggctcactgcaaactcggcctcccgggttcaagcgattctcccgtctcagccccctgagtagctgggattacaggcgctcgccagcaagcccaaccgagtttcgtctttttagaagagacgggatttcctcatgttggtcaggctggtctgcaactccggacgtcagggggtccgccggcctcgacctcccaaagcgatgggaatagaggcgtgagtcaccgtgcccggacatgtctgagtttcacagggtcgctgattggattatgtccccttccccggaacgaatgcttttctgtcttccttaagggtagtatctctgtggcaccctgttctggctccttacgtgttcttcaggcttgaaggcctcttttcacgtgcaccggcatccactcaggtgcctgcttccagaagcttcccagcacccactctgctgacagccaagggcacaggactttgatctcttctgctgcccttgctgggttttgccttgcggcttaggtctttctatttctctctctatccctcactgtcggtaacgcctaagaaccaagtttacttaatggtgtgtgtgtgtgtgtgtgtgtgtgcgcgcgcgcgtccgtgtgcgtgctcatgtgtgcgtgtgcgtgtgtgtgtgcgtgtctttctttgtgtgtatgtgtgtgtgtcgtatctggcacacggacctgtgattaccagcccgcgtgaagccaacaaatgccctgagttagaatgcaaactttcaccaaagcttgcaggagctcgtaggaggtgaactcaaggtagttaacccggtcatctcatggtaattagaaactctgcttggcaggtttagacttcctgatcgagaacctaaagaagctgattgaggtgtcgccattctttcacaggggttctggctgaaaagattgggattgattctttgccgtgcttagtaaaagtattttgacttaaggaacgtagcagttgttagcatttatgtatgaaatccaggagttcctttcttcagataaacagcaggtttctttgagatgtgctccgcttgtgtcacccaggctggagtgcagtggaatgaggaagggtcactgcagcctccgcttgcccagctcaggcgatcctgccacctcagccctctaagaagctgggaccacaggggccgtgccaccacgccgggctcattttggtatcttttgtggagacggggtttctccgtttggcccagcctgttctccacctcctgggctgcagcgatctgctttcctcggcctcccagaggaggatggccgacgattacaggatcatgcccggccttttccctaaaagaaaacaccaacagcaacaaaacattttgcgtagtcggagttatcagtgtcaactggtggattgagagtttgtgtctaagaagtccttccttatgcactggatgatttcaaaagaaaggagaaaagacaaaagggaatctcacatcttgtacctgatttatgattgcaactagggcgttatttaaaagacgatcagtgaaccaccaaagtagaattgatccgaatgcgttcataatatcttctgaattctgaggtgtcctccaagcagggaggcagtggctgggtgtgggaggcaaaaatcacagggccagcacttgacacctgcaggattcggaggctcaactttgcaccaagccaagggttctggtgtccgtcgcaagtttcgttccccaacccgcattgactttgcattggccctcctccccccagattttatccgtaaggcaagtcctgagtttatcgtcgggagaatcttcccttgtagtctcgaattgccttggccatcagcggggccactttcttggcagcctgttttcgggttttgtccgcgggcgccgcgtgccggttgctgctgccgccgccgctcacgctgccgccgtcgccgtccccgaggccggagggagcctggctgcttcctgcgggcttgggggctggctccatctctccatttccggggtcagcggctcctgcagacttctcttgcctcctggaagcatcataaggcgtcttggccacagagttgaaacagatcatctttgtctgtcggccgctgggtttgttttcacgtgcggatcggattttcgtggtcactactcgcagccgctgctctcgggcgtcccgaagccgcaggtacagctcccgccaagactcgtgctcctgtggcttttcttccttgaagtcctggaggcaatgaatcctccataattcatctgtctctcgagcgagtgcggcattgtctttctctgtgcggtacggctgatcgggcgtccacccttccagaacgggttcaagaaccgagtaggggaccccttccacgtcgccgagggcgtccggattgttcctaggcacccggaggcactgctggcgcagcgtcggcacctggagctggcaggcaggcctggagcccgagtacaccggcatcttagcgttcactctgcgtccagggaaagcagcttcctcctggagcgttggcgcggagagtgcttctgggtttgcctgggaggtcatggcctcaaaagcggacagcagatcgtagttggcctgcatccaggcctctgaggggtcccagagctccgagaagacatggctgggcaccgttttcggcccggcggaatcagcgccggccgcctgcagcctctctgactggctttcctggacaggaggcgatttctgagccgaagccccgcgggacgatttgtgccccttgctgtggctccccaccgcttccccctggggttggccctggcagccttgacccagcagaggcccgccctgagcggcgtgagcgtggcctcttccgggttgctccccgggcacagcgggctcagggccctcgggcatcgggaggggagcggtgcgcgttggagggtcccgatgggggccggaatcagctggggccattctggggcgctttctctcggctctgggctcgcgactgggagacctcgggtgaggtctctgttgccccggaggtgttctgcgtgctgtccgtctgtgctcagggctgtgagatgggctcctgggggccgtcgcgttttctgggaagccccaggccttttcccgctcctgaagagcctccccgaagcgctgtcgggaagcgctctcctcagggtcctgcgggtcaggcccggtgtttcggtccacgagcaccagcttcttccaccgggccgctaagtctctggcaaagtcgcccacgtgctggtgcttccgcaggcgcttcaccgtctttctgattccagtctccgccaggatgtctgcggtcatgggcaaggcggagagtttctgcaaatatttctctagctttttcggctccgtcttagtggccagacgcacctgcagcttccccactgcgcgcagcgtagtggaccctgccgccatctcgccagagctgtgcaggcgtcgctgtcctcgcggtcgcggctctgtccgagctcggggcggcggcacaggcagtctggggtggccggtcctcgctgcccggtcgccaggcggcgacctcgggatgtggagtcacagcctggagcgagctgggtcctcggagcagcgggccacttggtctggaacgccggtccttgcagacagctgagcaggcccgcttctgttcctcgggatgtgcggccgcagcctggagtgtgacctgtgcggtgcgccgtccaaggcggagtgaagctccgctgccagagcccggccttatatagccagccccgggcccacccagggctcaagccctgacccccctgggcccctgggctgccccgccccgataggaattcattccgtcagcccaacgcagccaatcggggcggtccacgccaggtggactgctgtgccccgcggggtcattaggttaattgcagcctggacacaccccactgagttctaccgttggccctccatgtacccagcttccacatctgtggattccaaaagacacagagagaatcttcttgggagtaaaagcgaaaataacaacaccgcaagacagaatcgtaggaagaagaaccaacagaggatgacaactctttacctggcattgacgttgtgtgaggggacttggaaacattggtagaaaagtgggattaagggagaaagaggaaaaaggcgtattttactcctcaacctcggctccatcagcatcaagacccttctggaagcagtgtcttttccccgccgtctagcccatcccttaaagcccccagggtcctgggaatttaactatttccatgcaatcttttttccattgttaactgaagaaaactgggtgccccttacaggttttccaagacaaggaaacaaagagaagtcagcaggcgccaaatcaggattgtcaggtggacgcctcacggtttcccatggcaagtcttgcccagctgcccttgttcgaagaaaggcatgatcaggaacactgtcgtggtggagaagaagtctctggtggggaccttcttcgctccagctttggctaactttctgaaaacgctctgctagcgagcagatgtgatcagggtttggccctgcagaaagtcaaccagcagaatccctctagcatctcccccccccaccccgcccccaacggtggccatgacctctgctcttgactgctcctctgcagcttcgactggagcactgccacctcttggtagccatggcttcgtgcttggtcttcaggatcctgccggtagagccaggtttcatctcctgtgaccaatcttggaagaaatgcttcaggatcttgctcccaccggttgtttaaaatctcctcggaaaggcttgctctggcctgcagctgatattggtgccacggtttgggcagccgagttccactctcacctttcagtccaaatgaggaaaacagaaccatttgaagtgtctatggtgtcggctattgtttctgctgtcggcggcgatttcgcgtaatgtttacattctcacatgactttctctctctctctctcagtgtgtgtgtgtgtgtgtgtgtgtgtgtgtgtgtgtgtgtgtgtgtctcttctgcagaaagataatcgttatagcctgagaatcggggaatggggattcgggtgttaagccttttctgagaattaccctccgtgttgtgcagagaaataagtaaatttgctgtgtttccagacttccagctgcctcacgaagaggatcgtagtgcaatactggcgatgcctccagagctccctgaatgaggtttatcttgtaaataggtgggaagagaattgagctgtcctgggtcagtgtagtaatgttacagcaggatccttaggttgatgctgaattctatctggggtagatttatattttgtgcgggggttgtttcctttctgtgttttcgagcgggattgtcgctgtgggagcagggatctgctaaggtttgtctcgttctccagtaatgaatgagtttaatgggtgcagccgctgttttcagtagcatgccagtgggggcatcgatgagctatgaggggctagagcttgctcggattgtttccttgtgtttgtgttttgagatgcgtttgcttgtgtcatgtttgttttccattttggcaggggaaaggttttccaggaagaaaggttgttgccagtggatttggttccgaggggctggggtttctggctgggagtggggaggggctgcacggtgatcggtggctactccacctccagaaagagcgtgtggcttctctgcctcggggaggatattctgctctcttgtgagttttgcaagccacccgagattctctcttgaattgctgtcaagaaatagagaccggcgttgtctctggccctcgctggggaagcttttctgaggttttgtttttttaatttgagacggagtttggcttttgttgtccaggctggagtgcaatggtggcatctgggctcactgcaaactcggcctcccgggttcaagcgattctcccgtctcagccccctgagtagctgggattacaggcgctcgccagcaagcccaaccgagtttcgtctttttagaagagacgggatttcctcatgttggtcaggctggtctgcaactccggacgtcagggggtccgccggcctcgacctcccaaagcgatgggaatagaggcgtgagtcaccgtgcccggacatgtctgagtttcacagggtcgctgattggattatgtccccttccccggcacgaatgcttttctgtcttccttaagggtagtatctctgtggcaccctgttctggctccttacgtgttcttcaggcttgaaggcctcttttcacgtgcaccggcatccactcaggtgcctgcttccagaagcttcccagcacccactctgctgacagccaagggcacaggactttgatctcttctgctgcccttgctgggttttgccttgcggcttaggtctttctatttctctctctatccctcactgtcggtaacgcctaagaaccaagtttacttaatggtgtgtgtgtgtgtgtgcgcgcgcgcgtccgtgtgcgtgctcatgtgtgcgtgtgcgtgtgtgtgtgcgtgtctttctttgtgtgtatgtgtgtgtgtcgtatctggcacacggacctgtgattaccagcccgcgtgaagccaacaaatgccctgagttagaatgcaaactttcaccaaagcttgcaggagctcgtaggaggtgaactcaaggtagttaacccggtcatctcatggtaattagaaactctgcttggcaggtttagacttcctgatcgagaacctaaagaagctgattgaggtgtcgccattctttcacaggggttctggctgaaaagattgggattgattctttgccgtgcttagtaaaagtattttgacttaaggaacgtagcagttgttagcatttatgtatgaaatccaggagttcctttcttcagataaacagcaggtttctttgagatgtgctccgcttgtgtcacccaggctggagtgcagtggaatgaggaagggtcactgcagcctccgcttgcccagctcaggcgatcctgccacctcagccctctaagaagctgggaccacaggggccgtgccaccacgccgggctcattttggtatcttttgtggagacggggtttctccgtttggcccagcctgttctccacctcctgggctgcagcgatctgctttcctcggcctcccagaggaggatggccgacgattacaggatcatgcccggccttttccccgaaagaaaacaccaacagcaacaaaacattttgcgtagtcggagttatcagtgtcaactggtggattgagagtttgtgtctaagaagtccttccttatgcactggatgatttcaaaagaaaggagaaaagacaaaagggaatctcacatcttgtacctgatttatgattgcaactagggcgttatttaaaagacgatcagtgaaccaccaaagtagaattgatccgaatgcgttcataatatcttctgaattctgaggtgtcctccaagcagggaggcagtggctgggtgtgggaggcaaaaatcacagggccagcacttgacacctgcaggattcggaggctcaactttgcaccaagccaagggttctggtgtccgtcgcaagtttcgttccccaacccgcattgactttgcattggccctcctccccccggattttatccgtaaggcaagtcctgagtttatcgtcgggagaatcttcccttgtagtctcgaattgccttggccatcagcggggccactttcttggcagcctgttttcgggttttgtccgcgggcgccgcgtgccggttgctgctgccgccgccgctcacgctgccgccgtcgccgtccccgaggccggagggagcctggctgcttcctgcgggcttgggggctggctccatctctccatttccggggtcagcggctcctgcagacttctcttgcctcctggaagcatcataaggcgtcttggccacagagttgaaacagatcatctttgtctgtcggccgctgggtttgttttcacgtgcggatcggattttcgtggtcactactcgcagccgctgctctcgggcgtcccgaagccgcaggtacagctcccgccaagactcgtgctcctgtggcttttcttccttgaagtcctggaggcaatgaatcctccataattcatctgtctctcgagcgagtgcggcattgtctttctctgtgcggtacagctgatcgggcgtccacccttccagaacgggttcaagaaccgagtaggggaccccttccacgtcgccgagggcgtccggattgttcctaggcacccggaggcactgctggcgcagcgtcggcacctggagctggcaggcaggcctggagcccgagtacaccggcatcttagcgttcactctgcgtccagggaaagcagcttcctcctggagcgctggcgcggagagtgcttctgggtttgcctgggaggtcatggcctcaaaagcggacagcagatcgtagttggcctgcatccaggcctctgaggggtcccagagctccgagaagacatggctgggcaccgttttcggcccggcggaatcagcgccggccgcctgcagcctctctgactggctttcctggacaggaggcgatttctgagccgaagccccgcgggacgatttgtgccccttgctgtggctccccaccgcttccccctggggttggccctggcagccttgacccagcagaggcccgccctgagcggcgtgagcgtggcctcttccgggttgctccccgggcacagcgggctcagggccctcgggcatcgggaggggagcggtgcgcgttggagggtcccgatgggggccggaatcagctggggccattctggggcgctttctctcggctctgggctcgcgactgggagacctcgggtgaggtctctgttgccccggaggtgttctgcgtgctgtccgtctgtgctcagggctgtgagatgggctcctgggggccgtcgcgttttctgggaagccccaggccttttcccgctcctgaagagcctccccgaagcgctgtcgggaagcgctctcctcagggtcctgcgggtcaggcccggtgtttcggtccacgagcaccagcttcttccaccgggccgctaagtctctggcaaagtcgcccacgtgctggtgcttccgcaggcgcttcaccgtctttctgattccagtctccgccaggatgtctgcggtcatgggcaaggcggagagtttctgcaaatatttctctagctttttcggctccgtcttagtggccagacgcacctgcagcttccccactgcgcgcagcgtagtggaccctgccgccatctcgccagagctgtgcaggcgtcgctgtcctcgcggtcgcggctctgtccgagctcggggcggcggcacaggcagtctggggtggccggtcctcgctgcccggtcgccaggcggcgacctcgggatgtggagtcacagcctggagcgagctgggtcctcggagcagcgggccacttggtctggaacgccggtccttgcagacagctgagcaggcccgcttctgttcctcgggatgtgcggccgcagcctggagtgtgacctgtgcggtgcgccgtccaaggcggagtgaagctccgctgccagagcccggccttatatagccagccccgggcccacccagggctcaagccctgacccccctgggcccctgggctgccccgccccgataggaattcattccgtcagcccaacgcagccaatcggggcggtccacgccaggtggactgctgtgccccgcggggtcattaggttaattgcagcctggacacaccccactgagttctaccgttggccctccatgtacccagcttccacatctgtggattccaaaagacacagagagaatcttcttgggagtaaaagcgaaaataacaacaccgcaagacagaatcgtaggaagaagaaccaacagaggatgacaactctttacctggcattgacgttgtgtgaggggacttggaaacattggtagaaaagtgggattaagggagaaagaggaaaaaggcgtattttactcctcaacctcggctccatcagcatcaagacccttctggaagcagtgtcttttccccgccgtctagcccatcccttaaagcccccagggtcctgggaatttaactatttccatgcaatcttttttccattgttaactgaagaaaactgggtgccccttacaggttttccaagacaaggaaacaaagagaagtcagcaggcgccaaatcaggattgtcaggtggacgcctcacggtttcccatggcaagtcttgcccagctgcccttgttcgaagaaaggcatgatcaggaacactgtcgtggtggagaagaagtctctggtggggaccttcttcgctccagctttggctaactttctgaaaacgctctgctagcgagcagatgtgatcagggtttggccctgcagaaagtcaaccagcagaatccctctagcatctcccccccccccccccgcccccaacggtggccatgacctctgctcttgactgctcctctgcagcttcgactggagcactgccacctcttggtagccatggcttcgtgcttggtcttcaggatcctgccggtagagccaggtttcatctcctgtgaccaatcttggaagaaatgcttcaggatcttgctcccaccggttgtttaaaatctcctcggaaaggcttgctctggtctgcagctgatattggtgccacggtttgggcagcggagttccactcttacctttcagtccgaatgaggaaaacagatccatttgaaatatgtatgttttcggcttttgtttctgctgtcgttggcagtttcgcgtaatttttaatttctcgtgtgactttttttgtgtctctctgtctttctttttgtgtgtgttgtggtgggggcggggtgtgtttcttctgcagaaagaaaatcattatgccctgagaatcggggaatggggattcgggtgttaagccttttcttataagtacccttccacagtttgtagaaaaataggtaaatttgctgtgtttccagacttccagctacttctccaggagaatcgtagtgtaatactggcaattcttcagagctagaatgaggattattttagtagagatgggatctttttcatattggtcgtcctggtctttaactccttaccttatgtgatccacccacctcggcctcccaaagtgctgaggtagggccttgagcctccccacctggacttttttgagttttatatggttactggcagtgtcacatcccttttcccagaaagaatgctttcttgtcttcctgaaatgcagtatccctttgtctccatcctggcttttttcctgtgtgtgtgtgtatcatatctggcatacgttcctttgattaccagcccgtgtgaggccaacaaatgccctgctttataatgaaaagttttaagaaagctagcagacgtccgtgtgatctgaactcaaggtagttaacccggtcctttcatggtaattagaaaatctgattggcctctttagacttcttgattcagaacctaaataagctgattaatgtgtcaccattctttcataggggttctgggtgaaaagtttgggaatgattctatgtgttacttagggaaactattttggcttaacgcatgtaccagtgattaccattcacttatgaaatccgatagttccttttttctaagaaatagcagttttctttgagccatgctcaggttctgtcacccagcctgaagtgcagtggaatgatgaagggtcactgcaacctctacttgcccagctcaggcaatcctgccacctcagccctttaagaagctgggaccacatggaccgtgccaccatgccaggctagttttgatatcttttgcagagacggggttttcctattttgcccaggctgttcttcacctactaggctcaagcgaactgctttcctccacctcccaaaggaggatggctcacgattacaagatcatgctcagccttttattaaaacaacaacaacggcagcaacagcaaacattttatgtattcggagttatcagtgtcaactaatggcttgtgtgtttttgtctaagaagttcttatctacttgatttcgaaaaaaaaaagaaaggaaaaaggaaatctcacatctttttccttatttatgattacaactagggtgtttttaaaaattatcagtgaacatccaaaatagaattgttcccaatgcgttcatatcttctgaattctgaggtgttctccaagctgggaggtagtggctgggtgtgggaggcaaaatcacagggccagcacatgacacctgcagaattcaaaggctcaactttgcaccaagttaaaggttctggtgtccattggaagtttcgttccccaacccgcattgactttgccaatgcaaaaatccccccagattttatctgcaaggcaagtcctgagtttatcgtcgggagaatcttctcttgtagtctcgaattgccttggccatcagcggggccactttcttggcagcctgtttccgggttttggccgcgggcgccgcgtgctcattgctgctgctcaggcaggggttggcccgcttctcagggagccagcgaaggatgctgctgctgctgtctctgccaccgccgctgctgctctggctggagggagtgtggctgcttcccgcgggcttggaggctggcttgatctccccattttcggggtcagcgtctcctgcagacttctcttgcctccttgaagtatcataaggcgtcttggccacagatttgaaacagatcatctttgcctctctgccgttggggttgtttccacgtgcagatcggatattcgttgtcattactctcagccgctgctctggggcgtccggaagccgcaggtactgctccctccaagttttgttttcctgtggcttttcttccttgaagtcctggaaacaatgattcctccgtaattcgtctgtctctctaacgagtgcgtgattgtctttctttctgcgatacagctgatcgggcctccacccttccagaacaggttcaagaacccagtaggggacctctcccacgtcgctgagggcgtccggattgtttctaagcacctgggcacactgctggcgcagcgtcggcacctggagctggcaggcaggcctggagcccgagtacaccggcatcttagcattcactctgcgtccagggaaagcagcttcctcccggaactttggtgaagagagtgcttctggctttgcctgggaggtcatggagtcagaatccgaaagcggatcgtagttggcctgcatccaggcctctgagaggtcccagagctctgagaagacatggctgggcaccgttttcggcccggcggaatcagcgccggccgcctgcagcctctctgactggctttcctggacaggaggcaatttcttagccgaatcccaggactcacgagtgcccttggattcgtttgctttcctttgtttatctccaagtgcagtggtggcagattttccagtctttttcttttgcttccgcaactgatcgtaggtgaggtatttttcacatgacagagtgggctgctcgaattcctcagccatatctacctcctccacctcagagagggagctcacggacgttctgtccaaatgagcagtcggtggcttcccctcttgagtctctcggtcgttggaaagctgctctttctcctcgggcgacaggccgtgtgtcccatttcctgggtcccggccgtctagactgggcctcttcttgttcgagtgactgtgctgaggcctcttctggtgactgtctggagcctcctccaaggcagggacacgctggccgctgccagcttgccccccttccttgtctgtcttgaagtccgaaggctgcctgtccctggcacttgcccaggagggcatccttggggtttcctctcttaagcaggccccgcatgatttctccctgatcaaagtaggggagtgccaatctccctgggcacacaaggggcgtttttcctggcgagacgatttgtgccccttgctgtggctcacaacggctttcccctggggttggccctggcagcctggacacagcagaggcccgccctgagccgcgtgagtgtggcctcttccgggttgcttcccgggcgcagcgggctcagggccctcgggcatccggaggggagctgtgcgcgttggagaggcccgatagcggccggaatcagctggggctattctggggcactttctctcagctctgggctcgcgactgtgagacctcgggtgaggtctctgttgccccggaggtgttctgcgtgctgtccgtctgtgctcagggctgtgagatgggctcctgggggccgtcgcgttttctgggaagccccaggccttttcctggtcctgaagagcctccccgaagcgctgtcgggaagcgctctcctcagggtcctgtgggccaggccgggtgtttcggtccacgagcaccagcttcttccaccgggccgctaagtctctggcaaagtcgcccacgtgctggtgcttccgcaggcgcttcaccgtctttctgattccagtctccgccaggatgtctgccgtcatgggcaaggcggagagtttctgcaaatatttctctagctttttcggctccgtcttagtggccagacgcacctgcagcttctccactgcgtgcagcgtagtggaccctgccgccatctcaccagagctgtgcaggcgtcgctgtcccggcggtcgcagctctgtctttggggctgcgggacaggaagtctggggtggccggtcctcgctgcccggtcgccaggcagcgacctcgggatgtggagtcacagcctggagcgagctgggtcctcggagcagcaggccacttggtctggaacggccgtccttgcagacagctgagcaggcccgcttttgttcctcgggatgtggagccacagcctggagtgacctctgcagtttgctgtgcaacaaagaatgaagctctggtgccagagctgggccttatgtagcccatcccaggctgacactcacggctctagccctgaccctcttagctcttgggctgccccgcccccatacgtactcatgccgtcagcacaatgcagacaatcgggacggtccacgccaggtggactgctgtgccccagaggttgattaggttaatttcagcctcgacacaccccactgagttttaccgttgaccttccatgttcgcaggttccacatctgtgaattccaaaaaacacagactgaatcttcttgggagtaaaacagaaaataacacagcaagacaaaatcatagaaagaagaaccaatacaggataacaactctttgcctaggactgatgttgtgtgaggggacttcccaaatttgtcaaaacagggattaaaagacaaaaataaaaccggtagattttatttcttaacatctgctccatcaatttcgagacagtagttcgagcactgtcttgaccccgccttgtccctcaagccctgatgtttctgggaatttaactatttccaagaaatcttttttccattattaactgaagaaaactgggtgccgtttgcagaatttttaatacgaggaaataaatagaagtcagcaggttccacatcatgactgcaaggtggacgcctcatgatctccttttgaaactcttgccaaactgccctttgttcagtgaaatgctacagcaagaactttttcatgattaggtagaactctctggtaatggtttttctgctcatgctttggctagttttctcaaaaactctgttagtaagcatatttgatcttggtttggcccttcaaaaagtcttttagtcatatcttttgagcattccccaaaactgttgccatgacctcttctcttgactggtcctctctgtctttgactggagtgctgccaccttttggtagcctttgttttgtgctctttcttcaggactatccagtgtagccatgttttatccccgcttacaaatcttggaataaatatttctggatcttcttccacctgttttaaaactttaaagaaatttttactcttgtctctagctattattgttgaaacagatttggtatctggatcggactttaattttcagtgacaattattaaaacaggatcatttgaaatatctatggttttttctcttatttctgttgttacttatttaccctctcaaattagggaacacttggtcctatgtttctgagcatagttgaccaattctgacattgtattaaattcaataaatgtcttttctggatctgtagacacttcttttgatatttctagcatttttttgggttgtacagcatttgaaagttaggaagtttcctggcagagccaggagatagtcaggaaacaaacaagaaacaaattagaacctacaggtatatatattcaaccttttaggggaatattagatgcagggactgtaaaacagaagtatagtaaagacatttgaaagaagtgatgtatgctttttaactgtttgtttttgagattgaaagcttaatgcaaaatttggatcttattactgaaattgaaacgagctcatgcaaattaatctccattgcacccgtaaaaaggaaattaaaagcactaatgttgcatgtggtgtatatacagtaacatttcctaaatatcttctgggtctaaaactgggaatgatattcaatgcttccttttcctcaggctatggtatcataggattcaattttgaatttgataatggaggtatatttgtggcacaatagcccacaaaggaaatgaaagaaaacaaaaacagccagattattgaaacatgcaaatgagacacctagattagatgttcacttctgggcctcctttctttgtacacagaaattaatgagcatgtaattgtgtccatttcaggggcacaccatctcttacagtttaaatggatcctttttgcggggaatggctcattcttagttttttttaattcagaagataattttctaggttaatttgaatggcctgggcagaaagatgtagatctggccaactttatacctttaattaagaaatttgtaagactgcattctgtgttttcagtaacagaagctcatcttaaatatttaacactacatttggaatagtgtttttaaaactctcttttcctgctttactcttactgaattctgaatttttatcactcttaccacaaaataaaaatcacattattattttaagacctggtcaccacaagtaaaagctgcttcacagtccacatagtaggaaagccatttttttttttttattagagatgggagtctccctatgttgcccaggctgctctcaaactcctgggctcaagtgatcctcccaccttggcctcccaaattgctgggattacaggagtgagccacagtgcccgaccatgaaaagccatttttgatgcagcctcattaccagacagagttctaaaggactcagccaatccccattatagacatcgactcttttgcaaactgtgattctaataaaaaaaaagtggaaattcttttgattggagttgaagtacctgccattttgcagaaatgtaatgaaaaccctgagtaagcctgtcttttaggctattctttcaaaagtatgatcaacattgctcagatttgtttaggattaagaattagacctctgtctcaagaattagagcttttgctttcttatttatcctgattaactgtgttaattaggtcagtggttcactgtttaaatgactctccagggattctaaaaaggagtttgaaggaaataattctgacaaatgttccaacttgcttttattagggttgctatgaaactcactatcctacctgtgggtagtagaaaataaactgtatttttctgcctctgtgtatgtgcatgtatgtgcacacatggagtatttctataatatagtgtaattgatcctctagagtataaattgctgagtgatattgctgggtcgacaggtatgcgcatttttctctttgatagattttgtcaatttgctctgcaaaagggttgtaccaacttacattcccaccaattgtatctgaaatacaatattctttcaataccttaccaaatctggatgtaaaaatgtaaaaaatagctgcactttaaaaaatttgagagtcttattgaaagaagcttatttttgtaccaaaaaactgaagaagtatagacaatagttaaggtggtttcttcaacttgtatatatattgcaaattattataaaacccacaagaaaaactgcaaagagaaatgtctgctgtaaatgaatatgtgaagattctgaacacagaaatgcctgtattactcttctgttcagtaagtctactcctgtagtcacactgatagagcaaggctgggtagtaataaagtgtcattgctacactccaaagcagaaacaggctctgtctgggggctgaaaaagcaggccctcatggtgctgtgtgtgataaccagttcttttacccccatcatttccatcttgaatagcttcaaaatattgcatataatgatttatattttcagttagactatttattttatatatcaagccacaattttacttaaattatttacatttatttaagccttcttttctctgcccctctcccacattttgcattttaaaatatctttattcatataccttacaactcaccatttaaaatgtacaattccatggctttcaagatattcacagagatatacttccattgccttgatcaattttagaaccttttcattagcccaaagagaaattctgtaccctttacctgccatcccctccacccactgcctcctgcagttctcccatcctccccagtcctctcctccctgcttttaaatgtttcttccaggatctttttttttctgttcctctaataaatctaatgagttttccctaatgagtttttcatcccactaatgagggtcttcctctgggtatatgcatgtctgtgcacacatggagtatttctataatatagtgtaattgaccctcctcatctttaagaaattcagccaaacccagtgcagtggatccagtactgaggagcacacagaacactagctactttttctcagtgacctagtcctagagaacatttgcacaagtacatgtttcaattaggaagaagcaaatgcttctagtgaaggatagagagactctgaaatgcatgtacgaagcaactaacagctattgggcacccaccaattactatccctaatattggcatagcacccccacagttttcaaagcactttccaggctttatttcatgtgatgtacaggacactgtgttagaacctctaatatggagggatatggacattgttagaaatgggaccagtcagtgtccaatatagtctttagaaaaatgtagatcactttcatgtctctttaagccaattcccatctttgctttctcaaagacttttacatgcatatgaaatggattagctttatttacagcaggtctgcaactattcagcaattaaaagacataatctcttataagacatactactcctggtacagcagggtgactaaccttttgaaggaggtctagccagtaacagctttggaatggtcactaatattgtgggaaattaggtttgagaaattgtaaaagacatcattcatttattactctgttaggtcaactaggaaagaccggctggtaaccacagttgtttgtttctggcaagtttggcccacaggttttggtaaattaaaatagtggttgtgcagggtatggattttatgaaatgatataaagtagaagattatctctggtctggagtgaatataaattggtgagagaatgatgaggaggagttgatgaaaggaagagcattggcctagaagccaagattctgctttcaactatttgggcttttcagcaaataacatatgcattctctgcatatgttaaaaatcaagtataaaaacatttaatgccttggaaaaatatttataaaatattatttctaaaaataagttatcagcttacatgagagtactactttgtaagaagacttaaaaagtataggctgggtggaatggtgcacacttgtagtcccagctacttgggaggctgaggtgggaggatcacttcagcccgggtgttcaaggccagcctggtaacatggtgagatccctgtctctaaacaaataaaattaaattttaaaaaagaatgtgaccaaaatgtgtttttttctcatggttttatgcattgtaccagttttctaccacgattatttttgtaaatgcagcttgggggaagactgtggtcattaatctatattgaatacaattttataataagagtttcagaagttttttgagcaatggaataagaacatgatctgccaaggaactaatttgaaaccataaacatccatttaaaagcagtaggcctgacaaattagtcactgctttttaaaaaatagaatttattttttagcgcagttttagattcacagccaaattgaacaaagtatagagaattcccacgtacctctctgcatgctcaccttcccccactgtcaacatcccaaaatacagtggtatgttgttaaatcgatgaacctacactggcatgattatcaaccaaagtccattttacatgagggttcatgcttgctgttgtacattctgtggttttggacaaatgtataatgatgcctatcggttactataatctatcatatagaatggtttcgctgccctagaaatcttgtactctacctattcatcccttcctccccgcaacccctggcaatcacttatccttttactgtctctatagttttgccttttccagaatgttatctatttggaatcatacagtatataggcttttcaattggcttcttccacttagtgatatgcatctaaatttccttcatgttctttcatggcttgatagctcatttcttttagctctgaataatattccattgtctgagtataccacaatttatttatccattcacctactgaacgacatcttggttgtttctaagttttggcaattatgaataaagctgctataaacatccctgtgccagtttctctgtgaacataagttttcaattcatttgggtaaataccaagggttgcaattgttgggtcagagtaattgctgagtaagagtatggttagtctttactttaaaaaaacctgccaaagtgcctttcaaagtgtttgtactgttttgcatcccaccagcaatcagtgagtttctgttgctctacatcctcgccagcatttgctattttggattttcaccatcccagtaagtgtgcagtggtacttcactgttgttttaactttccattccttgatgatgtgatgttgtcttttcatatgcttggttaccatctgtatatcttcttttgtgaagtgtcagttcatgtgttttgcccatttttaagtggattttttttttagtgttgaatttaggagggtttgtctgtgtttgtatattttggataccagtcctttatcagatacgtcctttgcaactatttctctcattctgaatcactactttttatgtcatctattttataggttcgaggattatatttttaaatctctttttcttttgaacttctgagagccctgacttttatttattttagactaaattcaaagcaacaactagcttttgaatggcagagagcaaaatcgatcaaacaagtagtacttactatgctcccttcacaaacattttgaaacacaggttgccttatttgttgtgttttctagcactctgaataaaggcttatcatcttaagcaataaaactttctatttgaattcttttggatggatatgtttataaaataggttactgttttacctgcctacttacattgcaaatattgagcataactgaacctcttcattatgactttaaatcataagataatactctaaaaaacaagaataagatgctatgaaaaaagaaagaatcagagaataagaagaagctcctggaaattaaaaatgttattatctaaataaattctgctaaaaaataaggccaaggaaattgctcagaatatagaacaaaagagacaaaggaatggaacactgtgggaaaaaaagtctttaaaaatcagttcaggatatcccctatccaattaataggtattcataaaaataaaccagagaaaaaatagtgaaataatttaccaaagaaataataaagaagttttccaaaaatgagaacatgagaatttctagcttgacaatggctaggcagtgaatggaaaatgacctacaccaaagaaattgtgtaattttagaaccctagggttaaaaatgagatcgtaggctgggcgcggtggctcacgcctgtaatcccagcagtttgggaggccaaggcgggcggatcacgaggccaggagatcgagaccatcctggctaatacggtgaaaccccgtctctactaaaaatacaaaaaattagccgagcgtggtggcgggcgtctgtagtcccagctactcgggaggctgaggcaggtgaatggcgtgaacgcgggaggcggagcttgcagtgagcagagattgcgccactacactccagccccggcgacagagcgagactccgtttcaaaaaaaaaaaaaaaaaaagagatcctaaaagcttcctgggaagaaaaattacattacatgcaaaggatcaggaataggaatggtaatgttataccttttcaagctatcaagcttaaagtagaataaagacactttcaggcatacgaattctcaacatttatctcccatacacctttactcaagagaatgtgtgctattttttgttgatgttgttgctttggtaatttacgaagaaaagaggtttaattgactcatgattccacaggctgtactggaagcatggcggaaagtgtgctattaaaacaagagagggaccagaagagaaagattcagtttctaggggatccaatgcaagaaaatgtcaaagggaaatcccagaaaaagcatctattgcaggtcttagagtcagtctctagagtagaacgggaggatagaggctccaagagggaagcaagaggtgagtgagtagaaaggacacaaaatcttatgtatttgatggcatgggaagtgatatgagatgtgttagtgttttgattattaacaatacgtatgttgaaaagtaacctaataaaaatggggtggttattcatttcaaaaaaaaaaaaaatgtacagaaatggaaaagtaaccatggtatttttggctccacagtgaacaacttttatatggtcctaataatgtaatcagcaaatattgatccaactgtagggaaggatagtttgaaaagggtataagacagcttagttctcatctgtcttaaaggaagtgaatagttaatgcctaacacacatatcatgaaacaatgatatattatttagaaacatggaagtacatatcagaagaaacagctaaaataattaaggttgtttcctctagggcaagggtgtccaaacttttgtgttccctgggccacagtggaagaagaattcccttgggccacacataaaatacactaacactaatgatagctgatgagaaaaaaaaagcaaaaaaaaatctcatgttttaagaaaatttacaaatttgtgttgggccacattcaaagctatcctgggccacagacaaaaaagtagagaggtggttgccaggggctgggggcaggggagatgtggagttactctttaatggaaacgaagtttcaattcgggaagatgaaaattttctggagatggatggtggtgatggttgtacaacaatgtgaatgtatttaatgacactgaactgtacacttaaaaatggttaaaatgatggccaggtgcggtggctcacgcctgtaatcccagcactttgggaggccgaagcaggcggatcatctgaagtcaggagttcgagaccagcctggcgaacatggcaaaaccctgtttctactaataaagtacagaaattagccgggtgtggtagcgggcttctgtaatcccagctactcaggaggctgaggcaggagaattgcttgaacccgggaggcagagtttgcagtgatcggagatcatgccactgcattccaacctgggcaacaagagcaagattccttctcaaaaaaaaaacaaaaacaaaaacaaaaacagtttaaaatgggtccggtgtggtggctcacgcctgtaatcccagcactttgaaaggacaaagtaagaagattgcttgaggccaggaatttgagaacaacttagccaacattgtgagactctcatctctacaaaaaatatagaaatcagccagattagttttatctaggtggtagtgtgcacctgtagtcccagctactgaggagactgaagcagaaggatcacctgagcctagggagggcagggctgccatgagccctgaccataccactgtactccagcctgggccacagggtgagaccctgtctcaaaaaaaaattaaaaaagaaaaaaaatggttaaaatggtaaattttatattacatatattttaccacaataaaaaagcaacttagaaaaaaatttagtattatttgattttcaaatatttatatgcatattttaatttcattataacattaatttttagaaaactctgcatgaatgcctgaaaaatgttttttggtttttggtttgtttgtttttcttttcttttcttttcttttttttttttttgagacagagtcttactctgtcacccagcttggagtgcagtggcaagatcttggctcactgcaacctctgccttccaggttcaagtggttctcatgcctcagcctctcgagtagctgggattacaggtgcctgccaccactggctaatttttgtagtttttgtagagatggggttttcccatgttggccaggctggtctcaaactcctgacctcaagtgatccatccgccttggtctcccagattgctgggattacaggtatgagccaccgcacccagccattgaaaagtgtttctatgtatcatgaatataagtgtttgtgcatagattttgtgatgtaatttaggccacacaaagaccttttatggcttttgtctagttcttacctgtattctacttagataaagatagataagttattttcaaataagggaagtattactgaacatgactattttgtgaatacattttggggcaatttgagataccagtttcctaaatgtagcacattaacactgtgaataagtgcacggattcatccagtttgagcaaagaccttatcatacaggagttgtccttttatggcctctgctattctcagtggctattctaaatccttgcctgtgcagtcacccctgaatggtttgtgggaactcatctctgcatttggcaaggactgggcggggctctgagtgaactacagatatggtagcaggtaagtgcctgtgttgtcacagatgatttctggctcacagctgattatctttttctaatcagtttccttaacctggtcccaatagtagtagatgtacatttgtttcttcacgattataagcaataaaaggccgattggctcggcaggaagaagtccaagtggtaaagagcaatcctaattaaaatcattgtcccttaagtttacaattgagaaggcagctgtgagaagaaaataacaatggaaaacaactttatatgtccttagagacttcaaattgctttccagcctttaagtcatgctgcttggctttgacaggttacatttaccttccagggtttattgccgtaggagcagtgttattttttgttgtcatcctacctaaattttcctctgttccagtgcgagatgaggacagaagcacgacgaaaaaatcttctcattttgatttcgcattatttaacacaagaagggtatgttacagtacaaacatttatagagatgattcctctttctctgctctctacttttccagatgcgtacttttaaatacaatagactttcttgtttagagcaattctatatttacagaaaaatcgagcagaaagtacagagttctgtatgccccttcccttttccagtttcctctcccagtgacatctgtattgatgtggtttattactaccgttgatgagccaatacattattaactgaagtccatagtttacattagggtatactctttgtgttatattgtgctgtgagttttgacaaatgcgtaatggccatgtatttgccaatatggtaccatacaaaatcatttcgctgccctaaaaatcccctgtgcaccaccgattcctcctcctgccccaacaacccagacatacactttttttttcttttgagacagtgtctcattctcttgtcaaggctggagtgtaatcatggctcactgcgacctctaaccacatccccctgctcccagcctccccagtagctgagactgctggtgtgtaccatcatgcctggctaatttttgtattttttgtacagacagggtctcaccatgttttccatgctggtctcaaattcctgagctcaaatgatcagcccacctcagcctcccaaagttctggcattacaggtgtgagccactgcacctggcttcagacttatgcttttattgcctcatttacctagatatttttcacattagatgttgaaaacttttcaacagacctatccagtacataaagtacttttcctttcctctacacatttgaagatagcacagaaatgaggtttttctatagtctcactgctggctatgtgcacaagataactttcttaatcagtttttctttcctcaaaataaacgtattgcatttacttggacaacctaaacccaactctcttcttcctcgcaatgcccattctataactggcagggtgaggaaatttaaaaacttttgggtttggccacctacctcattaaaaacacacaagcaattacagtaagggctgctgctactgtgctggatgatataagagtaagagagctgctccacaaagtgtttgaagggcactatctactttatattcgcttttcttttcaaatttcagccaggaagaaaacatgtaggtttcagactaagagcttacaaacttttttttttttgtaacagatgggggtctcactctgttgccagggctgcatgatcatagttcactgcaacctctaactcctgggctcaagggatcctctcacctcagcctcctgagtagctgggactacaggcacatgccaccatgtccagctaatatttaaattgtttttagagacaggatcttgctgttgctcaggctggtcttgaactactagcttcaagtgatcctcctgcctcaacctcccagtcactgagattagggctttaaaacttttgagttagagcagtggttctcaattaggatgattttgttccttgggagatatttggcactgcttagaggtctttttggctgtcacactggcatctagtgggtataggccaaggatactgccaaatgccatctgacgcacaggacagcccccataacaaataattatctgactttgaatgtcaacagtgccaagatggagaaatctggagttagagcaagaaaaaccaatcaatttttgatattttcccaaaaagtctgataagcatcttttcctccattaaataagggagctactggaactaaaagtcggttttgagactccagtgaccctcgtcctggagaggtacaaaggaaaaaggtgaggagggcaggaggcagttgacaacgaactgagagttcccattgtttctcttacccatgccagcaaccactgctttcaataaacctattgccccctagaaggaaatgagtgcccccgtcccatggttagcagacaggcaggccatcagtcacttctcagcttaggctcaaactctgtatctccacatagcagtggggtggaattgagccccggagcagggcagggctgactttggtctttctgtgcctctgtttctccatctgggctataagagcattcctgaaattgacaagccagacagtctgcatgtgggtagtgggctgctctgctctattcaccaggcacttaagtaaagtaaccccaagggtagcatatgagaaagtgctaagtgttcaatctatgacagggctgtggggcttgttgtcatagggacggcttccaggatatgcgtataaacttagaagccagactcttttttttttttttttttttttttgagacggagtctcactctctcgcccagcctggagtgcaatggcgcgatctcggctcactgcaagctccgcctcctgggttcaggccattctcctgcctcagcctcccgagtagctgggactacaggcacccgccaccaagcccggctaattgttttgtatttttagtagagacggggtttcaccgtggtctcgatctcctgccctcgtgatccacccgcctcggcctcccaaagtgctgggattacaggcgtgagccaccgcgcccagcccagactattttctttcaaatgtctgctcttccctttgctaatctgtgatcttggacaagttacttattctctttatgcttcagttcccttgtctgtagaatggagtaatggggtatagctaagtatcaggtagatgccattattacgaggattaaatatgtaacatgcttagaatcatgcctgacaattacacttatacttctattattgataggatttgggttttattctcttaatacccaacttggttcagcaaaggacttaaagaaactggaatgtgggcttggcccattttacatcatcttttgatggaatctcagctctatccaaagaaccctgagttaaaatacctcaaggtgcttttctgagtgtgtgcagcacttggagcagtagttatacagaatattaataggtgttaaagagttttgtggtcaggtaagcttggcagatattgggttaaattaaactaggtccctcatttcaggacttctcagaccatctgatttactatgtgcaatgagaatatcatactaaagtcacagtattcaaggttttgcaaatcaatttggccaaagcttttccagggttttgttattgtggttgttgttttggagacagggtctcacctatcatccaggctggagtgcagttgcccaatcatggctcactgcagcctcaaattcctgggttcaagtgatcctctcacttcaacctcctgtgtagctgaaactacaggtgtatgccacgacactgtttgtttatttatttatttccttattcatttatttttggtaaagatggaatctcgctatgtagacatagctggccttgaacttgtggtctcatgcaatcctcccacctcagcctcccaattagctcaactgcaggtgcgtgccgccatggctactttttgtttcgttgttttgttttgttttttggtagagatgagatttatctgttgcccaggctggtctgggactcctgggctcaagcgatccacccaccttggcttccagagtgctgagattactggcatgaaccaccatgcctggcctaaggaactcttttttttttctcagaccatctttagagacgagttttccacagataactttgagaatgctgtcttcctagataagttgactcttataaaacttaaactcaccatgccaggtcccagcactgtgaacatagtaacagaatctcagtaaatgttatttgcatagccattgaggaacttactagaatgtagatgggtagaataattagaaacgaagacaatgccattttcacaaattatccctgattttttattacaatgtattttttgttccagaaattgtatcagaaagaagaactgtaaaaacaaaaagataaaaataaaagtcagatgtagttgttaaggccaagtagtttgctgcttacaaagcatgcatttttcctttctgccacgagatggctctttgtatcgtgaatcaatgaaagttctactagaactgatcattttccgaaacctgctgggaaagggacaaatgagtggactgtcaaaacgaaaatgaactataggtatttttaaggacatatgagtgtcaataaaagagatctgccttaacgaagttctacaaattcagcagaggatagattactgtggattaaaataaacaatcagggaaagctttgtagagagggtgacgtgagctggacttaaaagatgtatagaatatgaatagaccgatgtgatgtaaggccattcctggcagaggcacagaggaagaaggggcacagcctaagtggaacaattaagtaaacaagaagaccagagtttgaatgtgtgagtgagaattggtgacagcagacaatggagggtcatggatgctggttcttctattaatagtcctccatatccatcttctcgggcttgggtaattttagtagcctctgcgtctctctcttgtgtcttgttattatggcccagtattgcacactactcctaaagtcccgtcctgtcgctctgttggttaagaatctctagcggctcctcctgccaaccacatcgaattcaaacctcattcaagctcagctcacttgagaccagacgttcgggaccagcctgggcagcacagcaagaccgcatctctacaaaaaataaaataaaataaatagctgggcgtggtggtgcacgcctgtagtccaagctacttgaaaggctgaggtgggaggattgtttgagcccaggagttccaggctgcagtgagccaagattgtgccactccagcttaggtgacagaacaaggccctgtctctaaaaagaaaaaaaaaaaaggttaaaaaaagtttgtaaaaacagaggaaatgttagtcattttctctgaggggcagaattttcttttgatttaccagtattttctagttttttcttaagtgaatatgtattactccatactaaagttattaataaaaaactgatttagtttttctctctgtaaaatgaggattaagacatagtatagaagcatggtgagacatgaaaaagtatagaaggtgattggctagagtcaactgactgtggtttgcagcttctttaaaattagcttaggagagatacatacatttcaaggtcattgaaaataatcatggcatcttcttttaagaaagttcaggctaggcatagtggctcacacctgtaatcccaacactttggaggccaagaagggaatcaattgcttgaggccaggagtttgaaagcagcctgggcatcataaggagaccttgtctgaaagaaagaaagaaagagagagaagaggagggctactaaaaaagaaagttttctctttctactttcctggatctagattcaaatgaaacagaaagaactctaacctgcagcagaaatctgaatctggggtccttggatgagctcctgaaattgtatgctaatttgcacatgtgcacacttttcaggagaaaattgttggttttaaaagaagttaagaactaaaatttaagacctggagagtctttcttctttcagaggattttgagacacagcccttgcttccagtgctaaggccacttatattggacagttttacaactgaacaagttaaaaatgacagtaaggaacaaagatcaaggtactacttttatacagaaacactctgaagtgcaatgtgtgactgattaaaaaattaccagaaacaaataatacattccaagtggatgttatcttatatgaaagttctttgatgatcttgattggtagatctttggaatttccttcagtgctcgagacttgttaatgtgaattacttcaatgatggcaaatttgggttgaatttgggttttatcattttgccaaatgttacctaaaatgaatacctgtgaataaagaggtaaccaagtttgggcagatacccattttaggctgcaaatgagtaaagacaaatcacaagatgtttcttggttgatttacttatttgacttttaagcacttccaaaaacatccttaacaacggtgacatcaccagaataagtatgtaactttcaaaggcaactgctttgaaagataatagttaaatatacttaacaaatatggggctctttataggcaaacctcctatgcacatactagttttcatctaatgtgctatatataggcttactttttgtattgcatccctttagacttgtaatgcctgttagccattattcttttcacctcagttaatttcttctttttattctgtgaaactgccaggtatatcgatacagcaaatgctttggagcaagaaactaaactggggttacgacggtttgaagtttgtgacaacattgatcttgaaactattttgatggaatatgagagttattattttgtaaaatttcagaaataccccaaaattgtcaaaaagtcatcagacacaggtacatgcctattttctagagataaggctttgtctcatctgtaagattagtgtttctttctcatcttattcccagatagatggagaccctcaccctgcaccaaaggagtaggccaggaggattgtgtagccattctcatatccagcacagacaactgaaatatgattacctggacactgatatccctttaggcactttggcatttgtttgagaaaatgtgttttcaggcaatgaaagcaaaaccccagtgtatcataggtacttttcagatgattagcattactttaatttccttagagatgaaaagaactgttggaagaggataaatgacagaagactttttttgtttttaggagacctattatctgtcttgaaaataactacaaaaatgagtattggggaagctaatagctcatgtatagataatgaaaagcttttgaaagccatcaatccagataatgatcaatataatataaaaacccagtataggttagcagtcaacaaggctggctggaggaaagatctaaagtgggggccctgtgctttgtagtaacattgactgagaagtctgtaagtgggggaagtaattataaaccaagggagatcattgtcctgtttacaagccacttgttaagccacagactttaacatttcatgtagggaccgggaaaccaagaggaacatcaatttaaaatagccagggccagatctcagagctagaaaaggtcaaagaggtattttatctgagctcccttccaatgcagcattcagagcttgacttccttggcaggtggttagatgtgggccttgaagagacagcccagactcctaaacacagggtgatcagcactgttagtgacatgatctcacttccagatggctagttcccatctagcatgatacccaaattctcctatgatattggacacgttatttttattttaactagcagagtatgacttcagtgttccctgccagattcgtgcaatcatcctggtgtcccatgtaatgcagcaaaatggtgtcaagttcatgaaagcgtaatgaaatggtagctgtaaagctagcctatattggagttgccaccaggtccacagtctctgacatgtttaatatctgagccctttgcaatcttcctctgtgaggagatgctggagaagctcaggcctctttctcttcgctggtaatttcagttctctctagatgagaatagcttaaagtctctagattccaattggttaaaactcaaattttaagaacaatgcaaaaaggggaaacatacctgaaaaaaatcactttgtcactcttaaaattattttctttccctcccaatgtctgttttgtcacagcagaaaataatttaccgcaaagaagtagagggaagaccagaaggtaaagtgaatggtaattcttcttaatcgactcggctcgaggagcttgtggaatccctttccagaagctttaccatcacagctctgtgactgtctcccagcaatactgactgcagtcatgtgacctggcccagcccaggacttctctcattacagctgccccagatttgggccaatgtccgtctactctcctggttttactgtaaataagtatatcctgtgatgctctgtctttccaggccatgtggtatgaaaagtcttaacctcaaaggttaaaagacccaggttcaactcctggctctgctatttacaagcatggagcaagttttggacacatagtgagttcctggcacacagtgagcacccaagatataatattttccctcttttcatcatttagttaatttcaagcactcccagatcagatgtcctgacctgtctgaagatcaacaatgagccaggaggtgtgagctcaggcttctggcttcgccagtcctgaccagtggggacccattcttctcttgcttttccctcctgttcacagctcatcttgcattcctttctccagcttctcaagtccaaatctcatttggggcttgtagcctctgatgggagcccctctgtctctggacctttttgggtgcacatattctctcacaaggccccctactcttgccagtgtccttcgcattcctctcgccccactcccatagacccctccactgtcagagctgttcagaaatacccaggggaacaagggtgctgctgccggctgccagtgagggccagctctggggcatcgcaacctgtgggctgttgctattacagtagggcctaaacctcatggaaagacacagccatccaagcagtcaacaaagtgtttaaagtcttaaaatgctcttggaaaaagaaaagttagattgtaatcacatgcaacttattaggccctcaagaggtatggattctgttatgcctccgctacatttcccacccctgcgactccagttcccttgttccagcctcagaaggaagggcctaggacactttacagggctggtgggcacagcttgcaaaaatggctgtggagcccacgcacgctccacgatcctacttgttataatacttggcctcgggctacctttgctttgtgctattctgcaggaagagttttatcgctttgacaaaagtgttattcttttatttatagtttccacaaagttagtcagactctgggtaataaatgataactgcttgtgcatagaaatcatgaggagcgtttgcagccagcttcggaaggcttttggattctatttttctggaaccttctcagcattcttccctggcaaatgctctgtgagtgaatggtgtcagagtgctttgttccccttaggcaaggagcaccgtggcacatttgacagtgtgggggctcctcagctcctctctgagtagatgtttgtatgtggcaagtgtaaaagttgaatagcaaatggttagaatcaggaggaataactaggaaagtaatgaatggtgtttctgcggacaatttatactcaaatatagttactaaaatgagacatgtcatgagactggctattagcaaatcaaagtgtcttttcctaatcttggaaaagatttataatccccacttaaagatttgctgatgaaccaagggaggaaaggttatctaatgtgatggatgacagaaatgggatcccaaaagatcttggcaattccagagatgggttcaaagtaacaagacgaaatttaataaaataaggtttaagctctaacaagagttacaacaaatagctcctccattacaaaatcagagacctggaaatctcagtttacctgggccaacagtgtgacatgagtgctactgtggtcccagccccatcaatagaaatacagtgtccaaaaaataggaggtcacactattctggaaggtgaccagtatgaggaacaatctgggaaccaggtaactttagaaatgactagagcaactgcagatgttgagcttgaacagatggctggtggaggggcactccttagaacattgcaggaacaggcttcagttcaccctctaaagggcgattgggccttttctgccaaattccacagggtgcacctaggactaatggttaaagtcaaagcagagtgaatttggttccatgttcagaagaattttaccatcctcagaaccaatttaaaataaattgcattgctttgtacattagtgctcttgtattttggtcttgttaaagcagatcttggggatcagttgcatccaatgggaaatcaaagtgggaatatagaatccctgtttcctgccagctccacaaggatggtgaggcaagtttaaatacagacacacacacacacaaacacataaacacacacacacacttccacacacacatatataacttctcttgagtcaacactattaatataagtttgcatttgtaaaatgcttggttttcatttcatagatattttatttttgtgccagcaaaagggtagagaaagacattcttattcctagtttaaagatagaaaaaaaaaaccccaagaactgttagtgtccacttctcatgacgctctccccagtgagaccaacactcacagatgtgtcaccatgtggacattggtggtgttatcgacatgtgtggtcttgctggccaaatagttgtgcatttatattagacatgaacatttattatccccataaagaaaggaagttgaaatagcagctctctgagatcactctgaacatggggagacttgcttctaacgaaccttctgcaaatgcatctcacatatggggacaaaagtgctaagagaactaagcaacaatgtgggagttcatgttctgcccccacaagctagtcctgtctctctctggatggcatcttctacagaaaaatatggatattccaatactgaattttatatctaattatgaggatgtagtgaaaaaagtgatttgatctttctatggatatataacatatatacagtcataccacatatataactatgtatacagtaaatgtatatactcttgtaaccacagttacagccaccggcaagctacctttgccccttctcagtcaaattctccccatctccatcagagttagctactcttctgacttccagccccatcagtttgttttgtctgaagtaaacaattgttgatgaaaatttgtttggcaaatatgattggtctgggacaacattgatgaagggaagtttgttttccttctgcaatccccttttgatgtttattactcataacatgctgagaggtattttaagtaggcagggtatatccaggacactggattaaaaccatggggccaatccctggatttcctactgtttcttagtttgaatgggaggactcctttctctctcacacctttctcctggtctaatgctccttttaaggaaggtggaaggaacaatggaagaatgcttgtaaagtaatgtattcttaagaactaaagctatttgcagaagggccgaagctatgtggtgtgaaagggaaatgaagagggtgagttggggggctcgaggaggcaatcttagaagaacccagtgagtagcctggagggtgttagggccaggatggacctggtgggtggatcacataggtggaagggccctatagttgccacctgcatatctttcaatagctttcttaaatgtgctattcttaagaatagttgtttaactacctcaaattaagtggctagaataatttcttccaaggtctttgttccctcccttaggatgatgaacgacagttgtcaaaatcttcccaagatcaatcagcagaggccccggtccaaaaccacagcggggaagacaggggacaccaaatcgctcaataaggagcatcctaatcaggtcaggatggcttggcttgactttgtgaacagcacacttggctgaaaaatagccctatgaaaaaggtcacatttatttattttttgaggacctacgcttttaaaattgctgtgtgatctaattgaattttaggttttcttccagtacactggactaaaaccatggacatatccctagatttcctaatgtttcttaacttgagtgggaggacttttttctcctccaagtttttcccctggtctgggtgctgggtgattggccagggtggggccagggcccagtcagagcgggaaggcctggttgccttgatcctcccatctgaggtaactattacctgaggtaactgagctaaccaagatggcaggtcttcccatcccagagcacattgctaggttcctaagtgtaggccaggcatagcctacactacatttcaggtatggctgggtctcaaggtctcctgttgggctcctccaaatcgcacatggtcagccctcaccccagaccttcatgctggacttcctgggggccaagaagggcagcaaggagagaatccagcaggtgagagaagtcaatggctcctgactcaggaggctcatgtccagaaccttcttagttaggactaaacatcccaggtttcaaaggaaagaggaccaatggaaactgagaaaaggaattaaaaaaattaatgtcaaataacggaaaggtataatcacaatatccgattggtcaaaaggattctctccccctcaaggaggtcctacggttctggccgctgcagcctgactcatgtggaagagaggtgaaggtggggcaggatgagtcccatgggaggctagttgactctgccatatctccaaactcagccactcctggccaaaaacacccctgatcacaggagaaaagacgagccagcgaatggggatgggttgaggcacaactgtttgaagcacattggaaaagctgcttggggcccatggggcctggcatcttctcagtcttccagggacaactctttccacatagtgcaggcagacagctacttcatcttcctgggtctgcacaaatgtggctaagctacatgtgcatgtcgcgttcacagaattgctatccagcatcggactttgcttgatggagtaggcaggtacatccagcaactctccatggctgctcacagccgatgtgtccttgtctctctttcttcaggaggtagttgataacactcgcctggaaagtgccaacttcggcctacatatatcaagaatccgtaaagacagtggagaggaaaatgcccacccacgaagagtaagtgaaactcatgaacctaacactgaaagtggtaatttctttttccttttaaacatgaaaacaaaaaacattatttttgtcaaacaggaaagttaagatgtgatttttgaaggttggctgtgaggtaaatggagaagagcgtcagaaaatgggttcttctttggaatctcctttctgaatgaatgggctggcatgaactgccccatctctaaggaactcagtttccacatttgtaaattgaggggcttggaagagattgtctctagtgttcccatcagcttaaaaattctgtaataacaatgacaaacattggcatgatcatcctgcatcgttctcatcatttttttttttttttaagagacagggtcttgctctgtcacccaggctggagtataatggtgcaatcatggctcactgcagcctcaaactcctgggctcaaagaatcctcttgcctcagcttcccaagtagctaggactacaggcatgcaccacaacatccagctaatttttttcatttttctagagatggggtctcactatgttgcccaggctggtttcaaacttctagcctcaagcaatcctcctgtctgggcttcccaaagcgctaggacatctgcgttatttagtgagttggaaacgcatactcattctgctctgtcctgtcagtggcatttgattagtggtgtcacctttctccttggagggatggctcctggtctaaatgtaatttcatgtggaccatgaaacatcagttgatacagggttgattttgtccttgatagatatttttacctttttcataatgaatctcatgtctagatttctaaataataatgtcttaagcagaaaagacccagattgggtggatgtagtcaaaaggtagattaaaacatgtaatttggaaatgaattgcaccatattgctcttggtcatactctccaaggttgtagttctttaagcttcttctttcttcagccaagtgctcaaacctctggagtgctgacttagttctggccagctcttagaaaaactgaactctgtgtgtgtgaatttggaggggtgactggagcatatccctgaaaatcaagagcagtgacctcactggcctgaactgactccctttaagggcctcacttacatggtaattgctgaagatgatgccatgggaatcaacacctcccttggaaaaatgtctccttgttcaccttcactgcttctattgtgttttcagtcacctttgcctagcttttttgtggcataagtttctcttgtgaatgcctcacattgaaatgaatggatgtttttgattgggtcacaaggaagggaccatttaacccagcacttaacctttgaaatagtctgactataaatcctcttaccagcagaaatgtcctcaaaggcacaatgtagatggctttctccctagcatttcatatgtccataggttgtatgagggtatatggcctggggccaatctcagaaaaccccaggtctgtcatttctatgttagtacctgtgtttgtctgttttgcattgctataaaggaatacctgaggctgagtagtttataaagaaaagagatttatttgactcatagttctatatggcactgggatctgctcagcttctggtgaggcctcaggaagcttttactcatggcggaaggcaaggggacctggcatgtcacatggcaagagagggaacaagaagggagggagatgacctgctcttataaacaaccaggtccctcgtgaactaatagagtgagaactcactcattacagtggtgagagcaccaagcctttcatgagagttcctccccaatgacccaaacacctcccaccaggcccacctccaacactggggatcacatttcaatatgagatttggagggggcacacatccttactacatcagaatccaagctttaggacaccctccctgcaaatttagtaggtatgttgttcttgagggcataggcttcagagtcagcctgtctagattcaaaacctggctcagatgctcccccactatgtaactttgggcaagttggttaagttgttttataatttctccaagcctcatttctctcatctgtaaagtggaaataatcatagcgtcccctttaagtctcatgatgaaaggagagccttggtgcagtgctagcacatagtaaacactccataaatgttaactattattattatttttttttttggtgcatccttgctttttccttcctacctctaggggggacagggtgatattggaaggatcatgggttgggagagagattaagtgggtttaaatcctggccttaagccatttattagctgtgtggccctgggcaaattacttaacctctctggacttactcccacatctatgaagccaggatgtcactcctgactaacagaagtgttataagaattagaagtaggctgggtatgctggttcgcacctgtaatcccagccctttgggaggctaaggtgggagtataactcgagctcaggagttgggagaccagcctgggcaacataaagagaccccacttctgcaaaaaaaatttttttaattagccaaaagtagtggcgcacatatgtagtcccagctctttgggaggctgaagtgggaggatcccttgagcccagaagtttaaggctgcggtgagctatgattacgccactgcataacagagtgagatcctgcctgtctcttaaaggaaaaaaaaaaaaggattagaaataatcctcacaggatatggagaaaagggaactcatacattgttggtggaaattaaattaattacacttatacccaataaatttatacaaattatatacaaaaataacaaaaaagaaatagttctcacaaagaacctttcacacttattttgtacccagcactctattgagtggtgaacgtgtatcacaatccatagacaggaactctcattaccattgtgccaatgagttctttctgcatgtgtaatattttaagaggataagaccatacaggggaagtcaacatataagggaggaagcagatggtctgtgtcaggaactgagaaatactcatgaatttttattcaaatccacttcattctggaaaatgtacttacaattttttaaggtgctccaacttgaggaaatcatcacgtttaatactagtgctggttctttttaaagcttaacttgaagtttgccctatataccagggtctataaatgtgtcttggtttaatgaaactgagttattaagaagagtcttctcttatgttctcatggcataaataaccattcctccctttcagggccaaatcattgacttccaagggctgctcacagatgccatcaagggagcaaccagtgaacttgccttgaacaccttcgaccataatccagacccctcagtaagtggcgaagatgtgacattcatctttcaaattgccaacatccagatgaactctggaaatataattttgagtacagtgaaaccttgagatcaagttaaaggccatagccacctgccatcgtttgtttcaccaagacctgtgcatgcccggggtttcttcctaaattatgaagcaatattgtaatgtgagcctttccgctcctctcatcaggaacgactgctgaaacctctgagtgcatttattggcatgaacagtgagatgcgagaattggcagccgtggtgagccgggtaagatctgatattcaattcacaaatttatggaggcaggctggggcttctggagctttgtgggctgcttcttttattaataacaataaatatgatcatttatttataaagtgcccccacttgcgcaggcactcatattgtttagaggcacaataatgcatgataaataaattatagagtcataaaattacaatatacaaaccccaccatctcatgatagaggccaagaaaaccaagagagaaaaagacttaggaatgaagggacaggtgaaaggttttatagcagagccaagagtcaaggaaagaaagcctcttaaagaagaaaagagtatgtctgcatctggtttaaaaagtcagagcctagaaatagagacgtcgggagtctgatgatatcatcattgaaaatctccatgaaaaacacaattagcaggaaagactaccatccagactacggacttttccagcttgcactgtggaaccagaaggcagtgaagaacaggctttggaattagctgacctgcctttgatttctagatccttctcttgctagctgtgtgactttgggcaagttcctgggaaataaaatagattcctgagttatagggtatttttctaatttctattgcttcatatttaattgaagactgaaacctaggcaggctcagaggggggtttaaaatgatccccaaaattcacagctcctctgagaagctaagggctcctgagctgtctctgttcagctcagcagttgtttcctgtatgcctcttgtgtgtcaggtgtgtgctgtgggctggagacacaaatgtgaacgagtcagagcatagtccttgccctcaagagtttctcatcccagggacaaagtgcactttaagagcatgaaggagggaggggtggggaaagtgttaggaaagaagacaggaaatcgctaagggaaaaagtggaagagggaggctaggagctgttctgggcataggcacttccatgagaaattgcagtttgtgcacatgtcctgtgggccacctaagaagcagggagtggtggggaacgggtggagagaggcagggttcctgaggaagggtgctgtgagcagtacccagggctgagaacacacctatagaagaggggaccttagaaaggcgcccgtcggaggatgggatcatcccatgtgcttgtggatggcttgttctatgacagtgagatgaatgaatagcaaagaaaaggagatggggagaccatctataaggtttttaccagtgagaggggatgagggactgagccaggctgcagtaaccccaaattaatagtctcattaccatttttgcaaaagggtaacatgactatgaggatagaactatagagtggaaatggcctgagatgattccatctggaatcctttctatagtagcataggaggtagaaaccctgctcctgcttgaatgcttacagtgacggagagctcaccacctcatgaggtagtcctgttgagttctgactgttaactttggattgatacaaggagaaactgtcagttgggaaattaaacattaccttgtggaactcaactctagaagaggtcaagaaatactgctgttatctatggatgcttttaatacctaggtaaatgaatcttccttgtgtgccgagatttcactaagaaaggacggtaataagaatgtgagtggctggtgggcctgcatgtagatccaggctctatagacagaataaggaagactgagtcctttctctacccttcaatccaagaatggattgtaaatatcatgcatgaccaaagtacttttataaatactttctctagaccagatgcagtggctcacacctacaatcctagcactttgggagactgagatgggtagatcacttgaggccaggggtttgagaccagcctggccaacatggcaaaaacctatctctactgaaaatacaaaacattagccaggagttggagaccagcctgggcaacataatgagaccccatttctagagagcattagctggtatatgtgggtttcccaagatcgactgtgggacttgagtatgcacagattttggtatgggggagagtgtcggggggggaacagggagaggttctggaaccaatctcttccatatgcccagagaccatttctagagaccccattagctaggcatggtggcatgtgctggtagtcctagctacctgggaggctgaggcatgagaatcacttgaacctgggaggcggaggttgctgcactgtagcctgggtgacagagtgagactccatctcagaaaaaacaaacaaacaaacaaacaagaactttctctaataaaagtgaaagttggctgggtgcagtggctcacacctgtaatctcagcactttgggaggccgaggcagaaggatcacttgtgtccaggagtttgagactgggcaacatagtgagactccgtgtctacaaaaaatgaaaaaaaatagctgggcatggtgtgtgcctccttgggaggctgaggtgggaggattgcttgagcccgggaggttgaggctgcagtgagtggtgatcatgccactgccctccagcctgggctacagagcgagacccagtttgaagaaaaattaaaaataaataaaaatttaaaaaatttaaaaaaaattttaaaaaaataaaaatgaacctcctatggtggagggaactggatgggtggggagcaggagtagcacaaacatctcaccagcatttaaaaaatgtatttatatttttggtccatgtgcatatattacttattaaaaattatataaatataataattagtttcagattttttctgtagtcactcagaatgactttggaaagaaggcttttcaggcttttttgaggaaacactctagatattcagtttgcctgaaacaactcctactgagaaaggccccttagtgactgctctgaggcgtctggtgaaattgaagtttggaaactgtaaattagttatcagtaaaagctaccttaattgattatcctagatggttgctacagggctcttctataagaggagaaaaactgcactttcgctcggttgtcagcttccttgaattctgtagaagcaattgctcctgctggaagtagggaatgatcgctagcgaaaaaagagaaattggtttcagaggagcattatctcctttatgcaacaaattaagaaagtgtttgtgagatcaaggagcaagagcaaggccaggcactggctaggaactatgtttcacagtaaaacctaatgtaagttgaaggcatattctgtagcttctttaattatggttataaatcagcatggtttgctattgactgaaaacaggtagagtctgttgttaggagatttttttttctctctgaaaaataccacaatgtgttatcaatgtcttcttcagggaaaatcattgaatattttcatggcatacctttggtgaactaacccaaaattacaatgtatatatgtgtttatatatatatatatatatatatatatatatatatatatatatataatatgaacagtttttatcaccagcactttatatcctattgtaagtcaagtattctgctgctcccaagtttattacagctgtagaggaaaacatcagttttaaaaaaatgatcaaatgtgcattgcaggacatttatctccataatccaaacataaagtggaatgacattattggacttgatgcagccaagcagttagtcaaagaagctgttgtgtatcctataagggtaaggacgggaagcctcttgggggttatttctgttcactatccattggacaagctgtatgtcacacaactatcaggaagggaagggcaggatgattttctgtccacacgttaactctttgcttgtgtcacagcactttctcaaccctggagcaccaaagcctggtccattctagatcatttaaaatcatattacatattagttcaagacaggtgtctgagctaagtgaaactttaaaatctaagaccatagtatacatgatttgtcagattgattcaaattagcctgctcccttaaaaatattcttattgttgtagaaatacctctggtaggggagaatctctcactttgtttccacagatccttcctttacacccctgcccccctgacctaccctccccaggatcgtctggggctttgcttctggctggttgtgaagactagacagccccttccagggcagtgaccagcaaagccagcctgttgtgctcattacttattactgacaaatctctgtgcagtttacaaactgggtagaaaaatagaaaaacaatactctccatgtttgatttacaaatgggttaatgaggagataagtgataacttagcttttgttgtataacagaccaccccacaacttagtgccttaagacaacaatttatttgtttgtaattccgtgggtaggcagttggagctgggctcagctgggctggctcatctcttttccacgtggtattcttggctgagctcaatcacaggtctgagccatcagccagagtagctggaaaagatggagagactgaaaaggctgggacaagcagtacggccaaggtgtctctccatgtggcctccatcctctagcaggaaagtccagtcctgctcacatggtggcagtgggttcccagaaagaggcaagaaagggaaagttctaattcacaagcatctttcatgcctcttatatttttttgctagtcttatattttcaagtcttttacatttgctaatgtcccactggccaaagtcacagggccaggcccagattcaaatgttggagaaataggctccatttcttgatgaaaggagctacaaataatttgtgaccattttctgtaatctcctgctgttaggattatgaatttattttattgaataacctatttagtcttaaaccactgagcccatgtggcccctgatttttggatgctttcctctaaggagacaaaaatcaatacatttggattctcttttccccctctttctttctgtgttcacacttaagggtaagaaatacactagtgttcagaattaatagaaatttactcaccttttcctctaaatggaactataaaacttttaaaaaggatagaacatctcactgaaattccctggatttgttgtccccatggcattacaagctccatatgtgtggagatttgacatcaggattagcatgaaactaatagctagttgtaattttactaatattccttgccacaccctctcccccattctctaccaacccttgccacccacattcccgagattgtttgaatttgaactaataggagagacttcctgaaggctacgcatgtcctgttcagcgttggtgtctcttaatgcgtttgcccctgaatattcccaacttccaaaacaagtttcaccgtagctctgtactttattcgaataaacctttactaattggttctagtatgtattttaaagttcatacctgctttacaacattcaaaagattgccaaatgctctccgtatagaagtctggggaaaacgatgttatgcatgtaagaaataactgtttaacggagaggaagaaatacctacatatacctttccttccaaaaaaattggtcctttaaaaagctgcaaaaattgtcaggcattctaatcaagcgtgaaaataaaattgggatgaataagatctgtttatttcggtcagaagcagacaaccttaagcaaaaaagggagccctgaatcttagagctgtgctgctttgacttcagctttcccagcttgtctgtgctgagagtatgcaggctgatgtgttggtaccaaacctcatccttgttccttgtttccttagtatccacagctatttacaggaattctttctccctggaaaggactactgctgtacggccctccaggtaaacacagcttcctattttgatgtcagtgttaagtgtgtgtgcagaggatgagttgccccttctgtcctcacttcaggactggggcacacgagagctgagcagtcacttccttccttgtgtgtgagactgacttctgtctataagcagggggatggagttgaaatgcctgctcatcttttatgtgtttctctttaggtacaggaaagactttactggccaaagctgtggccactgaatgtaaaacaaccttctttaacatttctgcatccaccattgtcagcaaatggagaggggattcagaaaaactcgttcgggtaggaattcttaattttgtttttaaaaataagttctagtgtaatacagtggtacaaaatgatgtcagagcttctttgcttttaggtgattttatgtgagatctcaagatccactcctggatcttgattaccagcagcttgggaaatggattgtctattacgtgtggatgttaattgtgcccccatcagcaaaacatgatctcccttcctttgggaatttgatcaacagctctttttttattcatgcaatttaggcatgaaagctgggggaaaaaaatctctgacgtggcatattttttcttcattcaagaagtatttattatttaacatgtacactatatttggttaacatttattgagaggctactactgtatgttagtccctatgctagatactctaagaaagaatcaagaaactttaaacttcattattctttcagatgttctgagcacctttgcttccatagtgcccatagcctgtaagattttttgctttctttttttttttttttttagacgaagtctcgctcttgtccccaaggctggagtgcaatggtgcgatcttggctcactgcaacctctgcctcccgggttcaagcaattctcctgcctcagcctcccgaatagctgggattacaggtgcctgccaccacgcccagctaattttttttgtatttttagtaaaaaaaagggtttcatcatgttggccaggatggtctcgaactcctgatctcaggtgatctgcctgcctcagccttccaacgtgctaggattacaggccaccacgccaagcgattttttgctttctttcagaggttgtttccatctttacaatatcacatttatagttgatgttatattttatattataaaatggtactgaatcttccaatgacattaagagcacttccatttatggtttaggtcccagtgtaagacaggtccttctttgaaatcctgttaaactatcacgctctgtagaatggcagatatgtaatcaatataagtgaatataaaatattacgtattttctgaaaagtgattaacaaattatgcttaaattacattcccttagatgactgtttcaaaatatgatggcctatttggaagtcataatagaatatgtttaaaggattgattttcctaaaataacctattatctattaccttgatatcattttcaagttgttgtaaatatgtaagcttatgtaaattcttgttacccattcaagatggtaatttgtggaaatctacattgatatcttctatttctttgttcttcatcttgcatctaactcagtgccagttccgaagatggggcttgaatttagctgcacctacagttatggttccatgtgattttagttagctggaggttcagttacggttggcccttgaacaacagttggcccttcaactgcacgggtctacttatatggggaatttttttcaacaaaatacagtattcacaggatgcaaaacccgagtatatgtgggtttcccaggatcgactgtgggactccccagtagctgagactatagatgcacaccaccaagcccagctaatttttgtattttttgtagaaaccaggtttcaccatgttgccccggctcctcttgaactcttgggctcaagcaatcctcccgcctcgggctcccaaaatgctgggattacaggcatgagccaccatgcctagcttctccctgcctttctaaatacaagtagaaacatactatgttcccttttgtacctggcttttcccccaacttaatatgcacagattttggtacggggaagagtgtcagggggaacagggagaggttctggaaccaatctcttccatatgcctagagacgactgtagctgaaattcatctcactagaattcttatcaccctgaagtcttttttttttaaatatcatttctatatgctgaatagcaacaaaactcttaaaagataccacccagaattagtttaggttcatctcctgtcatgaaaagtggtgtttggaaccacgagcacaagacactgctaggtacacgaaggaaggtgacatactcttgagacaggacttacctagacagaagaggaaactcaggaagtttataatattcctaacaaagattgaagttacatggattttctggtttaatgttgaatagccagaaaagtcaattaacaagaattatccatcctgtgtgagcattgtatttacttaaagttttcctctggttcagtattattttgttaggattctaagagtgaagaaaagtcccagtggagtgggagcaaaaaaaattaattaaaaaaaaaaaaaagagtgaggaaacaattcctctcccaatttcttcttttttttttttttttttttttttttttttttttttttacagagtcttgctctgtcacccaggctggagtgcagtggtgcattctcggctaactgcaacctctgtcaagtgattctcctgcctcagcttcctgagtagctgggactacaggtgccccccaccatgcctggctttttgtatttttagtagagacagggtttcaccatattggccaggctggtctcaaactcctgaccttgtgatctgcctaccttggcctcccaaagggctgggattacaggcatgagccaccgtgcccagcctcttcctttcttttactatatatttttaaagtaactagccttttaaaaaaaagtataagaggatacacagactcctgagccctctctgcagaggcaactactattaacagttgctggagcagccctgcagaacatttatctattatctacgttagcatcaacaactgtttcttttgggtgttctgtttctgttttgttttgaggcagggtcttgctctgtcacccaggcacccaggccaaagtgcagtggcactatcacagctgactgcagcctcgacctcctgggctcaagtaatcttcccacctcagcctccccagtagctgagactataggtgcacaccaccaagcccagctaatttttgtgtagaaatcaggtttcaccatgttgcccaggctcctcttgaacttttggcctcaagcaatcctcccgccttgggctctcaaaatgctgggattacaggcataagccaccatgcctagcatctccctgcctttctaaatacaagtaggaacatactatgtgttcccttttgtacctggcttttcccccaacttaatatatataacttggatattgttccacactattatagataaagcatgttctttcatatgtctatatggtagttcattgcataaatgtgccaaaacgtatttaaccagtctttgcttgatgggcctttagattgtttctagtctcttgctattatgaacaaagctagagtgggcagtcttatatgtacacatttttgcccatatagtatgggacaatttgtacgaagtagaatcgccaagtcagagggaacagacatcaccgattgccagattacttgccaacagggttgtactcgcttacagtcccatcaatggttcatgagtgtgtttgcttctccacaccctggccaacacaccaatatattttttaaaataaacatttgtcaatctaataccaaaaagtaatagtgtatttcagtgattaaacatgcatttcaatatttcagtgctcgaatatgtatttctttgattctgaatgaacttgagcaacttttgaaaggtttagaaaatatttatatccttttgtgatgtgcatttttattttggatattttaaaaaataattcaagaagaaacagataacctctgctaacctcgaaggaactcgtctcatttcctttcagaaattacatcattttctctttattttctgagcttttgggaagatcctcaactggacaatcttggtcatgctgtcaggctccttactgtgaagctttcaaagaaagcaaacccttcaggaccttcccctaaagcagagaagctttttctaccatttgtttctctttctattccaattaaagagttatttatagggaaccattgggttgtgttcctccctcccctactaatgtctgtgcctcttaggagctgatcgctactgaatagttgagtggtctctttagcaaatgcatacatctgttgatgcttacatctttcaatgcaccgccccccagttgtatgatttaacttcctccaggttcctctgaaaattttagactaatgcttccagaaacacttacccatgattctgtatattccctatgagtggaaagagcaatgcagaggacagtatgaatgcctagactccaggcgtggttctccttccaactgggtgtttggtctagcagaggctcttggtctctctttgcctttagtgagcaccttaaaaacatgtacgggttttatattctaatatttcattcctcattgggtagattgccactgtcgtaatcacccttaatatcaggtatatttgggcttctttgtgtatgtgtgtgacaaggacggaaagttatttgccctgaattaggtggtctccattgtatctgaaaggcattgtgatgaatgccccagcattgccattgttctctcagttcattaaactcagccagttgttcctataaaacaggattctgtaaaagggagatgctggtgcatgcgcttgaatgtacccacgagcagtggggaaggtgaggtatttcctgttcagtgacagggagacctgtaagggatgagctgctgctgctcgtgaaaaccacaacctgactttttcagaaccctttccctctaattctgtgatggtttgctagtgctaagtgacatggagaataaatcccccatgcctattaaagaatctctgttcttttttaaatctccactgttttttcccatcaaccagtgaaggattgtatatgatgctcaagagatcagtttcagggttaaaaaaataaaggtttaggttgttatattctattaatcaccaccacatctccctttagagctctttattttgtttttatatgtctgttcttttgccggttgctttcctgttcttgttcagtctataatattttattttattctcaaatagaacatcgtattcaattgagaattgccttccgtacctaagcctaccaagcagccttgttgaggtagtgtgggaaggctacggagtaatttggagaacacaaaggggctaaatttgtcagccttgttacccatgatgggaacccaatccttcccctgaaatcctttcttctgagaataacctcccattgttcccaaagattaagggaagaattatcaaatgattatacatattccaaggctcttgtgtccatatggaacatattattggcagggtgtttcaggggttaactggccaactgcaagcttgggaacctaaatttatctgaagctctcatatttatgattagtaaccttggagtaaccacctactctctgcctctaattttatcaagtgataaatggaaataatcggaccatccaaccccatggggtgaaggtagggagaaatgattgtaatgattataaagtttttgtgaaataacagagtgcagcataaatgcttattattacagtcattctaagtttttactctgggagcatctgaggactttaagtctataagcttgaacacttgcttgcttttcccccacccaggtgttatttgagcttgcccgctaccacgccccatccacgatcttcctggacgagctggagtcggtgatgagtcagagaggcacagcttctgggtaacagacagggttggggtttttgttgttgttgttttttgtcatggcttctcccctcttgtgtgtttgatggtcggaagcctatagacatttactagcagaatgagcccattaataagcccacaaattttctgcagacacatggaaaggtctttaaattagatcctgttaactgaatagctgatttaagtagtttttataaccggaggaaatgccattctcccttcccccgttccccacagagtggttttcaggcctgaagatcctctagccccaggatcccaggctgccatatcggttctgctggctgaaaatagccgctgtgatggcctcctctggagccagaggggctgcccctggggaatgagtcttgcccactcagccactgtgcagggccacgtctgtacttcactcctgagaggcagtcctcgacggtgtgtgaagcctgggaaaacaccacttctctgtggcatcaggttatggctcagcagggctgactttaaatatgttacatatattatctctaaagattgtcactgaatatcctcagcaggcaggaacacttctcagactgtaataagccttctgtttgtgcttccaaaagccagagtagtgttgtgctttttgttcgttcgtttttaagatcagctttctgtcttgatcagaggtattttccactgaagctttttactaaatctggcacccctggcttgaaaaaacagatctctgagaaatctcaacacagctgcatttattaatgacctttaatggactatcatcaaggcagaagtaatagtaataaaacacaattaattagcttgttggaagtataactataatataatttatgaaattttactcattggaaaccattttcccagcagggaaaagcaaccataaagatgtacccaagtaatatatgggattcatgtaattgattgaaacaggacattttcctcagcttaactggagctggtgcttgtcagccctaggctggagcactctgctttctataccaggcctgatagaagcaggcaactgcacaggcacctagatgggaatgcaccagcccaccctcatagtcactctacaaagaccaggtctccctatgcacttgttgttacgtgtgctttgtcgagctctgtccccagtttcccacaaccttcatcgagctaatgtgaagactcttcatctgctatccttgtgtgtgctccaggttctgccccgaatttccatttccctgtctgggatcaaagactccaaaattaagagtcttcaaagggtcaggaaatagggatgggtgctctgaagacttcgataatattatgttaaaggaattatagttatgggcaaatgataattaaacatatagcaaatatatgggcaaatgctaattatatattatgcttataatatataataaataaattatatatatatatatatacacatatatatatagagagagacggtcttctctcttaggcaaaggtagttgagtattaaggggcatagatcctaaaaaaacatatacctagccaggcagggggcttgtgcctgaggtcccagctactcaggaggctgagggtgtgaaagtactttcctgtgtgctatgtaagtgaaagggattatcctcaattatgtcatttttaaagaggtaaataatgctgcaggtagacacagttgggctgcatttaatctaccagtgggactgtggaccctttagttattttctccagctcactgcctgcctttggttttctttcaaataccatcattatattcatttacttgctttctatcatactgtatgtgaaaataacagcaaattgctcattttctctaactctagtatgaacggctccattggccatcagaacagaaactgttctacagtcacagggacattgctgtgaatgctgctcttgtcatgagggcgaaggctctgacacttaggagaatcacgtcttgtctctctgtaggggagaacatgaaggaagcctgcggatgaagacagagttactggtgcagatggatgggctggcacgctcagaagatctcgtatttgtcttagcagcttctaacctgccgtggtaagagaccaagagagtaaattttgaatacattttcaggagtcactaagtgcaaataaaaattttatattgaccacttcaggcaaagctgtgttgtttggctgcagccctggaagattaatgtggaggctttactgttcaggtccccaatccttgctgtctgtaccacgaaagatctgccttaacagaggaaacacaggccagggtgaccattaacaatatttaaaatggacatttcaagattaaagccaaattacatagtttgtttaaattaagtaggactttggcatagaactacaaaatgcttaaaatctccaggactcaaataatattccagaaataatatgtttgaattttatagtattaaaattaaacttttttaagttaggaggaaaatcttctctttaatgctgcacagtaaatagaaaggtaaataatctctaatggaaaatgtaatctactctcagagtcttatttaaacagtgtcccagagtggtttaagaacaattctagatgtggaattgggaaataagagatgttgattagggaaaaacaatatctacttggagaatatattttaaaaataagtataagccctttatagttctgagaatgttttcacatacattatttctttcaagcttcaggcaaagcaggagacagataaagggaatgctgttcttcccattctcagaggggaccaaggtcaagagaggtcaatccaccaacatcaacaactcttgtagcctagctgggacttgtgacctcatgcccctcacacccatctcttgctctacattcaaagatgaaaagagaaactcttctgtagtgcatgctaattatctgggaccccccccaaaccagaagtcattgaaaaaaaccataatgttcatttgtaatctgttattttaaatatactcataatttaaacctggctccacctccccttgaatctagaatactttctctacttgctcaggtgatcagcattttacaatttgaagatataggatctatatataataatatcaaagtggagtccaaacagagaaccgtcattgaaatgtgattgtggaaacttttagggaaggaatcttctttccttcaaaggtttaaaacaaggttgatcataaccactgggggtgaatattagagtcagctagggaggcagaaaaactgtaagtcttcaggcatgaatgtgggaaggtctgtgccctggggagacctacatattttctggaagaatagaggaccttctacccccagtgaatacctaagaatttgttgagaaacttattgtgctgtttcgattttcctaagcccaaataaaatggttcacagaggtcaaaaaaccaaaaacaaagcaaaaaacgcataaaaattgaataagcttataagggcttttccaaaaatttgcttctcaatgtgtcagctggcaaatacatatgtgcttttgagcttatgttccttatatcattgattgcatcattacaacgtgccttagaaccaatatgttctaactcatatatcctgttttattatgaaaaattcccaaaaacactaaggaaaggaaaaaagcagaatgaacccaccatctccccgttttaataactaacaccatcttgctcaatttatttcatctattccagcaccaccccctgccacttctttgctgcaatatcttaaatcatattcaactattatgttatttctcaaatgtacatgttgaagaaaaataaggactttttttacattactacaaagtcattatcaccctaacataattaacagtgattcctgtttatattcagatttcccaatttgtttcaaaactctctttaccattgacttactgaactggtatccaaacaaggtttgcactttgtaattggtcattcccttaagtctcttaatctagaacagacggcctcttttttttctttttttttttgagatggatccttgctctgtcatccaggctggagtgcaatggcacgatctcggctcactgcaacctctgcctcccgggttcaagccactctactgcctcagcctcccaggtagctgggactacaggcgcctgccaccacgcccggctaatttttttgtatttttaatagagatggggtttcaccatgctggccagactagtcttgaactcctgacctcaagtgatccgcctgcctcagcctcttttttttttcttttcctccacttgtcattgacttattgcctgccagagggattgtcttgcaggatgtccacactttctggattaggctcattgtgtcctcatggtagtagggttgttcttactcctgtaattagactaaaggttagatagattatattcaggatcaatagaattttttggcaaacacacttcataggcgatgctgtgcacatcacgttgcattatatctagaggtatgtgatgtcttgttgctccatttttggtgatgctaagattgatcaccgggttcaggtgtgtcaccctggttccttgcctgtacagctcccatcaatggtgtgagcatccattgatgacctctgcctgaatcagttatttcaccaggggtacaagtctatcatttcctctgatcaacagctggaattattcttgataacagaactttccctcttccagtaaggttatttggtaaccctgaaatatagttcatactagaaaagcaggatttttttctctttgatttttagttgtgagttgatgccacagtgaccttcagtggcaaccaatgagtcagccatcagcttctttctctttcactacaagctcatgacttgtttggtacaaccccattagtttcattttttccccctaaaattttattgagatataactcacataccacccaattcacccatttagagtatacgattcaatggttttgagtgtatttagggttgtgcaactaccaccacaatcaattttagaacatttttctttaccccaaaaagaaaccctgtactcattagcaaccatcccatttcccctatgcctacatcagcattaggcaatcactgatctattttacattcttgtagatttgcctgttcttatacctatgagtagaattattgggtcatacggccactctacgtttgattagttgaggaacagcccaactgttttacaaagatgttgcaccatttcacatgaagcaaattcacacttcacaagcaaaggatgagggttccgatttctccacaacctcgctaacgcttgttattatatgtctcttttattgtagccatccgagtgggtaagaaatggttttgatttgcatttctctgagacaaacgatattgtgcatcttttcatgtccttatgggccaattgcgtatcttcttgggagaaatgtcttttcaaatcctttgtccactttaaaatttttctttttattattgagttataagacttttaaaatatattccagatacaagccctctattggatatatgatttgtaaataatttctcccattctgtagcccttccttccttcctccctccctccttccttccctccttccctcctccctttccttcccttccctctttccttccttccctcttctttctttcccgccttcttccctccttccctccatcactttatccctccctcttcctctctatccatcactttctttctctcttccttcctttctgaacttttttattccttttttttctctaccttgctaaacttcccatgtgtgtctcatttcccaagtcttggacctttcagaagaccctgtacctggttattcaacagcggcactgtctaatagaaatataatagaaatatattgtgaggcacatgcatactttcaggttttctattagccacatttttaaaaagtaaaaataaattggtgaaattaatgttaataacatgttttatttaacacagtattttcaaaacattattttaatatcagtataaaaattagtgtgatattgtagtttcttttttcatactaaattggaaaaatccagcatatattttacacttacatcacacctcagtttggaataactgggtttcaatacccaaaagccacatgtggctggtgctaccatatgagagagtacagatccagagactcatttgtcttccctcatgctgctgtggcagaaatggacagttgcctcccaacatttatttcaccctcggaatttaagaatagaacttcaagttgggggttctgtttcttagtcttcccctactgttaggtgtggtcaaggccaagtttccttcttatatgtgcaggatgactcagctccattttgtacattttgctcctagaatcagccacttattcatgaagcccttgtgcctttagtgggaaatgatgttaatattcagagattacagtctcacaattaggccttttgattagacagagctaggaaatacgtatctttaaaaagaggcaaataatgagtccatgctagtatttcccattcagatttaggattaatatatttgattttatattggtatcttttctctaatagtgaaaatctcagttcttagcattaatgtaattaatactcactttatcccaatatgtacaaatactgcatatgtgtgtatatcacagagcttctcagtaataacaccaatactatcttgacagtgacattctgatgtggaaaatggtactgacctggcctaactaagatgaaagagctaatgtgggatttctcaacctcagagctactgacattttcaggccagataattctttgtggtgggactgtcctgtgcattgatgatgtttagcagcatctctggcccactatccactagatgccagtagcacctcctccccagcagttgtgacaaccaaaatatgtctttagacattgccatatgtttccttggaggcaaaatcacccccagttgaggaccactggactaatctaaggatttgataaacatcacatagagataagctgacacatattccacagctaaactcacaatgtttattaaaaaaataaaataaaataactgaacttggttttcttacacatagtttattacataattttttctgtatcttgattttatcttaacaaaataccctgccaatcttttcaaataagtatataaagttcttccttgctccctttatagctgcgcagggctccattttgtgtgtataataatttatcccaccagccacctaatgataggcatttgggttaatcctattaacccaaattaaaaagaatgctgccgtgagcagcagtgtggagaccacactttgtgtatttgctagtgtatctttggggtaggttccttgaagtagattttgctgggtcaaagggctaatgtgcatgaaagtatggtagagcctgccaagtttccccccgcagaggttgtaccactttgtattcccactagtgtcctgctttcattacttaacatgacagcaagaacatttccaatgtcattaaatcatccttgaaaattggattttgtaatggctgcccaaaattctcacacataaatataccatcatttagttaataattccttccctgttgaacatatatgatgatcccaaactttctctgttagaaataacactgaaatgaatttccttgcataaaaatctttgactaaagttctggttgtttccttaggacagatttccggaagtcagtttactgtagcagagggtttagatgtttcttaagtcccttgtgacacattgctgatgtccttctatgagaaaatagtgtattttttagcaagaatgtgggaacagatctttctcttgacttcagggtcttagatgagggagtagacttatctgattcaagcagtctgtccttctaggggaaataactaaatcataccaagtgatctaaagacccagtcttaaaatcccaaaagaaattccttacagttagtggcagttctcatctattgcatcgtccggggcactaggctattctttactgctggttgacttaccaccattttctctagacacatagattccgtctcaaaggggcaatcattttctcccttcccagcagtgacaggtgtgcagcctttgtttattcagcccttctcctccaaagagcaccttccctagtctatagcatcacagagaggaccagaagaaagaacagctcttgtgtgtcaattgatgtataaacaagcaagaagaggaataacaaatgctgcaccttcaatattactgcttaaaataatagccatgtaagaaatttagtaaacacagttagaatttgatgtgccttgattgttgagtattcacaaactcaagcctaagggtcaggaaacaaaatactgaacaggcccattaaggcaaatgtcatctttaaatacctatttaactctctgggagtttgtacaaataaggtgtgaagactaaatatatgaagcatgctgaaattcatgttttccttgctgtttgtaaaagggctagaaatcccagcaactctcttaaaaatcagacacctggtataccaagctctggatttaaaaatccctaacatttagaagaaaacttaagatccaagagatggaataaaatggttctgattcacttgcaggggaaatcagcaaggaaaagagctgtcagtcagcagtggctcacttgtgtcatcgcctggtgacttcaacttcttttttcagccaaatttgaaacccgccggggcaactgctaacagggatgtctttctgttatctatgttaacctacttcttcctacatgaaccctctcctgctggtgtaacattgctatagcaatgcatgcatgtgattggagggataagcagatgtaacccttgttctttccatagtaaccacatgcatttttgggctccaggaagaagctgtcctccctgcctgcaatcaaggtcttgattgtgccttcactagatcaacatttttccaaaagcagtctgccacaggtcagcaagcattgtgcaaaaaatgagatctagtggcctggtatgttcaggagataccaagttaaagacagttcaactggtttcccccagcagggttgctcaatgtctttaaaatacgactgtgggccaggtgcagtggctcatgcctgtaatcccagcactttgggaggcggaggtaggcagatcacttgaggtcaggtgttcaagacctgcctggcccacatgatgaaactctatctctactaaaaatacaaaaattacccaggcgttgtggcacgtgcttgtagtcccagctactcaggaggctgaggcaggaaaatgacttgaacctgggaggtggaggttgcagtgagttgagattgcaccactgcactccagcctggatgacagagcaagactctgtctaaaaaaaaaaaaaaaaaaaaaaaaaaaagcctgcctctggactcttgtactcacacttacctgagtctagaatctggaatgcagtggcacccccaccaccgtctccctccccttcagatatctgcagggctctgtaggtcaccttcaggggtctgctctgatgccacccactcagcatcctattcataattgcagccccggccccagctccctatgctgcattcttgctttgtgtttcttcctgtgctgttaccagaagtgatactaatttggaattaatggcgattaagctttacagccccttgatttcctgggacccttccttggctcatggagagtccccagcaatgtcctcatggtcttcatttttgcaaaatttgtgaaatggtagttttattgctggaaccacttttgcaaaaattatataacagttagaagattatggcagtgaaagagatctgatctaaccaacctccatcttgcctttaatcattcctgggctcaagccaagctaactttgggagacatttcgtttatagtttaaatgataataaccctttttgaaaactatgtggccttcctaaagctaatgcaagaccaccaggttagaaggatgagaggagcctgaagtcgttaacttccccagttactcctggagataacatcactattgtagaatctaagtaagattggcctttagagatgtcttttaaagtttttgcatttctgatgacccacgactccacgtgaacccaccaactagtcccatggccgcccccagaagaggactactttccatactcccattcaattgcccaccaaactatccttgaaaaagcctagcctccgaaatttgggggagattgatttgagtaatgactccatttcccatgtggcgtggccaggcttgtgtttattcaactctttttttattgcaaataaataaataaataaataaaagatactatttgcaggctgggaatggtggcttatgcttgtaatcccagtgttttgtaagactgaggcaggaggactgcttgaggccagcatggacaacatagcaagacctcgtctctacaaaaaaattgttaaaaaatcagccaggcgtggtggtgtgtgcctatagtcccagccactcaagaggctgaggcaggagaattgcttgagcccaggagtttgaggctaaagtgagctatgatcacaccactgcaccccagcctgggcaacagagctgcaacaccctgtctcttaaaaaaaaatgctattgtgctttgtgactctctatgaaaaataagataaagcagtactttccacacttatctgaccccactcctttcctcaaggagtatctcacaagtctagtgttccatttgaaaaccttttggaagacattagtttgtattacctcaccctgatctgatgaatgcatttttcattgcaattgccttcagtcctgcctgtaggctttttttttatttggagacagagtctcgctctgttccccaggctggagtgctggagtgcagtggcacgatctcggctcaccacaacctctgcctcccgggttcaagcaattctcttcctcaacctcccaagtagctgggattacagacacccaccaccatgcccagctaattttttgtatttttagtagaggtggggtttcaccatcttggccaggctggtcttgaactcctcacctcatgatccacctgcctcggcctcccaaactgttgggattacaggcgtgagccactgtgcccagcctgttattcatctttaatagtatttttgtgcctactagtggtcaaaccattttgcttggaattacttacatacaacacttcactatcccacacaataatatcaagcccatgatcttccatgtgtgttttacgggtaaaacccatatgacgaggaaagaagtatactgtgcaggatttggtaggtccagtggggaaggcacatgatgactagcaggaggttactaagcagtaaccttgctcttgcttcgttcacaccttactgtttgatctcatcagacaaaaacaactttcaacctggttattctggcattaccttttcttcttcacagggtgtaggttgacatgcgaatcatacatttcaaaccacatttaaaacattataaaattattataaccattttatagaaaataggagaattagaaaaaatacttctgatttcaccactgtgactcaagtattaccatctttgtatctacctttctggtgaaaatggtttagttatttatcatcttttgcttccatatccttctctggtaatgttttttgttcccaagagaaaaacagtttttactcttttggttattttaaagtaatagttgtttattataaaaatcataatttatatgctttattattatttgaaagtgagtagtcttcacaatagcaaagacatggaatcaacctaaacgcccatcagtgatagactggataaagaaaatgtggtacatatataccatggaataccatgcagccataaaaagaacgagatgatgtcttttgtgggaacatggatgaagctgaaggccatcatccatagcaaactaacacaggaacagaaaaccaaatacctcatgttctcacttataagtgagagctaaacaatgaactcatggacataaggaggggaacaacagaccctgaggcctgcttgagggtggagggtgggaggagggagaggagcagagaaaaataactattgggtactgggctttgtgcctgactgatgaaataatctgtacaacaaacccccatgacaaaagtttacccctgaacctaaaataaaagtttaaaaaagtgaatagtcccctgtaactataccatggaaaatgatgtaagtctctccaaactcttttacatctgtgtgtgtgtgtgtgtgtgtgtgtgtgtgtagagcacatacacagagcaacaaaaatgcgttgtcctgtagatacaagtgatatttgttctatggcctgttttttttccttcatttaatctattgtggacaactttgaaaatctgcctaatcccacataaaactccattgtatgtgtgtaccataatttatttgacttttctttttcttgagcgtttttaatctggtgccagcctgttgaacaccttttcccactaccatgactcagtgccctgctgggctccacggacactctaaggtcggggggcagttcttcgttcagtgtttagctggaatagggcaggtattattaaaaggttttttattctggtagaccgcctctcctcagtcctttggctagcgagagcaggcttgtcatggggtgtttgaatctgtgcatgttagcagttctgaattgcaggcttctcctgcattctattgggatagatgggaagtaaagagaaaacccagggaactcactgccacaccattcctcaagtcccaaggtccctagctagccagtcctcatctttccaccattcaatgtctctccatgtttatttcttgtattatatccagggatttttagttgtaagagggtgaactagagaagaatgggctactccatcttggccaaaggaaaagtcttgttcatatttttgttcataaacataatttattttacactctctatcaggggagtctatttctgttgttagtttttttctgccaggtctcatttataatggtttattatgtgttttgtaattttatattaattaataaatttattcattcatttttgagaggggggtctcactctgttacccaggctggagtgcagcgatgcaatctcagcccactgcaacctccgcctcccaggttcaagcgatcctcccacctcagggaccacagacgtgtgccaccacacccggctagtgttttgtaattttagattgttagcttacattaatgaagttgtctctatctgtgggattcttgcatgggtccctccagagaatatttgttttactgtgtcagtctttaaatcacttttagctaatttccctgttcagaattttttggaccatgccaataagaggagatctgtggtcctaacttatcagtgaacactttctcccaccccaaagtgcaaggcagacaaatttccctggtgccttccattgctagtggggagatttcctaatcaaccctttcatagtaggcatgcacccttcagcaatactgagtctttatgtggtgggccttgacgccacctcccatcttgaatgggtccaggaccttctatgccattctacatgttgcctttaaaactcaaaccttttgtaaccaagagacaaacacccctaatcagccatagcttcaactgcccagctttcattttcagcttcctctttatttttggcccttgagaattctggccctgtctccttgagggctcaattgtgcattcgaaaggtatttcctataattaattgagctttttaagggactgtataacaagagaagctagtttatctttttgctggaaacagagccagccttcccatttttttcctctcaattttggtaatatattttctggcaagagtaattgaggaatatatcttctttgttgatactgtagcaattagaagttattttcattcttcattataaagaaatgatgctctcaacccaaacatcagtaggacataaactgaactgatagctgcagactctcctacagtatcctcaggcctcatgcttctgaactcactgctcagaatgagaagtggggtctctgtggaggccacatctgtcagctgattttcaaaagtactgcccagccacatgggttcaatgaatcatcccctaaactcattgtttccattattttcactaaagattaaaatataacatcttatttccattgcccaagttgatgcggcttttctctattgattagaactaatgatgattataaaatgctaaaattttcaacaaagcagattcaccttcataaataattcctggatgttaaggaagcaggccatttaacatgaagtaagtagccctgcacctaaaggtcagtcatgtgttcaagtagtatttcttttaaaaaaaaaatctattttgagattaggttataagactggctaatttttgtatttttggtagagctggggtttcaccatgttgccaaggctagtctcaaactcctggactcaagtgatccacctgcctcggcctcccaaagtgctggcaagtgctgggattacaggcgtaagccaccatgcccagctgaactagtatttcttctttttttttttgagacagagtctcactctgtcccccaggctacagtacagtggcatgatcttggctcactgcaaccttcgcctcccaagttcaagcaattctcctgcctcagcctcctgagtagctgggattacagttgcccaccaccatgcccagctcatttttgtattattagtagagacagggtttcaccatgttagctaggctggtctcaaactcctgacctcaggtgatctgcccacctcagcctcccaaagtgctgggattacaggcaggagccaccgcgcccagcccgaaatagtatttcttgagcacctgttgggtatttattctgcatgatggagggagggggaatccacatcatatggtccataatctttggcctctggaaactggcaatctgattgaacaatcagtgggttagaaaataaatgactatgaggcggagatgcagccagcaccgtgtgattggtacagacaataataagaataaaaatatacaagggaaagaggcaatttctgatgacatatagttttaaaagcctttatgaggtagagagcacttgatctgggtctataaacatgactcgacttttgatagacaaagtgaaagttccacataaggaaaatggcctgagtagaaactcagaactaggatggcaaaaagtggattctgagaatggcaagcagaccagtttggcccaagtgggaattgtaggtgggggacagctgatgctgggctcactgtggaagacaaagtacccttcaatgcttaatcattggctccctattatcaaccacagaatgttaataaatattaatttccagagttgtcctgaccactcacttcatggtgttacatagacatactgcaaagacttcacttttaaaactgaaggttggtttctcttatgctgataatttcaacttaatacattttaactagtgaaggaataaactagaattatgttgcttccacattctgtaaaatttggaatgatctctgtcccaggaaccctggtttaacagtggagacaggacgagggacttaggaaggtacctgagggttggcacaggggctcagctgatcgggcacaaggccttgaagcaagatgtaaaccgtggaagtggccagtgggtgctgcaccttttatccagcagtgggcctgggtccagtggaccaaactctgaggtctgtgagtctttgctgcatttcacacttgctgtacaccagcagctcacacttgctggtagttttgccctttgaggtgacagaagtaccagaaaaacaaaagaaaggagacattaaaacagagtaactaggttcaaaactcaaagtgcagggactaaggggagtgctttctggttgccacaggttaaatttttttatataaatatattggcataaagaatgattcctgggtacattccacttgtccttcgtttcctcccttgtatatgattattgatgtcatgaaaagtgcattcatcaggcctggctgtcagagagttgcacttattttgtgcccacaagcagttttgaggtaaatctcttgctttagggcattagctaatcaatacagacatctgtagtgagggattgttttccacatcatctacaagactccattttcctagggcattctggagggttctggacttcctttagacaggaagtcactctggatgggacagggacagcaggaagaaggagtccctgtgaaagaatctttcttctttagcagcctgtcttttagaagcaagtagctgatccaaagtaaaggccttggaagaaaatatagcaactgctcattaccctgtgctctgccatttctaggggcttattttctcttcccttggggttttcagtctgatatcagcttattttttctttgaaatttacaggatcaatgatcccacatgccaaggcccaaccctccatattactgcctttaattacatataaggaagagggcatcttgtttctgtatattggaggcatagcaatgactatacacatggcaggcagtaaatactgctgaacggcactgaattcctaaaatataaatgtaatgatttagcttccctgttaaaagatctcccggccgagtgcagtggatcacgcctgtaatcccagcactttgggaggctgaggcaagcagatcacttgaggtcaggagtttgagaccagcctggccaacatggcgaaatcccgtttctaccaaaaatacaaaaaatagcccagcatggtggcacacgcctgtaatcccagctactcaggaggccaaggtgggagaattgcttgaacctgggaggtagaggttgcagtgagccaagatcgcaccactgcactctaggctgggtgacagagtgagtgagactccgtctcaaaaaaaaaaatcccttctctcctttttttcttttctcccccatcacttcacctttttctcctataattcagtcacaactgttaactgtctagatggactcttgatacattgagacattccaggcattctatgagtttcatctccttggagagaaggctggtaagagccttcttaccagctccaggctcacctgcttgtcctgcacctagtctatagaggaaaccctggggttccccatcgtcctcctggagggtccttcactctatgcgtcacagcctctgtttcttgaatcccttatagtcctttggtgtggtttactctcctcctttggagagaatcctccaatgctttcctgataaagagtacatgggaggtaatttttttttaggcctcacatgttgaaaatgtctttattctatcccccaacttaattgatgtcttcatcaagagatagatttctatgctagaaattatttctcatctgaattctgaaggcagtgttctattttcttttaatgtcttacattgctgttgagaagtcttattgatccattgtacataacctgttttttctctctggaagcttttatgatcctttctttgttctccaggttttgaaatttcaccacgatgtgacttgggagtccactagcagttaactgaggcataggtttagggactcgctgagttaaatcttcatgcctgcctcacagggttgttgtgagaattaaatgaattaatgtctgtaaaatgcttgagacattgcctgccacttagttaagtactagttaagcatttgcttttattaatatttcacatacagaaaattatttcctagaattctggaaagttttcttgaatgatttctttgatatcctcccttctgttttctctgtcctttttttttttttttttgatctcctattgtctgttggctctcctgtaataatgttctcatttaaaaaaccatttctttctcatttcgaatttgtgtgtgtgtgtgtgtatttatgtgcatgtttgtgtgtctttttttttctttaattgagacagggcctggctctgtcacccaggctggagtgcagtggcatgaccacagctccctgcagcctcaacctcttgggttcaagcgatcctcccatgtcccaactagctgggactacaggcatatgcctggctaatttttttgtagagatggggtctcactgtgttgcccaggctggattcgaactcctgggctcaagtgatcctcctaccttggcctcctaatgcactgaattacaggcataggccaccatgcctggccttgtgtgtctttcttgtcctactctgtgagagatttctccagctttatcttctaaattttccattgtgtttttaatttcttctatcatattttgtattctcgttactgcattttgttgtttttctctattctttttaaatggcatcctctttgctgtagtctgaatgtgttcctcaaaattcatgtgttagaaacttaatccccaatgcaacagtgtcggatggtagagccctatgggaagtgtttaggtcaccagggctccactgtcatgaacagattaatgccattataaaaaggcatgatggaggcagtttggtctctcttgtttgccttccacttgccatcatgtgaagacacattgtttccccctcttgaggatgtgccatcttggaagcagaggccagcctctcaccagacaccaaacctgctggtgccttgatcttggtctcccaccctccaaaatgacaattatgaaatttctgttcttgataaattacccagtctcaggtattttgttaatagcagttcaaaatggactaagacactcttcttgtttcatggcaatattttcttacatctctctgagaatactaatttttgaagtttcatttccctgaagaattctgttttctccaagattctttttattttccaccattaatttgtgttgggctctgtcttcaagttagaggagttccacagatgtaggtcttcttggctgcctaatgtttatgagaggggtacattaacaaaacccacaggaagctctgtgcatgtggcaaaggcttgccaactgtgggctccatgtattgagatttgactgggttactgtgttggggaactcccaatatcaatgtccttagggtctttctctttggctggtcagattgccaagtgacgattcttgcaatctcctgcctggagggcaagagtttggctgctaatagtctagggatagtcggtatctcattgcttcagtacagtacactattttcaactgagcctggtgtttcccagcctggagaccctccattttaccctctaccaaggtatgggagaggcagttcccctgctactggagggggtggaaatctgtgatctaacttttttttatgcaaattggcaatcaaaccccctattttcaacccagcctcaccctcacctctaaaggtagaagaagatactgccaagtctcttggggattctgtgactcagattatttcttgactttctttactgctgatttagaaagcagcttctcagttctactaagtttcttttactcattattatgcttcccagctttcaaatctttgcttcaatcagttctccaattctctttgcttttgtgggtttatgccattcaaaaactctttcagtggtgtttagtaggaggaagcagaggtgattgtgtttatccccaaatttaagtgcagtcttagttaatttaaagttcatcaacaatgaagtgtaatatggtttggctggtccccacccaaaatttcatcttcaattataatcctcataatccccacctgtcaaggacgggaccaggtggagataactgaatcataggggtggtttcccccatgctgttctcatgagatctcactgcaccttgatggttttataagtgctcactctgtcctgccaccctgtaaagaagatgcctgcctctctcttttgctttccatcatgattgtcagtttcttgaggccatgtggaactgtgagtcaattaaacccctttcctttataaattacccagtctcaagtatttcttcatagcagtgtgagaatggactaatacagtgtttttatttcaaccttagtaacacagacagccttctgttggaacatccttgggtatgaaggataacatatttttgtggcttatatgcaggagtgatattcaaaatattgaacaactggtgtggtgtgggtgctgaccagtcaaggggaacagcatcattcttgctgcctgctggctgtatattattgctgagtatgaacaaggaagaaaccatctgaagcaaagatgagcacatcctcaattggagtgctaggcaaagttctgctgtgaagcgtgtttttttcttcttttccttgaccctgtgccttgaatataaatgtgccttgagagggggaatgattgtgcaagggaagaggtggctgagtctctgatgtgcgatgaatgtcaacagggtgagactgataaaagaacaaagcaaatgcaaaaaagaaataggtcattgttactgtcggtaaggcacccctggactatggattctcagctcagggttagacaaacaataggagaggaaaagacacactccttaaagaaatctggttgctgtgatttaggattcagatatgttccctggaagtatgttttcagtttaaaaagaaatattgtaacatagattcagaatgagaataagaaaaaatgggaagacagtttagatattctcagtgtttttatgagtgagaaatacctggtgatgacgttttcattgttactcttttttaaaaaatatttaaaattttattttttaaaaaatttatttctgtcactcaggctggagtgcaatagtatgatctcggctcactacaacctcggcttcctgggctcaggtgactctcctacctcagcctctcaagtagctgagactacaggcgtgcatcaccacacccggctaatttttatattgtgcagagacggggtctcactatgttgcccagcatagtcagcgaatcttctacctcagcttccccaagggctgggattacaggcgtgagccaccgcactcagctcattgttactctttatcaatggttaggctaacatacaggaatttcctaatttctatcctagaaaatcaaataaacagttcacagactcacactcaagatgatctattgataataggaatggtaatttagagtaaccaaatagcctcagctgatgagggaaagctctgctttacataatagtgctatgtaatttcataataactccaaataatgtatttggaatgaaaaatccaggccaggcgtggtggttcacacctgtaatcctagcactttgggaggctgaggcgggtggactgcttgagctcagtagttcaagaccagcatggttaacatggtgaaactgcatccaaaaaatattagccgggctcgcacctgtagtcccagctactggggggctgaggcagaaggatcgcttgagtccaggaggtgtaggttgcagtgagctgtgacggcaccactgcactccagcctgggcaacagaggaagaccctggctcaaaaaaaaaaaaaaaaaaaaaatccaactctgtgtgtgtatgtgtgtgtttaatcagcatttgcaacctctagtgaaataattgattcagacaaagatcattaatagatgctaaaaccattagttgaaagggcataaggaattgggtattcctatggtgtcaaagtattgtacacagaatacttactacttgctgagagaagatgtttttctttacaacggagagttccatggccaccagaaaatcaaacaccacaccgacagtgagatacacagatgtgtggatcctgatgaatatgaaaacacatcatcatctatgcaatacgcttgccaaaaaatatttaccctaaatctcattaagcttttagaacttccctcttagagacagggaatagaggaaccagtttcatgtatcacaaggaaatcatcagacaaattcagaatgtgggacattctccagctggccctgtttcttcaaaaagggtctagggcaagcaggctggcctagattaaaaagaggtttaagagacagaaccatacatgatgcatatgtgttcactggattttgtcagaaaatgatggaaggtattttggggatggttggagtattttattttttaacttttatttaagctcaggggtacatgtgcaggtttgttgtataggtgaacttgtgtcatgggggtttgctgtacagattatttcatcacccaggtattaagcctagtacccattagttgtttttcctgatcctctcctcctcccaccctccaccctgactggagaaatctgaatatggactgagcattagacacatcacagaatcagttttgccaggtgtcataatgatattgtggctatgtaagcaaatgcccttctttggaaatgcatgctaaaatatttagggatgaggtgtcatgatataaattactttgaaataatttagcaagaataggtagatagagagatatgaagcagatatagaagaatactgatgttgaatcaagatggtatgtatatagatgttcaattgttttattctacttttatattagcttgaaagccattgcactccagcctggcgacagagcaagactccgtctcaaaaaaaaaaaaagtgtactagtccattttcatgctgctggtgaagacatatccaagactgggaagaaaaaaaaattaactggacttacagtttcacatggatggggagcctcagaatcatggcggggggcaaaagacacttcttatatggtggcagcaagagaaaatgaggaagacgcaagaagcggaaacccctgataaaaccatcagaccttgtgagacttattcactaccatgagaacagcatgcgtggtggaaactgctcacgattcaaattatctcctactgggtccctcccacaacacgtgggaattatgcgattacaattcaagatgagatttgggtggggacacagagccaaaccatatcaagaagtttaaggaaatggcctatggatgcaaaatcacataaacttggcctgacagttttgggaggagtaaaagtgagtgtctgaaagggcggttatttgcactgggcacccaggaagggccactggtgctaagttcaccaatgtaatgaagtgaggggtcattcactccagaaggactgagaattttggaagaattaatgtacttagagtgcccaacttattgtcagcaataatttactcactggcaagatcggactgaataattcatgttacaactgcaatcagaatactcatgattgctggttgttagttggtttttgtaccccaaattaagtcgcataaaattacttccttttcattagttctgagaatgtgctcttttccttttcttccattcatccttccttccttctctttcttctccttcctttctgctttcctctcttcccttccttccctccctcagttctctttctcaccaattctttctccaaataatattaattgtcccatccactcaaggcatagatgtagagtgacagttaaaatgcagaattgcttcctgcaatgctaaattgttcttaaagtacagttgttgttcaggaagtgtgtttgcagccctgtccagctccatttctggtgtgatttcagggagctggactgtgccatgttacgccgcctggagaagaggattctggtcgatctccccagccgggaggccaggcaggccatgatctaccactggctgcctcctgtgagcaagagcagggccttggagctgcacacagagctggagtacagtgtgctgagccaggtcagctgccctggagaggggcacatgtaggtcaagggcccaccatatggccatcttgtagaccaggtcttaccatgagctgatagaagcttgagacacttagaataagatccaagctgcccccgtaatgcaatgggcatcttcacgaagaataagctccttttcacttaaaaatattcagagaaggagaaacaatgtgaggcagtggaaacagcatagggtttagactcagagaacctatggtcaaatcctggccctgctgcttgttagctgtgtgacctcggagaagtcacttactctttgagcctgtttcttcatctgtaaaatgggtagcagatgagccacaaagaatgactgtgatgattacataacagaaaaactccaggtacatgtctattatgcccattatcactggtgtccattcccagggtgttgcagaaatgttgcctgcttttggtgaacatttgaacacaatgttctctgaggttcctaaatggcaggtatgatcttatttacaagaataaacgtgcctaccaaatttgaccatccttggatttgagcacaggggccctgataggctaacttgggtgttctgatccttcactggcatcttacagcatatttcgatggtgttagaaagccattctagcccagctgcttaggttatcccaacatgctagcagggtctcttcctcaagcactgtttatctgggaatctttttaggatgttcatgggtgacagatacagaatctacacagggcttctgatactgggtcctgcctataacaacgtaatggccaggagcattctgcccactgaccaatggctggttttttggctgtttcaggagactgagggctactcaggctcagatattaagctcgtctgcagggaagcagccatgcggcccgtgaggaagatctttgatgcacttgaaaatcaccagtcaggtatgggttggatcaccatgaaggtgttccaggaatttgtgtaaaaatccctctcaccagcagatggagcctggcgcctgttcttggtgccgctttacacttggcaatgcgttttttggtcaaatcatccctcactcaactcattcctccgtgggtgttctgatttggatcgactttgcttgcagatgataaactccttagggctcaggcttttatttctctggcacactctgatgttgggctggatccatttgaggcactatataaatattaaataatacctggtaacgatacatttaggtcacatttttttgtctgggccttaggggctaactcagttgcacgttaaagaatttttccccagccctctttagtcttgccttttgctgcattaacaattaagaatgctgcattatgcattattttgaaagaaggtctattagcgtttcaagagcattgatcaccaagaggtcgattgttgtgctgttactgttgtgttcttatcctagaaagcagcgacttacccaggatccagttggatatagtaaccactgccgactttctggatgtgctaactcacaccaagccctccgcaaagaatctggctcagagatactcagactggcaaagagagttcgagtctgtctgaaaccacatttaccctgacctggccacaaaggcaaccacaaagacctcctagtttattaatgtccgtgggagaacaaaatgattggaatggaaaagagaaaattatttttgaagactggattaacttgagccactgtattgttttggatagctgagatatatttattaacttaccattatcgatgtcagcaaaatattgagagtttcagttacatacatatatgtgctattgggtcatacaatggagatttttctgacaattagactccataaaattttaatgaacaattttctgtaatgttactcatttgtaaactttttaagaaaaagatgtacttagaaaagttgtgttggccacacacaggatgaccctgagttggggcagccaagtagaagctaagcttgacaggcactgcccagctgacagtcccagggtgaaggaggacggaagcagggaaggcaatgcagtctgtttctcattccggacaatattctgaatctcatcagctccccctaattctgactccatccagctttgtcagcagcaaacccctcccaaactaagccccactcagaaatgtcactgagcattctgatgctagagctaatagccagggtgactagcacaccatcaccatcagctgccagtctgattgttttgggttctggcccccaataacatcttttcactcttcacacctcacatccggtgtgctctgcccttctctttccattgccgcagcttctcatcagatccaaagcttaggatggggcacctaagcttcgagaacattcatcccaagtcttccctgctcttaggctcttccccctctccttaaggggttataaacaactagacgcatctctctcagaaacccacaatccgaggcatctactttcaacccttgataaattttgaaggcttctactaagtaatgccacttcttttcccccactagaacttacctatgggaaatcaccttcttttctcttccttgccttgtcttcatcatccctgcagacagactcttcaagaggaaaaacctccagaaagagacactttggatagctaagtatcccaaaggattttacccttttaaacaaaaccaaagcatttttttcggtatcgattattttgagattattctcaaatgcctctttaaacatcatttcatggaaaatgtcaaattgaaaatataccttatttaacaaattgaaaataaaaaagatttcatctca

SEQ ID NO: 543 - DNA, 5525 bp, Homo sapiens
ttaataaattaacccaagtaaagtactttgataccaaaggaagccctatatgtgttagtgatttcagccttcttcctctaaatgccctttgagttctgaaagatttctgaaaatgttcggccttgtgaccttgggtaacacctgctgctctgagcctcagtttccccgtctgtaagaaatgaggctacgggactcaggaggacccgtgtgtcccagcaggctgatggggacatgtgaagcagacagacagcctgcctggcccctggggacaagctgtgagaccttgggaagccactcccctgctctgagactcaggtttctcccctggaaaacagagtgaggcccccagcctgtctgacagccttcctgagctgcagggagggtaggtgacaggcctggttcaggattgttctgtgattctatggaatagactgtacatcactcttgggttcaggggcaccaactttttctggctttttcttttcttttctttttttttttgagacagagtgttgctctgctgcccaggctggagtgcagtggcgcaatctcggctcactgcaagctccgcctcccaggttcatgccattctcctgcctcagcctcccgagtagctgggactacaggtgcccgccaccgcacccggctaatttttttgtatttttagtagagacggggtttcaccgtgttagccaggatggtctggatctcctgacctcgtaatttgcccacctcggcctcccaaagtgctggggttacaggcatgagccaccgcgcccggccttttctgcctttttctattgtggttctctttccctgagactctgttgttctgtctccaactctgggtgtctgacgctgccctctgggtctctgtccctccctcccccactggctctttttgtttgtttgttgagacgggggctccctctgttgcccaggctggagtgcagtggtgcaatcatggctcaatgcagcctctacctctcagggtcaagggatctttctgcctcagcttcctgagtagctgggatcacaggcatgtgccaccacactcagctaatttttgtattttttgtagagatggggtctcaccatgttgcccaggctggtcttgaactcctggcctcaatcaatcccccttcctcggtctcccagagtgctgagattacaggcatgggccacttcgcccggcttctatcccctgctcttggtctctgtctccccactctggatttctgttcctctcttctgcgtctctgccataccccaccctccaggtcattgtctccctctccctgagtctctgtttctctccctttgggtctctgtctctctgggtttccacctcttcctttttctgggtctctttctctatccttttggctctgtccctctatcatgtctggacagagtacagttttctccccctctcccctttcccttgtggctctgacctccatgtctgagcataaaactgtaggggagaatgggagtgaacagcacaatgaagtggatgtggggtaaacaggaggagcatccacctcttcctaatttacccagtcgcctctggatgaacacccaatcccatggatacagaatccagtcccgccccctacagcgagctggggagccagctcggcacacctcccagagccctcgccactgcatgctcccagatacatgatgcttccccactgctatttcctttgggtcctggtgctaccactaaatgcaaaacagcccgatgtggccctatggaactcgttcgcacagtccaactcaacccaacttcctgtaggactcacatagtgacacaactcaatggaactcaattcagcatggccctatgagactcaaacagtggcatgacccaactgaactggccttacaaggctcatatggttgtacaattcaacacaactcaactcgctgtggccacgaaaaatgtccagccacacacctctacacagttaagcccaacagaaccctacaagattcatttggtcatacaaacttaacccaatgtgacctagaaagctcaaattctaccactggactcttcacatttctacatgactcgcaagttcacagaacctaaaataacatgcccctggaagaatcacagagctacacaatttccaccatgtctcaacgaaacttaacaccacacacattcgatctcaacaatgccatgggggaccatctaacttgacccaacatggccctaggggacccaccaaaccacagaatcctacacaatgcagctggaccacactatcccagactcacaacccaaccaaacccaacactgacctaggaaactcacaaaatgatacgaccaaacctatctcaacactaccccaaaaggctccatgagctttgcacaactcagagtaatatgaaccaattgagtcttcattaacacaacacaacccattgccattcgctgctgcttcaggaggtacccacaggagctaccaaaccacacaacccaagacccaacaagactcagtgtttccccactcgttacgacttaacctagctcttcctaaacccaatcccctccccccagccttgccctccaccctgccctccctccctccctctagggaggtgtgaggtcctgcagacctcaactgttcctcacacttcggtgaccaggtgtttccctgggggtgcccagagtggaggtggtagctcaggtacctccccgtccaccagccccccattggccttgccctccagtgggccacaaggctgcatgtccacatggctgaacatcccagcctcttcgccctctgtctcccggtgataaaagtagctgaaattggagacaatgacgggcactggcagggaaatagtcagcacgcccgcaatggcacacagagagcccactatcttgccacccacagtgacgggtgccatgtctccatagccaactgtagtcatggtgactaccgcccaccagaaggactcagggatgctagtgaaatgggagtccacccggtcaacttcggcaaagtagacggcgctggaaaagaggaccacaccgatgaagaggaaaaagatgaggaggcccagctcacgcatggaggcccgaagcgtctggcccaagatttgcaggccctttgagtgccgggacagcttgaagatgcggaagacacgcaccaatcggatgactctcaggatggccagtgacatggcctgctggcccacccctcgctgccgggccagctcggtgcccagtgccacaaagtagggaaggatagccacaaaatcgatgaggttcatcacgttcttgaagaagatagccttgcttggacagaccaggaggcgtaccagcagctcaaaggagaaccaacaaatacacagcgtctccaccacgaagaacgggtcattgaagggcaggcggggtggatttccaggcatttggctggagccattcagcggagcggggaactgcagggaggaaagtgttcagggagggtcaggctggggctaggacacggggacagccttaatcatcatttaaatacccagctcctctttacacattggtcagtagccgctgcgccaaggccctccgtgacctggttatcccagacttcctcccaggatcccagggatcatccctgggccgctgactttctggttgcctgacctggtgggtggctggagacgtggtccctgccccttcatgcgtgggaactcatgtttgagtagggtgcaacctcttctctctcaaagtcccgcctccagtgttgattttctagatggggagcatccctgccctggccccaccaccttgtgcctagcttttccttgccctccacagtcccagcccagagtataatgcggctgggcgcggtggctcacgtctgtaatcccagcactttgggaagccgaggcgggcggatcacgaggtcaggaaatagagaccatcctggccaacacggtgaaaccccatctctactaaaaatacaaaaattagccgggcgtggtggcctgcacctgtaatcccagctacttgggaggctaaggcaggagaatcgcttgaacccgggaggcagaccttgcagtgagccgagatagcgccattgcactccagcctgggcgacagagcaagactctgtctcacaggaaataaaaaaaaaaagaccttctctgcaagccgagccctaggccccctcctctggcccctcaacctggctttctttccatagattcctcctactgtcgcccctcgggctccagcaccctcagctggagttattcagggcctggctttcaccacccagccgcacagactccggagttttcaggctctccttggcccccctcagctgtgatttttaaggttcctgtcctcctaccccttgcatcaagggccctgccctcttcacgccgggtttctcactgacctcaaccccaccttctgatggggcaggtcctccgacccggatcctcaggccccgcctcccgcccaccctgtcttcggctggcccacccctcgcagcccctggccccgccttatgattggccaggtcccctctggaccccgcccatctcctcccaaaccccgcccgtctccacccacgccccgcctctcaccgggccggctgcggctgcagcagcaagccccgtgccgtcgcggtcgtcgcggaagtcaggcagcgtctcgaggcagaagacgacgatggagacgaggatgaccagcacggagactacggcgagcacgcgcgcggcctgagagctctcgggaaactcgaaaagcagccacagctggcgggcgaaggcgcggcggggcagggggcgctcgggcggcaccgggcagccctcgtcctcgcgcaggcgtgccagggccgccgcgcccagcccgtagaaggccacctcttccaggaagacgtcgagcggcacgtgcgccggccgccgcagccgcccaccggactggtagtagtagagcacggcgtcgaagctgggccggtgccggtcgaagaaatactcgcggcgcgcgtcgtcgtagaagcggccgcggcgcgctgggtcccctagcagagtgtccgggaagcggcccagcgtgcgcgcccgcgtctcgaagcgcagcccggccacgttgagcaccagccgctcgcagcagccgcacggcggcgggcaccgcggctccatggcgcgcgcagccccggcgacccgcgaaccgacgtgtggccccgacgcccggccccggtgcggccccgcctcggccgcctcggccgccgccgccgccgccccagcccggtgtccggtgtccggtgtccgcgcgtaaaaatagcccggcagggcggctagggcgcgagggagggggcactgtgaccccggcggggcggagggcgacagggcgaccgcgcgccctctgccgggacgcccgccctgccctgccccgccgccgccgccgcccgcgcctgctctgcgcctttcccgtcccggggtcccctttctctccgtccttctgccgccgggatcctgtcctgcgtctctccaagttt

SEQ ID NO: 544 - DNA, 2729 bp, Homo sapiens
attattatatcatcatcattattaccctcaagttgctccaggagaactcctattcaacctccaaaaccccatgtggtttcacccatcctgcagagattgagctcaaaatcagagaattgtgattttgtgattatttgatgagttcccaaactggggtccttagatcagctgggccatccctgaggtctctcagcatccagctctgttattttcctgggcatgggtctcaggcccggccagtccggctgaggagtgtgcagacgcaggcagtgtcaattcgaatccatcgccagcccacacggccctgggcatcagcggtcaatgcccgcacataggactgcttggccttgcactcagatacccagtgcctcctgtccactccccggcagccccctccacctgcccccgggccaccttcctcagcgttatcagccttgcagcgggtttcaaagaagtactggcggaggggactgccgccagctgcaggcacctcgcccaacacctccacctcgcgcccacgcaagtccacagcggtccggcggtctgtcacccagccactgactgcatcgcacacagccagctcaccccgacgactcgctggtgcagtttcgctcaccccacgccggctgcggttggccggggcacctgctgactcccgaaaggccccagcctccagcaggaagagcagagggggcccagcaggggcacccctagacaggactactcggggggagagaaggtcccactcaggggccagaaaagggggcaatgttgagggtgggggttgggactcaattggcacactggggaggaggaaaaggaggaggatggggagggagcatgaggggagagggagcatctctcggagcacctggagacagaaagagggaggctgggattagagaagggggtaaaaacttcagtggggaaagaagttgggaaccccaggggaggcttgcctgccaggattgtggggaagcccttgttctagaagtttgggggaccctatatctagggcttgcgtaatgcgcaacttgtagattaataataaatattcaactactacaggccaggcactgtgccccacacctctaatcccagcactctgggaggctgaggcaggtggatgacttgaggtcaggagttccagagcagcctggccaacatggtgaaacctcatctctaccaaaaataccaaaattaaccgggcatagtgctgcacgcctgtaatcccagctactcagtaggctgaggcaggagaatcacttgaacccaggaggccgaggttgcagtgagcagagagtgcaccactcccctgccacctgggcgacaagagtgagactctgtctcaaaagtaaaaataaggccaggcatggtggctcacacctgtaatcccggcactttgggaggccgagatgggcggctcacctgaggtgaggagttccagaccagcttggtcaacatggtgaaaccccttctctactaaaaatacagaattacccgggtgtggtggcgcatgtctgtaatcccagttacttgggaggctgaggcagggcaatcacttgaacccaggaggtggaggttgtggtgggctgagattgaaccattgcactccagcctgggcaacaagagcgaaactccgtcttaaaaaacaataataataataaaataaaaataaaaataattcaactactattacttaacagtaacagatgttgaaatacaggctcagagaagttaatgatttgtgcccggtcacacagccagcaaatggcagagatgggacttcacctctgggcaactgcactctgccgtccttcctgtgcaactctgaggaaccgacagtcttgcatcttggaggatgttccaaacaattttttttttttgagacagaatctcactctgttggccaggctggagtacagtggcacaatcctggctcactgcaatgtctgcctcctgggttcaagtgattctcctgcctcagccttctgagtaggtgggattacaagcacctgccactgtgcccagctaatttttgtatttttaatagagatggggtttcaccatgttggccagactggtcttgaactcccaacctcaagcaatagtcgtgtcctggcctcccaaagtgctgggattacaagcataagccaccatgcctggtcccaaacaaaatttttttttttttttttttgagatggaatctccctctgtcgcccaggctggagtgcagtggcacgatcttggctcactgcaagctccgcctcccaagttcatggcattctcctgcctcagcctcctgagtagctgggactacagactcaagccaccacgcctggccacattccacaatttagagaaaggtcacaacctggaatcctagggagaccccagttcacctcaaaactgccactaaggaggtaaaacgctgcccctctgaggcaggcttcagtttccctgtgtgtgaaattgacctggcgctgggagaggctggtggaggcgcggattttgcagtttccctacaacattctggaagcctgtggttctgggaaagggtggcgtggagaagactgggaaacagtcagtagttaccagacctgtcagcacctcctccgcctcggagctctggggctgggagtccccaggcttcggggggcccctgtggaggacacaggtggccccctccttcctgacatctcaggagagggagggggcaaccacctagg

SEQ ID NO: 545 - DNA, 95539 bp, Homo sapiens
cccgcgggggaatcgcagtgagcagcgcggggcgaggccgccgcggacgccccgtcggatgtgcccttcgctgggccgagcggcgcagggttggagagggaagcgctcgtgcccaccttgctcgcaggtgcccttgctgacctgggtgatggccttctccccgcggctctcggccctctggctggcggcgcgcagctggcagccgctcgggtaggtggtgccgtcgctgccgcacaccgggtagcggctcttgcacacgcacacgccgcttacacccggaccgccggctgctgccccggctttacccttccgcctcttgcggctcttcacgcactccatgcccggcgcgcagtaccccctgccggcgccgccacccccgcacggctcgccctcgccgcgggcgcacatagggcagcagccgcacgcgtcgcgggtctcgcccagcaggcagcccagcgggggcaggggcgggcaggaggccggctcgcaggggccgcaggtgtccgaagaggaggaagaggagaggggcaggagcaggagcagcagcccagcggcgccgaggagcagggcgcgcagcgacggccgctccatggcggggtgcggtggcagcggcaagggcgcgagtgagccgtgtcgggccggccggcgccttaaacccgccgccccgcccggcctgtccgcgggaaccacaccccggggcggtgagagcacgggggccccgcccgtgccgccctcccggccccgcggggcctgcgcgcgcgctcctgctggcgtcggggggtgagcgggcacccggcgtgaccggcccatgggcgctcggtctcacgcccgcttcgcagagctcaccccgccagctcctgctcggtccccagtcccctgccccgagccctcagggatcgcaccgcagtgcgagcggctcttccaccctctggtttctccccgtttccggtcaatatatttaaacttcttaacaaccacggcttcgagacgatccagggtttcatctattaaatcctccgtgggcctgagacacctgagtgctcattactctgtggtttgggaagctctcttaagaacaagctgttaaaaacccccacttgtggactgtgtccccgctggccacaggcctgctgtggtcttgggtgtcaagcactaaaaggacaaaccgttgccaaccacttccctttctggaacctcttaactgcctgcacctccctccccgctttgtctcccagtggcattcaacaagactctgtgctttttttgtgctgagccgttttcagtgagtactggaatccgtgtgagagctgtgcccttgttttgagttcttgctgaactgctcgccctccagcaagcctctcgggagaacagagcgcagctgagaggagcaggggtcccagctccttcctcgttggagctgccacggaggcacctaaagcgcccccagtcttcaccagcattccaggaggtttttgatataaacggtggactcttcctcagtctttctgcgaagtgctctgcaaactcaacttgaaagcctctcttcccaggaacactggcctctccaatgcagacatggaagttgctttcactttttaactgaatgtgtaacattgcagcgtgcattattctgcatgtcacattgtggttcttttgtgttcttttttcttagcataaatccagggatttacagggttgctgactgaaagccagcagttcagttcataatcccattagcagtgtaaagaactcattctcaacagactcttacaaggataattattgcaaattttttgaaaattaaatgaccacaaaatcggggggtggagagtggggaaacatcctccaatccagaaaaacctagcactgctttttggcctctccttagtgtattatagacaagtggagcattttttttcccctcaaaggtcatatgttgacctgacagttgtttaaaaaacaatgaaaaatctttacagcagagtttccctaaatatttttgtctttgttccatcctaagagatgcagtttacatgacccatttgttttcttgaaaaggaaacaaatgcagagtgcactctatttcctattgtatttaatttctttctttctttcttttcttttctttctttttcttttttttatttttttgagatgaagtctccctgtgtcgcctagtctggagtgcagtggtgagattttggctcactgcaacctctgcctcccagcttcaaacaatccttctgcctcagcctcccgagtagctggtattacaggcatgcaccaacatgcccggctaatttttgtatttttactagagacagggtttcaccatgttgcccaggctggtctcaaactcctgacctcaagtgatccacctgcctcggcctccgaaagtgttgggattacaggtgtgagccactatgcccggccctgatttcctttttattaattcactggtcaagagccactaaattggttccatgatctagtatgacgatctgtcatagttttagattctccagaagctttctctgagacaaggattccagtgcaagtaggtcacctgagaagccacatcaggacacagagattgagggttggggcaggcaggtgagcaagcaggaagggaagacagccaataaaggtgcttatctccgcagccagaagaagccctcaggctctacaaactgtgtgtgtgtgtgtgtgtgtgtgtgtgtgtgtgtgtgtgtttgcgtgtgtagggcatgtgggtgggcagtggcagcagctgtacactaagagctgtcacccacagtgtgtggaggtcctgcatcagagccaacagtgagaatgcaagcatgtgctacagcggagtccctttgaggaacctcctcactgcccagcaagcaaagaaaacaagcaagtttctggtcactgaaaggggaacccgagctctgtgatagtgccagtcgagctggaggacctgaaaacaagaagagatgttagaaaaaaggcaggtgaatggagcctttaaagagcaagttgacaactccacccttccaataacagatatattgtcacctgttcagcttcagttttagtgaggtggagaggctggatgtggagatggagatatttttacttcttcctgtttaattggtgccttttgtttctttttcttgcttaattgccctggttagaacctccagtataatgttgaatagaagaggtgagtggacacccttgtcccagtcctcaccttagagggaaagttgttagtttttcaccactaagtatgaagttagctgtgggcatttcatagacagtcttaccaggttgaggaaattcctttctattctgttgattgtttttcatcatgaagtggtgttgaattttcttttcttttcttttctttctttttttttgagacggtgtctcgctctgttgcccaggctggagtgcagtggcgcaatcttggctcactgcaacctccacctcccgggttcaagccattctcctgcctcagcctcctgagtagctgggattacaggcacatactaccccgctcagctaatttttgtatttttaggaaagactgggtttcatcatgttggtcaggctggtctcgaactcttgacctcgtgatccgcctgcctcagccttcccagagtgctggaattacaggtgtgagccatcacgcctgacagagagtacattttaaatgttcttgcctcaaaaatgataagtatgtgaggtaaagaatatgttacttagcttaatctagtcattccacaatacatacatatataaaaacatcatgtacactgtaaatatacacaattttttgtgaattaaaatttttttaatgtttaaaaagaatcattcctgctttctgagagcaccccatccatagcaacctcctgcttccttagaccttcccctaaattactcaaccaaagtccaaatcctataataggctctttctaacacccccttactgagacccccatagttccatatggtgtctatcctcccttgctacaatgagtgataaactcaacttattcaactacaggtgcattcctgtgatctttggctgaagggtaatgatgcaagagatatatgtccccctcccttctacactacttcagctcaatattcccccagcccacaggacactcccaaaccctttgccgatgggtccttgtacctggcgagcacccttcttggtggagtatctctaagactactcagtctggcaagtttcttgatatctgtgggaaacccgtggtgctgtgcagcctgcccctgtgaagtccctctatgtccagccagtacagggccagaagccagcctgcctattcaggagacatctaattggacaacggaatgcttgtctctttttcttgcaaacatcacagacctcttggctccgttatccttgtcttcttaggagttgggggtggggcggtgattaaggggaggagaaacctgctttctccagtaagctctcaccccaaacctgtttatatgtgcctgtgtgtgtgggggggtggggggatggtgtgtggggcttgtggtgcttgtggcagggacatgtagcattgaggagcattctggttcaattttttttttttttgagacaaggtcttgctctgtcacctaggctagagtgcagtggtacaatcatagctcactgcagcctcaaattcctgggcccaagcgatccccctattcagcctcctaaataactgagattacaggtgcataccaccatacctgactattaataatttttctttgcttttgtagagacagagtctcattatattgctcaggctggtctccaactcctgatgtcaagtaatcctcctgccttggccccccaaagtgctgggattataggcatgagccaccacacctggccctggtccaatttttggtggctctgctttagaatgtggggacacgcagaacctatagttttgggttgtagatcctagtgccattttttaggcaaaggaagagttgttctattcaacagtctgttacaatagttatctatcatctttattatttcatttttttctcctttctctccttcatcgttatcaccattagtaagtcagagattgtcaggtgatggggtagggtgtatctgatcacccaaactcggataaacagtgcatgaaaaggggctaagccagtggaaaccactttggcatgttccagctgccacaagaagttcagcttagctgaagcaaggtgagtatgtggagaagtgggaagaaatgagtctggagagagggcagatgacagataatgaagggccttgcacactgcacccagagctttggactgcatcttatagatgactgtgaactgttgaggggtgcaggggagaggcaaggtcaggttgtggtgttggaaggtcattacagaagtaagagggaaatgaatcataacagggacagacttgaagaaggaatgcagtttccacaatgcaggggctacagtcagcctatgctgttcctttatggtaattaaaaaaaaccacctctactgggcagatgcagcactgagggttcaagacttggcaagcaggtggttgctttgtgtgaagaaaaaggcgtccctttctccgatgaagcagacccagtccacatgaagatgcgtggcccagcaggtggagaactgaattatagttttccttgctccctgggctgggtgcccttgtgcagtatgcaaattgcatgcccctaccggggagcgtggcctcatgctaatagtgtgtctggtacagaattggcaatcaattaaaattttttttcttttttttttttttttttttgagttggtgttttgctcttgtcacccaagctggagtgcagtggtgcaatctcgtctcactgcaacttctgcctcccaggttcaagcgattctcctgcctcagcctcctgagtagctggggttacaggtgcccaccaccatgcctggctagtttttgtatttttagtagagatggggtttcaccatattggccaagctggtctcgaactcctgacctcaggtgatccaccaacctcagcctccctgatggtattacaagcatgagccatggcgcccggccgattaaaaaattttaaaagtaaatggaccaaagggaaaatcaattggcagctcctactgccaactactactaccatccaggtaggaattagcaagggcctgaagtcagttgtggcaatgggagtcgaagtagagacagtatcatttgtctatacctggactcttgtgagtgaaagggagcactgttcatgattatgctgggacaatgggcataaatcaagactgtcctggacaatagagacatattgttacccgaaatagagatgaagagatggacaagagatcttaaagaagtagaatatgcaggtcctgtaaagaaactgactggaggaaagtcaagagaaaccccaacatttctcccttgggggactcggtgccagtctctgccacagccagtttgtgttgggggaagaggatgagcttgattttggactcgttctttacaaatcaagactgccttttgtggacagttctggagaggaaggaggggggctccctagcgatcatatcacattgtatcagaggcattgcagggcatttggctgagagtaagcccttgaggtaaagtccctcactgataacatctcactgtgtaataaaggacataaactgatttcttatcagtattctgcatctcatctcttaaaagaggtactgccatgcaggaaaatagctaattatataattgaaaaggcattaatagcctgtaaaattcaatattagagacacagaacttgaaggactcgctagaggtcatttaaagccaggtgactggatccattagccctgatcctaagtcatcaggggcacagaaatatctaaagaaccctcagaaatcatcaaggaagatttttttttttgtgtggtcagtcttgtgttctgctctgttatttaactgcctttcacatcaggaagatttgaggtcactgcataatagccaacttccaaatatacacagttgaaaagaaaatttagattttaaactgtgatcctgactatattgcatatatcatgagaggcttttgaacccagaatagcctcatttcctgtcttaaaattcattatcttaacactttaactttgcattaacacagacttttacatttacatttccctgtaaaataaattagaaaacatttctttttgtgacaacaagtagaaaaaaatgtctttgggttattccataattaggcttcatctttcttttgttatggggaaatgatatgatcatttggtggcaaatgatgcagtgccccatattaatctcccagtggcccgatttcataattcaacttggcaaagtagacaaataaaaaataaaaatctctcctcatcatcgtaagaggctcgggagaaagtcaaatcaggaaaaataaaatattttcagtggttttttcagacttcactatgaataaaactttgtgcccaggaaggagtttcttgggtgtttttgaatgtttaggaggatatttatcctgcaagcattgattcctttccttctgaacagatgatcagctgggatgttaagatgttaacaacatttctttcatgcatgctagtttgttttattttgttttagcttgttaagatgttagaataactacattcctttcaccgatgctgaagattcacctttttaagaaagagtcactgatcacatgaatgacatagatgttgctttatctgcctctgcagtgcagctacctggctggtgtcagcctcttgggtgaataacaggcgaatttcaatattgtcagagtctatagctgtcaagcttcagatctaacttccttaatgctaagccacttccctgtgtagtgtcttctcataacatcattgcttattggtaatgcttgctttaaaagagaaatgtggatgtgtccgaatagaggaaatcctggaaaactttaagtccctcttctttttgattcttgttgagtggcattctctcaggccatttgagtatattcccatgccttattgagaaatagcatttttaggttttccctgaggttcaaaggttaaatatttgtcctcatgttacataaaattgggtcctggaagcccatgtgacacagtagagatggtgattggcttgaatgtcagggtcttcaggagcagggcaggttccctgtggctttcttacagcagggcaagtgatttgggaatgagatattcaagagacaggagggaagatacaatttcaagaggaaggaacaagtgtctttgggctgcagtaaaatctctagcgttctgtgtgtggttcctggtttcaggaaggaatggggcaggttagggcatagctgaggagtgtagtgggggcttgcatggcctcaaagggtcagaagtagacccaactgaaggtcctgttatcctggtagatcttcagtgagaggtttaggaggggctatgtggtggcaatgatgcctgtgtaggaaaacctcctacctctttagccattgaaatgaagagatggacatccagaagtctaggaaaattggcttaatgcaagaaagcaacactttccagctttatgtgcctctcagaactcatcttgctaaatctttttgggtcacttgcaaacacaattggtaattctataccaattgtgtttgcaagaagaggataattcgtgactgaataaaagctattctcaggcataaggccgagtgtggtggcttacacctgtaatcccagcactttgggaggccaaggcaggtggatcacctgaggtcaggagtttgagaccagctttgccaacatggtgaaaccctgtctctattaaaatacaaaaattagccgggctcgttggcacgcacctgtagtcccagctacttgagaggctgaggcaggagaattgcttgaaccctggaggtggaggttgcagcgagcagagagcacaccactgcactccagcctgggtgacagagtgagattctgtctcaaaaaaataaaaaagtattcctaggtgtgaatgcaccaaaccaattagaacatacatcattcttaatctgggcctcttgcagcagctctggtcaattgagggtttatactcagataaatatcattgagttatcacgccctgtttaatgagaagaatgccagacttcttataattcttcataaagccattaccaacctgccctctgtgtgcctcactcgatccctgtctttgacctcctgatgtgccaagttgaatgactttcggtctcccagaatagccgtcctctttagatgtctcacatgtgatttcttctttctggaattccctgggaagacagcttttacctcatcccaagcctctgttttctttaggaatacagccttgcctcctctgcccacttcccttctgggagttgtcttgctattgagttccagccaagtctagaatcctgtctgacgccactcctctctgtgtagacgtctgcccagtgtctgccccggaagtgcagctccctctctctgagccgctctgagtttggttgctgtcttggactgctttcacttgtccctgttgtattctccacaaacatgtccacatgccaggctgagctctttcttccactgctgtagcgggctcgtcccacagagctttattcctcccagtgagcccctcacatcctagcttcaggcctttcccagcccatctggccacccactgcctttgctaagccctttctctttccctgagggcttttagggtaggaagaaaaataaactctatgactggattcatttggaatttggctgtcagagtcatgttctcttcttttgggtctatttaaaaagcatccagcgcccatgggaagcaataacccttcccaaagggctaaggcaatctgctccgacccccggagcatccttcctcatccttcacatctcagagcagacatcggtctctgctggaagagtctttctaaccttcaggtctcacagaggtctcccatgcccctcactcagtgcattctccattttagctttactgcactgtatataaccaccagatctcaaggacaatgatagctttaaaaactgatttgccattgccgtatctccagcactcagctcaataggtgcatgagtgaatgaatgaatgaatgatttctctgcacatcttccactgattagctctctgttgcctaagacatctcagttaccattcattcttcagactttgttttttattcctttcttctcttattccagtttctagcacttgttagctatatgaccttgggtaagtgactaaacctctttgtgcctcagttttatctgtaacatggagtaatagtattacccatctcatgaggttgtggggagattgaatggagcagtgcttggcacataataaaccctcaataaatatgatgattgaattatttcctgtgctttccttgatgttttcacaggattattaaccatgattttgttaaaattgactaatagaatagaataattacttgttgcaacttctcttgctctcttgctaaattgaggagaattatatagttttattttccttttcctttgctcctccacttgatccctcccatatttttggagggactcaggcttttgggtggggaggtggtgagtagttcctcctagggctgaattactttgcaggtaacacttggaatattagagatacctaatgttggacttaagtttgaaagtctttcaatagttttataaggtcaaaacaaacttttttaaagcaaccctacgtgaacactgataaagttaaaatgatgactgagaaaaagtggtgtcaacttaaataacagagagatgccgtctaaaagaaataatatttacttgggaacaggcattgcaataggaatacatgtgccaataggaatacatgtgaactatgtgtgtattcaggaaggtaaaagaagacaatggcttttaaaggaaaatgagagggttgcatagttgttttgagataattatcctgggttataaggatcaataacaagggtggtgccggttcaaggttggacaaatcttctgggcagatgtccttgccgaagtattgtttttatataagattgtgatggtctttgtgcaaggttgtggtttttgctgaatctttagtgatagttcttgttattaggcgtttgtgtgtgataaccttcttttcatggccttccctggcttcttttgttagggtttttaacacaagcgtctccattttgattccaacaactttcacagtggaaacttgtatgtgtagggctggtcattccagcccaacttgcaaagactttcaagctggacctctgtgcatccgctaatggggagtctgtgggaggatagtacctcttgaagagtgcagcctcctgtgtgcccatggggttcttcgtgaagagtttcatggttgctgcttcagaactactgagatttgggaattctcctttcttgttcttttaaaataagcaataagtcaaaggggtttttgactgcccttttttttttttctgggggagagtcttgctatgtcacccaggctggagtgcaatggcacgatctcagctcactgcaacctccacctcctggggttcaagcgattctcctgcctcagcctcctgagtagctgtttacaggtgcatgccaccatgtctggctactttttgtatttttagtagagacgcggttttatcatgttggccaggctggccttggccaggaggccttggcctcccaaagtgctgggattacaggtgtgagccactgcacccaggcttgactgctttttaaattctcaatctcaaagaataataaataatatttgaatagtaaccatactagttttagccctgtgttggttaattttatgtgtcaacttgattgagctaagagatgcccagatagctggtaaagctttatttctgggtgtctatggggctgtttctggaagagattagcatttgaatgagtagactgagtacagaagatcttcctcgctaatatgggtaggcatcatccaatcccctgagggataaaatagaacaaagaggcagaagaaaggcaaattctctttttctctgtctttgagctgggatatccatctggcctttggacaatggagtgcctagtttttgggcctttggactctgggacttaaactgattactgcacccccttcccacctgctgtccaacctcctccaggttctcataccttctgcttcagttttgccatcagctccctcccctggtcctctggtctttgtactctgactgcattacgccaccagtttttctgggtctcttgcttgcagacagcatatcatgggacttcttggcctccataatcacatgagccaattgtcctaataagccaattgtcctctttatctctatctctatctctgtcttatctccaactatatctctcttattggttctatttctttggcaaaccctgactaatccaagccctctgatgatgagacacattttttgtttttcaaaagtagttctggtccttcactttaaagggcaaagtggacctatgtccactttggttctgctcacaaacaggggttgattccaaggggctggagtagggctgttttatccatctttattatcttccatggagcagaagtgatggcagttatcaatatccagtctgcatttaatcaccccatttgaagcaggtttatggcaagtctgcctttgctctataggaacaacagtaaacagctgactggcccaattttttggaagatgagtgtctcctacgaatctcacaagcattgcatgttctacctgttgcaatattcgtctttttggaaaaagtgcctgcagatttcaatgtaacttgcttaatattcatagattcttactctcttctcttccaggaaaatattgttaattttaaggtgagtatcagggaggttgtaggaatttgatcaagcagaaccatgataagaaaagccaacagatgctttggaaattccttataattctggccttaataatggaaggaatgacagttttattagttttctattgttgcttaacaaatcactacaaagttttcagcttgtaggcttgactgggttctctgcctaggctgaaatgaaagtgtgggctgggttgggcttttatttggtggctctgggaagaattcacttctaagatcattcaggtttttggcagaattcagttccttgtggttgtaggactgagttccctgcttccttgctggatgttgttggacagctctctggtcctccttgcacatggcccctccatcttcaaagccagcaatatggcatattcagtctttctagtgcttcagatctctctgacttcctcttctgctactacccagagaaaattgtgctttcaaagggttcatgtgattagagaagacttacttggatcatttcccttttgatgaattcagagtctactgatcagtaataatgtaattatttttgcaaaatcccgtttgccaggtaatgtaacatagccacagacatgatatcacatcctattcctagtcctggagattagggcaggaaatcttgggtggtcagtttagagttctgcccaccacagttgtcaaatattgttttctcaaactaactctttgctgaaactgagctctgggatttcccttgcttgtttttgtttgcctgtgaaccatacagttggttatgctatatatctttttttttttttttttgagaaagaatttcattctgtcaccaaggctagggtgtagtggcatgatcttggctcattgcaatgcccacctcctgggctcacgtgatcctcctgcctcagcctcccaagtagctgggactacaggtgtatattaccatgcccagctaattttttgtagagacctgtttttggcatgttgcccaggctggtcttgaactcctggactcaagcaattcacccacctcagactcccacagtgctgggattataggtgtgagccaccacacctggcctatatcttatcaatggaattgtattctctggctcaaacaagatgccattctccagggcacttattcctggggttcatctattggttttggactttgaggtttggtgtcctccttgcacatggcccctccatcttcaaagccagcaatggcatattcagtctttctagtgcttcagatttctctgacgtcctcttctgttactacccagagaaaactttgcttcaaagggttcatgtgattagagtaggctcacttggattgtttcccttttgattaactcaaagtctaatggtcagtaataatttaattattttgacaaaataatgattttaaaatagaattattttaatttaaccaaagcaccaaagcaccatttttgcttggaccacacaagggagagataagagaagcagaaagcagccaacacaaccttggctagcttccaaacctgtgtcttttagtgttacaagtacatatagaattgctgctgtattcacagaccaacaattatctcattaaataacttcccaagccttgatttagccattatgaaagatgttttgataaagaacatctggtgttgttttcaattaaatattgcaccactaaactttgattaaaaactgatttaaaattttaatagtccctcctttagaagatggcaaaatgcaaaaaagaaaaatgtcactcatttaaattgtttttttctctcctttgttgctctattttaactggattcccattaatgactgtttaaaacccacacaattttggatgcagtaaatagagatacataaataagattaccataccaatactgctgttctcactcttttactactgatacttcattttgtttttatgctttaattaaattgagtatattttatgtttcagtttgctttaaaacaacggcagtgcacataattgacactatttcatcccatgatagaaagtgctgaattgaattaaacataccagttccatttccctttacatttaatctgtggcaaaactaaggcagaaataatatgaactatatttcttctccaagttgccgtggtaggtgaaaataactaaccatctaataattactaataaaggctgaaatgaaatctttactgttagtgtaactcttatctatataaaaatagatatttagtggtataagctaattttacttagtaattttccccaagtggcatgtaacaaataataaacacataattgctattccatgtactccatatcaagcataaatcttcaagcacaaattttaatatatttttactcagactatcaggtttagcctaagtatttatagtagggaaatgatattatgcaatgtttctatagaatagggattgatgaacttttgtaaagggccagatagtagatattttcaactttttgtgggccatactatctcacaactacataactcagctgttacaatatgaatacagccatagacgatatgtaaacaaatgagtatagctgtgttccataaaattttatttacaaaaactggtgatgggccaggtttgacctgtgggctgtggtttaataggctgacccctattattgaggataatgaccaagtgctagctaatgttcacagctgagaaaaatcaataggtcagttcatgaattaaggtcccgcatatacttttgttatcgtaggtatttttttgtttttcttgcaatagtttgtcttaatttaatctgttgattcccatgtgggaatttcctccccaatcttgtattttaaaatagggacctatgctcatccacatttccgcaagtctaaattaagtcatcatataattaccgtgattaaaattacctatcttctcttctgcagtggttcaggcaacaattgtaacatgtttatcttacacaaacttggattaagtcaggccagactttgcaagctcttggcttcataccatttgatatgatttttctctgcatccccacccaaatttcatctcgagttgtgatccttggtgttggaggaggggccttgtgggaggtgattggatcatgggagtggattcccccgatgctgttcttgtgatagtgagttctcaagagctgatagtataaaagtatgtggcacttacccttttgatctctcctaccaccatgtgaaggtgtttgcttcctcttctgctatgattgtaagtttcctgaggctcccagtcatgcttcctgtgaagcctgaggaattgtgagtcaatgaaatctcttttctttataaattacccagtcttaggtagttctttatagcagtgtgaaaatggactaatacaccactgcactctgttgcccaggctggagtgcagtggtgccatcatcactcactgcagccttgaactcctgggctgaggtgattctcccacatcagcctcccaagtagctgcagctatgggtatgcaccatgatgcctggctaatttttaaattttttgtagagatgggggggtctatctatgttgcccagactggtcttgaactcctagcctcaagtgaccttggcctcccaaagtgtgaggattatgggtatgagctatggtgccagcccccattgtattttagatatcattttggttttgggaggcaagagggtcaagtacagtgatacggtttggctgtgtctccacccaaatgtcaccttgaattgtaataatccccacatgtcaagggtggggccaggtgaagatcaatgaatcatgggtgtggtttctctcatactgttctcatgttagtgaataagtctcatgagatctgatggttttataaatgggagttcccctgcacaagctctcttgcctgccaccatctaagatgcacctttgcttctcccttatcttctgccgtgattgtgaggcctcctcagccatgctgaactgtgaattcattaaacctcttttcttcataaattacccagtcccagatatgtctttattagcagcatgagaacaaactaatacagtaattggtactggtagagtggggtgctgctgtaaagatacctgaaaatgtggaagtgactttgatactgggtaacaggcagaggttggaacagtttggagggctcagaagaggataggaagatgtgggaaagttttaaacttcctagagacttttgaatggctttggccaaaatgctgatagtgatatggacaatgaagtccaggttgaggtggtctcagatggagatgacaaactgttgggaaatggaacaaaggtgactgttgccatgttttaacaaagagactgatggcattttgcccctgccctagagatctgcggaaatttgaatttgagagagatgatttagggtatctggcaaatgaaatttctaagcagcaaagtgttcaagaggtgacttgggtgctgttaaaagcattcagctttatgtattcacaaagatatggtttggaattggaacttatgtttaaaagggaagaagagcagaaaatgtgcagcctaatgatgtggtagaaaagaaaaacccattttctgaggagaaattcaagctggctctagaaatatacgtaagtaatgaggagccaaatgttaactgccaagacaatggggaaaatgtctacaggggatgtcagaggtcttcatggcatcccctcccatcacaggtccagaggctaaggaggaaaaaatggtttcctgggctgggcccagtgccttgctgctttgtgcaatcttgggacttggtgccctatgtcccagccagggctaaaaggggccaccgtaaaggtcaggctgctgctttagagggtacaagccccaagctttggtggctcacacgtggggttgggcctgtgggtgcacagaagtcaagaattgaggtttgggaaatactgcctggatttcagaggatgtatggaaatacctgaatgtccaggcagaggtgtgctgcaggggcaaagccctcatttagaacctctgctagggcagtgcagaaaggaaatatggggtgtgagctcccacacagagtccccactggggcactgcctagtggagctgtaagaagagggccatcatcctccagatcccagaatggtagatacattgacagtttgcactgtgtgcctgaaaaagccacagacactcaatgccagcctgcgaaaacagccaggagcggggctgtacccctcaaagccacagggtagaagctgctcaagaccatgagaacccacctttttcattggtgtgacctggatctgagacatggagttcaaaggagatcattttggagctttaagatttaactgccctgctggattttggacttgtatggggcctatagccccttaattttggcaaatttctcccatttggaatgggtgcatttatccaacgcctgtaccccaattgtatctaggaagtaacttacttgcttttgattttacaggctcctaggcggaagggacttgccttatctcagatgagactgtggacttttgagttaatgctgaaatgagttaagactttggggaactgctgggaaggcatgattggttttgaaatgtgaggacatgagattttggaggggccaggggtggaatgatgtggtttggctctgtgtcccccccaaaatcttaccttgaattgtcaagagaagggccaggtggagataattgaatcatgggggtggtttccctcatactgttctcatggtagtgaatacgtttcatgagatctgatggttttataaatgggagttcccttgcacaagctctcttgcctgctaccatgtaagatgtgcctttgcttctcctttgtcttctgccatgattgtgaggcctccccagacatgctgaactgtgggtccaataaacctctttcctttataaattaccatgtcttgggtatgtctttattagcagcatgagaacagactaatacacacagtgagaaagtcaagaagcatttctttaatggactttgaaaactagatactatgattttgccaataagcaggaaagacatttttctttctttttgattttgtgcatgatggttgttttccatatacaaaatgtagtatatgcctgtctcacattcatgtcatattcgcatagtgactttgccacccatagctttctataggtgcagtatttgtattcaagaacagttactgacttccacatcaattgctttgtagcggaatagctgcctcctggtctatagtggctgacatgaattcactttttaagggggctattgcctcaataaaaagttagaatctggagatgttgatttgcagaggagtgtacacacctggcctgccaaacaactttcatcatatgaataggctgaggtggcttacacaaaaacaaaaaaaaaggacctctttttcttaaagcactaatattttgttgtgtaggcaacattgccttacatgtttaaaacatattgtttttgggaggaattaataatatgtattattgggttgttgggaggaattaataatatgtatacataattttattgagggtttattatgtacctggaattttgcacatgttttctctaatctttacaataatcatatgcagtaggaattactggcactttacttgcacagaaaggaagccttaactgacttgtggaagatggcaaaggtggtaaagaggagttgggattcctgcttaggcctctttggaagcaaagctcttgtctgtctttctcttatgatactttctgtttttttaggagacagggtcttgctctgttgtccaggctggagtgtagtggcacaatcatagctcacagtatccttgaattcctgggctcaagcaatcctcctgtttcagcctcttgtgtagctaggaccacaggtgtgtgccactcacctgatggggtcttgctacgttgcccaggctggtctcaaactcctagcctcaagtgatcctcctgcttctgactcccaaaatgctgggattacaggtgtgagccatcatacccagacagatatgttttgatatagctccaggccagtggttctcaaagcctgggccccaccctggagtaatttatttacaatatctagggcaggatctgggtgtgtagatatatttatagattttattttttagagcagttttaagttctcagcaagattgagcagcaagtacagagagtacttatataccctcttccccacacaggcattagcctcctctgcatttatagaaagctatgagtggcaaaggcactatgatgatggcaatatgacatgaatgtgggccaggcatatattatatttttcatcccccagcaaagtggtacatttgttagaattgatgaacctccatcgacacatcattatcactcagaatccatagtttacattagggtccactcttggtgttttatattctatgggcttgggaaaatatataatgacatgtatgcaccattatagtatcatacaaactctttccactgccctaaaaatgccctgtgcctgcttatttatctttccttccccactaacccctggcaactgctaatccgttttgctgtctccatagtttttccttttcctgaatattacagagttggaatcacagcacatgtacctttacaggttggcttctttcacttagcagtatgcatttaaggtttctctcaggatgtggagagttttaaaaagcaccccagggaatgttaacatgcagccagttttgtgaaccactggtctcaggggtgaaatctagaaacagccagcatttaggtaaagactgggcttctccttgccgctaagagggcaaagttgatcttcatcgcccttgctgtgtttccccatgttgctgagctgcccagtggccttcagcaggaagtcataccctcgctaggaacacagctcgtcatggcctcttgtacctggaatgggtgtcagattctggccccattcttgtaaataaatctctgggttatccctgctaaggatctttgggtggcattttattatctgattcttacctttctcttgcaaagaagcctggagcaagtccttagcagaggttgaaccaaggtgtttccgactttgggaaaaggagtggttaatttagaatgacaggatctgggaatgagatgaaatctgagttgaattctgaaataaggctataacatctatagcatgacagtggggtagggctgtttgggatgaggctttctggaaaggagggaacagtttgagacaagatctgaagcagggaagacagggtgacttaacaaaaatgtgagtgcctatcagagccaggggttttgagtagcccacaggaatggggtagtgatgtgttgtacatgcacttgcgggagataactctgcaaaggctgatgagtcctctctgaggcatgttttagtgtcttcttcacctgtagatccctggagactcaccacctctcataacctttggaaagggtagcttctgactcttcttccttgacatggcagattggaccaaggctgaatgctagaactagttttcagtttagttttagcattcagccttggttcaatttctgtatttgttggttcagatgcccaggggagatcatctagctggcaagagaaccaatcagatggtctcatgtgagcatttgaaccaacaaatatagaaatttcatagtagagggccctgattgtgaaccatcatgcatttaataagtgctgattatctgcctcatgctgttctagggcctattgatacagggatgtacaaggcaaagtccttctttcacagacattaggtttaaatgggaaaatgcacaagtaaataaataagaaaatgtcaggtcataacaaaggcaatggatgaaacagggtcctttgaccgagtgtaatcaggagaaacagatgtcatcaaatggtgggcttggggggagatcagagaagacccttgaaagaatgtgacagggattaatagatatggagtccaaggcaaaaattaggaaaagagttgactagagcatgtgtgtctcatgacagaactagagttggggggagctttgtggtccctcgagatttagggagccacaggtgattcctggttaatttttggttcctttgagccatttcctcccttgcattcttttaataacatctctacacacacacacatacacacatacacacacacacacgcacctacacacaccctctcctgagctcgcttaagtggatcttgcatcttgcatgccaaagtgcttaaaaacagggataaattgaggaagattctgaatggtagtctgtggttttggactttgttctgtctcagaaagggcttttgagcgctatagagtgtctttatgcagtggtgtcagggagaacacattcctttttcgaggatggaaagctactgattgtactgaagctcgcattcctctgccaactgctggaacaggaaaaacaaccatcatcctgactgccagcagtctggccagacaccacctgttctcagtgcctgtgtggggtgtttagcttagctaggcagctccaacagcacctggaatgcaaaaacatcctgaatttctccaaacaccacagcaggactgtttaaacagcaagacattcaggaaatagtcattatctccacacctcctgcattcaatagggtggattgttggatgagcttcagagggcagctccagtgagtgccaagtcctcccggaccagatctcccatccacatgcatgtgccacctgtgggccaatgggtctgggcttctcaggttattggagaggaagttgggcttgattctgtctccctgtgtggagtcctttctgtataccaaatgaactgtcagcatcagcacaaaaaatgggtgcagacttgtgcagggaagaggaagactgctgctgttgcacatattttctatagggagcattttggactattattagggggaaaaggtggaggtgggtgggcgagtctcatctgtctcatttgccttgggatagagaaaggatgtactggtagtcatcagccagtgtcttccttcccttcatttgccccatttttttccccatatttggcaggagtccaaagcaaaccattgatgatcaagcactggatgacagcagtttggtctggttaatattctcatcaaggaatgaggttggtaattaacaactatatgagacttccaaaatactttcattttacaactgcctattgtaaccctctagtgtaccctgatgtgcatacctgttcttttgcggttttaaaactttactgaaaagccaaacactttattcaagtgaattttacagatctggattaggaagcagatcaactgagcttcttcctaggaagaagctaaaagatgctggaataaatcagaaatatggcacttttaaaactcaggtttccacctactattattttaaaaagcatcaaaatgtatatcatttttggtcctaatgaagtagagccccttatgtgaaaataaaaacaaaagcaaaacactcttcgatggtgggggccaatttggtctgaatgttttgatgactccagcatgcctgcagttcatttggccccaaccagtcccagcaaggtagctgacagaggcctgaagttggcagttgcagtcagctgaaattctgaaacccagcaacacatcacttagtcccacttactgagaaaaaatgatttactctatcatatgcactgtaatcccttaatgcctcccaaaatgtatctggtttggaaaatctcacacaacctggataataacacatatttcagaaaagagaatgttttgttaacaagaaaggcaaaacaaaacacagtaaaatcaccctgaaaaagccatgtaagctgcttctattcctagtgactctgagggacttggtataacggaacagtgctttgtagctaggaaaaatggaaaatcagtgaaatggaagacaattgcaaataagtcaaaatattatgttaatgataagtgtatgtaattgtctcttgttctgaacataaaggagaaggtatatattttttttcaagtgaagttagttggtttctccctactctcactaaaaatgtgttgagtcaatatttgaagaattggcacaaaccattagccagcccagagaacccatgtgcctcagtgagtctgataaggtggtatcccaatatacgtcaaataagagtaaggcctctctgactgaagaggaaggctggagacccacagcttcgccccttgctagctgcttttgagtatcttctgtgaagcaacttgcaaaccatggctctactggatcattgtttgatgactcctaatctttatttctttttctgtcttcaccagtctactctcactccatttttgtcttttctaccacccctaagctggtgttttccaaagctagtgctcacagcagtgctggtccctgatgaagttcacactactatctgaagagtggtggaagaaaggcacaatttagtgagtttttgcaaagccaaattgttctatttaagacttttttttcattatgagataatatctgcttattttttggttgttaaaatgttcttttttaatgaaatgatgagaatagcagatttttaaaaattcttttttttgggcaaaatagaaaattactagccctatattagtccccaggttttttttttttaattaaaatcacactttttgggtaaaattccaaaatctaggcatcattattttaaggtacatttaaaaaatttaatggatacataatattttacatatttatggggtgatattttgttacatgcatagaaagtgtaatgataagtctgggtatttggtgtatccatcaccttgaatatttatcatttctttttttttttttttttttttttgagatggaggctggagtgcagtggcatgatctcagctcactgcaacctccacctcctgggttcaagtgattcttgtgcctcagcctcccaagtagctgggattacaggcgtgtgccaccatactcagctaatttttgtatttttagtagagatgggattttacctgtttgccaggctggtcttgaactcctggcttcaagtgatctgaccgacttggactcccaaagtgctgggactataggcgtgagccactgtgcctgaccagtatttatcatttctgtgtgttggtaatatttcaagttatctcttccagctattttgaaatatacaccttgttgctaactatagtcactccactttgctatcaaatattataacttttaacttctatagaactgtaagtttgtacccattaactaaactctctttatccctcctcacccccacataaccttctcagtctctggtacctattattctactctctacttccatgagatcaactttttttagctcccaggtatgagtgagaacgtgtgatatttgtctttctgtgcctggcttattccatttaacataatgacctccagttccatccaagttgctgcaaatgacatgatttcattctttttatggctgaatggaactccatcgcgaatataccacgttttcttttctttctttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgtgcccggctaattttttgtatttttagtagagacggggtttcaccttgttagccaggatggtctcgatctcctgacctcatgatccacccgcctcggcctcccaaagtgctgggattacaggcgtgagccaccgcgcccggccatataccacgttttctttctttagtttaaaaatgaaagcaaatttgttaagaaagtaaagaaataaaagaatggctaccccatacgcagagcagtagcatgggctgctagactgagtatacttgtagttatttcttgattgcatgctaaacaaggggtggattattcaccagtttttaaggaaaggggtggagatttcctggaatgagggttcctccatttttttaaagactatatagggtaacttctggacgttgctattgcatttgtaaactgtcatggcgctggtgggagtgccttttagcattgctaacgcattcataataagcatataatggctgggtgtggtggctcatacctgtaattccagcacgttgggaggcccaggcaggtagattgcttgaggccaggagttcgataccagcctggccaacatggagaaaccctgtctctattaaaaatacaaaaaattagccaaacatgtggtgtgcacctggattcccaactacttggctgaggcacgagaattgcttgaacccaggaggtggaggctgcagtgagctgagatcatgccactgcactccagcctgggcaacacagtgagactctgtctcaaaagaaaaaatagcatataatgagcagtgagaatggctagaggtcactttcattgccatcttggttttggtgggttttagccagcttctttaccacatcctattttatcagcagggtttttgtaagctgtatcctgtgataccagtcctgtccacctcttatttcatctgtgactaagaatgcctaacctcctaggaatgcagcagctcttagccttttttatccagcccctattcaagatggagtcactgcctctgacatatttccccccttccttttacaagggaaccctcaatcctaagggttgtagagggatgaaaactcatcttctgtaacttcttcaggctaaataggggcaatgataatcctgcctaactattagggtatttgtatctaggacagagaagaactcaatcagaaagtgtcaatatgctgagggtcattcataactctgagttccaacaaaaggtgatatctggaagattaataagtgttcaatttaagaaaatgttgagtaagcttatcctacattcctacaaagggtacaacagcaatatatgccacaacagcaaagcaaaataagtaaaattatcccaagtaaactaaatagctttccatgaactgggcaattgtgggaaccaagctgatatggagttgctagctggttccagtgtgtgccagaattagaatactgatctagatttttacattacccatcccttttgtttcttctgagctgcagccagagatcactggttgattcacaggaataatcagggttagtctaaattgcaggaaaaaacttaaaaacaactgatgagattagaatctaataacaagtgtaccatggtttttgaaacatactttttctcttcccagttctcattttgattaaaaacaaatcatgatagcactgaattgtttgcaaaataagctttagtcttagacttggcctgattatttatataaagtgtaggaagaataactatttttcacatagactttttaagttggccctgatggaactctgttccataaggaatctcagataagcctttttttttttttaaagccttgagcccagccatggctttgtgccattaaatacctatatgagttgggtacattcctctctcttgaggtctccagacaacttggggctcctaagtctgtcaggaagtgacattctttacttaccacaggtcaggaactctgtacagggactgtgtagacaaagaatgagaccagttttctcaaggggcttttattggctctataagtcaactttgattctttaaacaagtctgtctgtacctgaaagcataccattccagtaaaagccttaataaaataatcagcatttccaattgtgtcctgttacaaaagaaaacagatcattattacacctatgcaaataacgatattgctataaattaagaatacttacaaataggccaggcatggtggctcatacctataatcccagcattttgggaggctgaggtgggcagatcacttgagatcaggagttcgagaccaggctggctaacatggctaaaaatacaaaaattagcctggtgtggtggcgggcacctgtaattccagctacttgggaggctgaggcaagagaatggcttgaacctgggaggtggagattgcagtgagccaagatcatgccactgcactccagcctgggtggcagagcaagactctgtctcaagaaactaaaaaaaaaaaaaaaaaaaggaatactttacaaatagtttccagattctggagaaatcaggtagagagaaacaaatacgcttccaattttgtttatagaagtatactttactcaattgttaaaagctgtaaatagctcaaaagaaaacttttcttctctctgaaaacaaaacaaagaatcagtaacattttaagcaaaaaattataaagggattatttcagtcttctattagttaagttcatgcagttaacctccgttctgcttgatattcatgaacatttcagctttccatgagagtcctgaaagatttttctctattctaatgtcacaatctccaaagttatcagaaacctgcattcaagagcacctgtcagagtcccatagctgattataaaactgccttttaaagaggatcaaaacaagataacaattgtctgtggatgacaaagtcttagggcagccactattaaagccacaattgactagaaattttggttacttctttggcatacaacaactttacataacaattataattgtaaataatgtacactaagtcagaattataggagtttcccataattttggaatatataccaatagcatatttaatgaatacagaccaaagaaagccaaacaccattttatatttgacaatgcttcttttatgattttataccaaataaaccaaaaatagtaagtcatttttggactttaggggacttaatatctaaaagattatttatttggtcagaaaaagacataatttacaatatgattttggaaagtttgtcaaatatcaaaggtttagaagacttggtactataaaatagaatttcaggtcactgtaagtcattcatttagccaaaatgataactcaacaattttaaaaaggcaataacctttactcattattagagaaaagacttagctttccaaacaatctcttttctttcctttctttttcctatagtttatttaaaaggcaaataaaatcttttattatttttaatattacatgaaaattttgttcaagagaaaaagggggatgtttccataccttccaggtggccaagagcacgtgtctctgatctaaaagtgcaaagagctgagtattcccccataactgctattaatatcagccatcttcaaaagtatatttcctacctacttattacacaccaaaactctctcataatatgaagtaattcctgatactctccaaagctgaagacgtcagataatgcaatgcaaaacagaacagagccttagattttgagagggatctatccactttcaattcctggggtttcatgaggaaaatggtgttttcctccccggcagagtctgtggtgcctcttctgtttttcccaaggagtttcaggctgttagaaattatctttggataatttctctcatgtgtgcatcaacagtggcaagaagacaaaatggagaaaaacaattaagtcagctgagaagagaaaaactttttcttcagaaaaataagatccagtaagagaaaaaaacataaaggcctttaaaatatatgtatagcatgtatattgcttttaatttagctgacttttaaccaaatatcttattaccaaagtctatccagaataaacagcaagtatttctggcttttgaactttaccaaaggtaacctcccaggtgctcagagaaaggaaaacccaagacaggaagtcagaagttgtatatggaggggaagaggatcagtaaatggcaaaggtcacacaaatatcaaccagaaagttctcattcctaggctgaaaatggaacctgggctgccattgtgaaaagacaaagccttagctcctaagctacaacattgggcagtttcctctgccctgcccagaaggactctagaggcagccaattttgagcctgcaaaggcttttaactgctcaagagaatttttagagctatgacatgaattccaaaattcctgtctctgaattttggcagagaccaagagcaagtactgccatgtggttatgaggacaagctcctaaggacataagacaagatgagagggaaatatcatctaattttttgtttgtttgtttcagggaagcaaaatttggtaactgaccagtttgctgggatggcttggacagtggacttatgggatcctaggcctgtgttctatcctaaggtacccctccttatgacagaatgatacagaaagacaaattcatagcataaagtccaccggatttgttacagtctaacactagactcacagattattttttcccattgttcaaaacgttgcagaggaggtgaacagtgatttctttaccattcacccaaccagtttgcacagagagcgaggccagaaacctgactggtaagaaattcttacccttttgctggcatgctagatttctgggttcccttttcctcagcacctgtagtgaccctttttgccacattatagtcctgggtgccaagccgcaacacaaaggaaaatcatctttttctgtttcatagaaccataggcaaaagcctatcaagtttgcaagatgccacccaaggggttgcatgggttaaccaaattcacatttcccattctggccagagcaaaatacatgtgacaaaacacagacattagccaccctgtttagcacccaatattgaactggtgaggctcaaacttgccccgagttgggccctgttatctttaatccattcaaagtggggtggaatgacctctaaccaggagtttcaaaatgtggcctctgggtaagatggaagagcagatggcctccttgagtaacagaaaagttaggaaaaggaaaggagagaaagagagagagaaaagcattgcttgcagtgtggtgaggaaggtgagcagctcagggaggccagagaaagacccactgttacccattgcagagacggtgaatcaaaagttcaggcagctgcttgtcagtcacaaaggtatcttttccagcagccccataagctctcaagtttcttcctttgtggagagaaaagctccccatgtcctgtgatcctgtacttgcctaattatgtcacccatagccatcagcaaagagagtaaggcagattaattcaaagagaatagtggttaacatcccataatgtcaaatccatttttaaccaagagactttactgagggggacctttaaccccctaaatcttaggaaggactctaaccttcctaagttgggccttgaaaccaagtttggtcaagtgtccttgccttttattaagaggggcctttagccctctctgtcttaggagggattctaaccctcctaaattgggtctctaacccaatcccatcatttaccctggtgaaatgtacccgccctcttacccaaagtcagccaattgatactgcagtccatttcctttgagttgggggtcttctcactatagtctcttcatggttttccaggaagatgttatgggaaaggggtcccaatccagactgcaagagagggttcttggacatcatgcaagaaagaattctgggtgagttcatagagtaaaatgaaagcaagtttattaagaaagtaaaggaataaaagaatggctaccccataggcagagcagcctataccacattttctttatccattcgtcctcttaggtagattccatatcttcgctattgagaacagtgctgaaataaacatacgggcacaggtatacacttgatatgctggtttcttttcctttggataaattcccaagagtgggattgctagatcatgtggtagttctattttcagttttttgagaaatcttcatattattttccatagtggtgggactaatttacattcccaccaatgatctacaaatgttcccttttctctgcagcctcaccagcatctgttattctatgtcttttcagtaagagccattctgactgatgtgagatggcatctcattgtggttttaatttgcatttctctgattattagtgatgttgagcattttttaatatatctattggccatttgtatgtctttttttgcacaatgtctattcatgttctttgcccactttttaatgggattattattattttactgttgagtttttcgagctccttgtgtatcctggatattaatcccctgtcagatgaatagtttgcaaatattttctcccattcaacaggttgtccctttactctgttgattgtttcttttgctgcgcagaaactttttagtttaatatagacccatttgtctattttgtttctgttgcctgtgcttttgaggttttagccataaaatctttgccttcaccaaagtcctgaagggtttcctctacgttttcttcaagtagctttgtagttttgagtcttacatttaagtctttaatctctcttgagttgattttaagttttttttttaattttaagttttggtagagacagggtctcgctatgctgcccaggctagtctcaagctcctgggctcaagcaatcctcctgcctcagcctctcaaggtgctgggattacaggcgtgagccactgtgcctggccttgagatgatcgttggataagatgagagatagaggtctagtttcatttttctgcatatggatattcaattttcccagaaccatttattgaagagactgtccttctcctaatgtatgttcttggtgcctttgttaaaaaccagctgattgtaaatacatggatttatatctaggttatctattttgttccattgttctatgtgtctgtttttataccaatatcttgctgttttggtttctatagccttgtgatatattttgaagtcaggtagtgtaatgcttctagctatgttccttttgttcaggattgctttggttatttgggctccatataaatttcttttggttccacataaattttaggattattttttctgtttttgtgaaaaatgactttggtattttcacagagattgcattgaatctgtagattgctttggggagcatgtttattttaacaatattaacttctaaaattcatgagcaccaggtatctttctatttgtatcctcttcaatttatctcactggtgttttgtggttttctttgtaaaggtctttcacctccttggttaaatttattccttggtattcttttggtagctatgtaaatgagattcttgatttccttctcagctagattgttattggtgtatagaaaggctactgacttttatatattgattttgtatcctgaaactttactgaatttatttatcagatctaagagttttttgttggaatctctaggtttttccagatatctgatcatgtcatctgcaaagggggataatttgagttcctctttacaaatttgaatgcccttaatttctttctcttgctggactgcaatggctaggacttccagtactgtggtgaacaggagtggtgaaagcaggtgatatggtttggctgtgttcccacccaaatctcatcttgaattgtagctcccataatccccacatgttgtgggagggacctggtgggaggtaattgaaccatggaggtgagttttcccatgctgttcttgtgacagtaagtttcatgaaatctgatggttttacaaaagacagttcccctgcacaactctcttgcctgctgccatgtaagacacacctttgctcctccttcacctccaccatggtggtgagtcctccccagccatgtggaactgtgagtctattaaacctctttttctttataaattaccaagtctgggtaatttaatatagccccatattagtcttcgtgagaacagactaatacagtgggcatccttgtcttgcttcagtttttagaggaaaggctttcagcttttctccattcagcatgatgttagtggtggatttgtcatttttggcctttattatgttgaggtatgttccttccatgcctagtttgttgagagtttttattatgaagatattttaaatgttatcaaatgctttttctgcattgattgagatgatcatatggtttttgtccttcttcgatgctctaccctttctcctgttctctaatgatgcactacagaaatgatccttggaagtacagtcttttaaggtacattttaaagaccttctgtgttttattgaaaaaaggaaatatgcctttttaattataatgttatacatattcattaaaaggatttagaaaatacagatatgatagagtctgtaacattaaaaagtatgaatgtgtaagtaatcacaccttttcccattcccttccctgtcaaaggaagacaggatctagtgttctgctgagaaaatgtgaggttgcagaactgtaaggacagaaagactgaaataatttttagtcaaaagagcccagagcaattggaagaacagaacagaccccaaagcagagagctggggtcagatggagagaaagaaggacaaaattttgtatgtatccgcctagctgtgcgctgtgaaactgagaagaaatatatatatatatatatgattttaaagatgttttcacaagtgtcatgccatctagtaactcttcccactctcttcaaaagaattccataaaaatgtacattgctttttaatgttttcttttgggttttggattcttttgaatgcaaaactgtattgtgactcatcatgaaatacccagttttatttgggttacaaaaaaagaaaacattaaaaattcataattccatctttagactctactagggtttaaaacatggtaaagatagtatgtatgcatatgtttatttatttttttgagatagggtctcactctgttacccaggctggagagcagtgtcacgatctcggctcactgcaatctccgcctccggactcaggtgattctcccacctcagcctcctgagtagctgggactacaggtgtgtgccactgcacctggctaatttttgtattgtttgtagagatggggttttaccatattgcccaggctggtttcaaacttgtgggctcaagtgatccatctgcctcccttccaaaaggctgggattacaggcatgagccaccctgcaaggccaagaatttttttttttttttttttttttttttttttttttttttttttagaacatggctcactgcagcctcgacctcctgggtttaagcagtcctcccatctcagcctcccaagtagctggaactataggcatgcaccaccacatgggctaattagtgtttttttttttttttttttttttttttgtggagatgggttttcgctttatttcccaggttgctcttgaatttgtgagctcaagagatcctccatccttggccccccaatgtgctggggttacaggtgagagccaccatacctggtccatttattgtcttttattcctctgaggagagcacacacacagaaaatacatcatggtcttttcaagcacgtagagcttgctagccactggcttcttctcttgataatggctctaatgtcataattagcttggcctcttctagaatgttcctttctgataaaggcattttggctgtaggaacttgtgaccaatgctgtaggtgcaatctcagaggacttgagacatcaaaaccttttgtttcctctgtgagagagaattctcttctgtgtagagaattattgatcaaccatctttagtttaaatgattatgtgtagctgctagttctaaataatacatggattcccttctgtaattctctatacatgctttcaccaaaataaataaataaatgatgaaaactatggaagacaaaatcctacattattttgaaacaacaaaggctaaaataggggcaaaacccccttcaagtcctttcaagagggttgaaaggaaacttcctttccttctgtttggacctcaggggagattcttatcgtttctggaatcccatgcctgcttatgtttcccagatgttctttcagataattaatccctcctccaatttattcctcctcttctccctgcacccaacagaaataggttgaaaattcttgcacctttttgataagagagaatggacataaaaagcatctaatgactaaaaatcctcatataaatgttgtagaatcatttcaatttttaatagaagtgtacctgttaaaaaaggactagagaatccaccaaatatcagagtcccttggtcttgcattccttagtttcttactcttttttctttggtgatcactgtacctccttccttaccctttctctcttgtccatttctggagagttgctcttgacttccaggaatttcttggcatttctgaaaacctagttcccctcgtccccttcttatccccatggtgtctgatattacttttaatatcatcttcagttatctctgttgcatgttggttccattaatatgtgctgaatagctcctttttgccaggcatgtctcttggaactgaagattgatgcaaagataaattgagatcatggtccctgcccttgaaggtaggagaaaggaaagccccacattaattcactatgcagaatctgactgagatgtcaacaacccacactgttatacagatatgacggcaggtgggggagctggggaggacacttttgtctgcatgactctaaagatctgcctgtttcccctccactgtgctgtcctccctcagctatggctggaaggctgagaaacaaatccactacagttggggaaaaggaacgaccacattgtgagcatccgctatgtgcctgtcactctggatatatcgtttaaaggatataaagtagccattgaattagtgtctgcactttctacatggagggagggttgagatgttttaattaggtgacccagatgcatatttagaggctgtgagtgagaacacagaggacaggaagcatttatagggtggcggtttagggttaaaaagttcgtatttcaagatacagcaggaggcaaaatggacaaggccaaggaagagtggaagtggaaatactatgtctcagagagcaaggggtatagtatttttcctgagataggattgaagaaggggcaatggataaagagatacattcaaagatggagagaagagcatttggagaatctatccccagcaggtttttaccaaagccagtgggtccaatgatgaaggttacattagatcatttcaagggtttggtgtcataaaacacaagagacaaactgtttctattagtagtagaaatgggaaggagcaaaacagatacacactaagtaggtgggatgccagcagttcagtattacctttataatagttacataaaacaagccaggaaagaaagttagtgaatatgggctctgggtcattatagaattcatttagagaagaagaatttcagttagtagccttcctgaaaagagatgataaagaggccaggattacgcccagggtctaagtaccggctgagtatgaggaaattgactctcctccaactctggggtagaagaaacatgattggatcagagggagagagatgattgagtcattagttaggcaaagcaagagctgacgacaatgataaagcactaatgcatccaagagattttttttccccactctagtggcaattttttacactttaaaaaaagaaagtgaagtcgactgatttgtcttgctgactttagaaagcatttaaaaatcttttaatgacactcgattatgttaaacggtacatttctcctctttaatttctgcttgcctcaagtgtgtccacccacttgtcctagtttccctgattaggcacctggtggcaaccaatgatgtgagttacaggaatgaaaaggcataaaaacctactttaggttttactgaagttccaggaggctgggcgtggaggctcccacctgtaatcccagcaccctgggaggctgaggtgggaggatcgcttgagctcaggagtttgagatcagcctgggcaacatagtgagactgtctctacaagaaataaaaaaattagccggtgtgatggtgcacttgtgtagtcccagctattcgagaagctgaggtggggaggataacttgagcccaggagttcaaggctgcagtgagctatgattcagccactgtactccagcctgggcaaaagagtgagactctgtctctagaaaaaaaggttccaagaatgtcatggggaattttatcacttctattctctggacatttcactgggactaatttctctcataaattggatgggtgttttccttgaacagattctggactaaattgggaagtggtacctaagtgccttctttgcctcttttctgtgactcatttcctgctcttcatgtctctctccaatctggatgtttcatattctcataaaggcttgtgctcagtgcctgtcaacttagaagacacctccgctaatgtggagataatagctagccctctaagagcttagcttctgggattcttacaagggccattcagagacctcactttgattgaactcaaatgaaacaatgtttttttttttttggagacagggtctcactttgtcacctaggctggagcacagtggcacaaatatacctcgctatgatctcgaactcctgggctctagcgatcctcctgcctcatcctcctgtgtggctggaactacaggcatgcatcatcatgtccagctaatttttttctttttatttttatagagacagggtcttgctatgttgaccctggtctcaaactcctggcttcaagtgttcctcctgcctcagcctcccaggtcctgggattataggcacaatccactgtgcctggcctgaaacaaatctttaatggtaaaattttaggtatcataataggttgctggagaagtgttctggattaaggaaactttgggagtcctttgaattctaccctgtgagaagcttcacacacttagaatttctgagctcaccagactctgatgtcctagttgctaggagtttagagtaacatgaagctgacacttggacactgttcttttcctctgttaatcatctatgactaaccaaccacattctgcaggacttaaaagtattctagtagccaaattagctagtagtccttaatgcttttaagcatcagaaagtgaaaaatatcaaagaactattgctgcatttgaggagctagaatgaagtttggtttggcttgaggagaattgatgacacccaggagtatgtgctggtttccatttggttcccattcacaggcaaacggaaagtacatacagcctggggtaggtcaggccagcagatatttaagttgttcagtagtggctgggcctgggaatatggggtgattttgaagaattaagttctgcaaaagattcaagagtacaaagctgtcttcatcttagtcaaatgcaggcaatcaatctgtcctttgcatgtaataaactgggaccttagaagtgaagattaaataatctgggatggaaaattggttggagaaggtccagcctgacctacatgtagacatttctcctgccttgtcttgtctcttgctacaaatcatcctgcaaggattaggtaacagcaacttcaattcacacacctttgaaggatggtgacttcagcattatccacggtgaaattcacagccaacaatcaatacgtattttcaggcaaagaaccattattcatttctgttatcggacaatctcaggcagaaatcatatcttttgtgactggaatgcacagcattttcaactgctttattactgcagctgagaatagggctttgcgctgactggcatttagctgctgaagttttctggactggcatttgcattggggtatccaggacaagtgtgggttttgaagggaagggaacgagggggagaagaaggaaagaaagagccgtctgcaggtaaaggccatttttgttagcttgaagcagcatgatttgttatcattgacactgagtgcaatgttgatttaacttttgcactgggggtattgactttacattgaaaagacagacaccaaccattgtctgacaatgaccaacacaatcagaatttcagacctagcatgatgtagaggaggaaagtctgccagaagacaaaggatcttgtcctggttctttgaagaattagttgtgtgaagctagccaagttgctttacctctttgggcatcagtttttgcatctgtaagaagatgtagaatacttgacttatgttcccttccagctctgagaggctttgactctatgattggggttctgttttactcttcattaacatcataaattcataaaatgagggagattgctaaaaaatataaacacaaatatgccttaatccacttattgaagtgccaactgctggctgatttttattttcaaaatcatctattaagaagggaatatgatgaagccattacttagaagttaactagtttcctacacacttttcagatcgtggtaatgatattcaccaacatttgtatagttctctaaagtgtgcagaagattccacatgcaccgtctcattttcttcttccttaatctataactctcagttttgtagtgcagctgaggagggagatgaaaacactgtttacattttttacatcggtttacattttttttggcaaaaaagttgtgttttgtctgaagaatgggtttattaatccagcagtgttcattgagcctctatgaagtgtcaagacctgtgctatagatgaggagatcaggatagacatggtgctacccttgtggagttcacagtgcagtaacaagaacataatcaacacatgattggataaattagagagtggtgagaattttgttgcttcatggaaactgggttgtccaggagtggtgatagaacaagggtactataaccttcccatggctggaaggaacacagtgctcactcctcctctgcaaatgctgtttggggatgtaagttggccatctcaggtcaattttcaggggttgcatcagcccggcacacgaggccccactgattttggtttgagatgcccttccaatcgaaagcccattttcctgtttcacagaatgaaagcaaatactcttaatggggccgttgggcttcaagtctgtgccaaacaattggctttcccagcactttcataaccacgcagctctggatttttcaggagcccgtgcaagactagtttgttgtataaaacgcatccaagaatttttcctcatagcactgaatggtaacttggtggcactggctttgccccacattgtgctaaaatccatgggttcactctctcttttttttttgagacggagtcttgttctgtcacccaggctggagtgcagtggcatgctctcggctcactgcaacctctgcctccagggttcaagcaattctcctgcctcagcctcctgagtagctgggattacaggcacatgccaccacacccggtttatttttgtatttttagtagagacagggttttaccctgttggccaggatagtcttgaaatcctgacctcaggtgatccgctcaccttggcctcccaaaatgcttggaatataggcatgagtcaccacacccggctgggttcactcttaagagatgaattcatcctgtcgttcattatggccaagtcttcacaataggaggcggggcacagtgactctagggtgtgtgtggataggctgcccagtgttgtgtttacattgaggctcatctgcgattccccgtgcctggcatacagcctagcatacagtaggtgctgattacacgcttgcttatccaaaacactactcaaatgtattgctttttactgttttttcttttgtccattttttttgttaattaccaaaataatttatatttaattttttttatttcaatagatttttggggaacagacatgaataagttttttagtggtgatttctgagatattgatgcacccatcaccccagcaatgtacactgtacccaatgtgtggtcttttatcgctcaccccctcctaccctttcccctgagttcctacagtctattgtatcattcttatgccaaagtaatttatgtttgaggtaaaaaaaattaaccatataaaaatgatttaaaagtgaatggtccttcatccccttccacagaaattaccactgtaaaccatttgatccttttagaccttttcaacacatgcatgcattcattcttctcacttcaaaaatagtatttaaaacacagcttgaaactggttatttttacttatcaacaaaaatctgacttttttcatctcagttatattgatctatctgaatcgtttcacaatgcttcatggcataatgcaacataatttgtgaataagtttttctattgaatgacactagttgtttccaatcctttcccaaaggatcgtttgtcaaaatgctttaatgaatttcttgattgtatacatatattttgataattgtgagagcatttcttcagaatatatttctggaagtaaaattgttagggcaagaattatgcataagaaactctttttgtagacactgataaattgcctattaaatgctgtatgaatttctactttaaaatgtttttggtgttagtgataagaaagtcaacccagtgcagaaaggaaatttaatggaccttgtactgaaaggttcagagtgtagctggtttcaggcttggtttgatacaggctcagaaatgatgtcatctggctccaggttctctctcctggcctctcagctcttattcctctttggtggcttcatctcaaacaagtttccctcatagtcttaaaacatctctggctgggtactgtggctcatgcctctaattccagaactttgggaggctgaggcaggaggattgcctatgcccaggagtttgagactagcctgggcaatatagcgagaccctgtctttgcaaaaaattaacaaaaaatttagccaggcatggtggtatgcacttgtagtcctagcttctcaggaggctgaggcaagaggatcacttgagcccaggaggtcaaggctgcagtgagctgtgattatgccactgcattccagcctgggagacagagtgaaccttgtctcaaaaagcaaacgaacaaacaaacaaaaatcaaaactccccaaaacctccaaaacccaaaccaaaccaaaagcaaaaaacaaaacagctgtggaactctaggcttcatcatttcaggttttagctcagtgaatacaggtttatttcccagaagttccagtcagtgtctcatttgatttgattggtcacgtgttcgtctctgaaccacgtagagtgtccagggccatgaaggcttttgttggcccagcctggagctgggtgtagagtcagctgcaccagaactacatgggctgagagcagggcaggatggctcaccaatgaaagttggtagctatttctggaggcagggtcagtgtgtagagtgtgaagtcaataaaggtggatggagtactgtggagacagattctttcctgtggacttatgagtgtaagttcagttttatcttggtctttgggaaagctgtcactgaggatcaatttggtgatatgacttaatgacattccttacaccgctaactgggacgacaattatgtactgctgaagtgtgtttaagggttatccttagataagattggatttatagctgaaaaagaaacacagtccctttaaaagaaggaacagatgaattaaagaacaaaaacatcttaatggttttgttaagattgctatggaaataactgaatgcaaatttcattttaagtctcttgaagttagcaatctattgagaggagagaagtttgcagcaggatttttttttttttttttagagagagagagagaaggaggaggaggagggagaggaagaagacttaaagttggggcaaaaactcttatggttagggcaaaaagagtttgaggttttttaatctggaagagacctgtaagattgtttaggcctatggttctcaaatttgagtgagaatcacctggaaatgttcttaaaacacagatttctggggtgcatcctagagattcttccttagttggtctgggaaagggtcaaatattaacatttctgataaattccccagtgatcctcatgccaacattgtggtggtgaaactggtcgaattttcccatagaactgatatttacaggtttttttttttttttttttaaacaaatgtagaaattgaccctccggggttttaaaacttgaaattttcgtttgcctcatctgggttgcttcctcaggaaatgagccctcaggcaagagactaaaagtcaccagatcactgcaactggataatgacagccagacccttcatttgtcatgattgcttgtttatcctgccctaattccttcccgcctatagctacattccttctaccagtacagaaaccccccagttttagttggccagggagacagatttgaggctttgtttcctgttctccttggctgctgagccaagtgaaagccttcttctttggtaatagtcattgtctcagtgattggcattctgcgtggtgaacagcaggacctagactgacctttggcattggggtaacagtggctgatgctactggtggaggaaccacaccttgagaagcactgatctaggcaccttccactcctctcagtctatagatgggaaaatggaaactcggagaggtgaggggctggctcgcggtgactctgggagaaagcagaggagctggggctagaatcacctctcctggctgcttccctgccctccccttctcccctcttctctttcctctccctgcccgccccttcccttgcctcctcctctctcccccattttcctcccctcctctctctctttccctttccttccttctgtaaaggaactgacccctggtctggttaatgtcaaggttacagagtagagtcaggaaagaacccaaacctcttgacttccaggttggtgcttaccccacgtctcaagtttcctgctcctggagaagcaagacaccaggagattatggggtttccctctcagtagctggatctttctgaaagtgtttttctttgaaggtgagaacaaagacagcctgcattattaggcaggatgtccctgagacacatgacagagggaggctgtcagcagtaacaaagaggctctctggtttgggaaaaaaaggtgcttgtagttgttgtgggagacgaaaaagcgtttctttgactttcttatatttagtacctgggggccttcaaattaaactaacaaagacagattaacagcaggaaaagaaaagcatacagttttattcgtattttacgtgcatgggagttcacagaaaagaagtgaaactcaaagaagtggttagttaggctccagggctaatatcgcattttaacaaaagaaagggggtttaggcttcagaggatgagacagggtagggaagtgactgaaaaatatatgggagaactaatggaagataaaaccttattttagtggggtctgtttttgcagactcctcttggtgtcaactctctgtctctggtgatgactgcttttgctccccggtattggggtgaagggtgggacactttcacaaagggaaatttacaccctgcttttaggcagacaagaggagggcagagaactcttcctgcatctgttgattctcaattgccttcagctcaaaataatccttatgccaaagtggcacgttttgaagcggcatattctggatctcttcattggatggaggattcacagacttgccaacatcaagggtggtgaaatgtagatgcatgctaaagcagtgtcccagtgtcacagggtgagggaatcagggccatgctcatccagcccaggggaagctaagcttagattaaagggacttatttaagagcctagtaaaattaaatttcaaatgatttttattaaaaaacttaccttaattgtgtattatattttagagtctagtatttactgatgttgcttaatgaataactctattttggcttttagaaaatatctgtgttatccatacctatgtaaaggatagttatttttaccactagataattagtaagtgactattatctaccttatcttatcccaattacaggcaacataactaggaagaaataaatggcttcgggcatgctggacttgcgaacacaaatttatgaagtgacagctagtgtcatgatgctcctgcctcaagatgacctcccaacccagagcccggctgcttgggtgaaacattttcccctccctgaattgtcttgcaaaatgtaaacacacattgtcactccgaaggagttagtttatcagatttcttcccttggtgataggagggatctagggcaggctgagcagggaggtgaggtggaggatgacagaagcacagacagggatgcctggggcttgtgactcacccacaggagtacagcaagtgcatgtgagacgcttctcaggatttatatgttagcttttctccccaattttggaaggcaaggaattgtagtcagcaatcggccaggtgaggggagtatttttggtgcaagggactgtccaagggatactgactgcagtgtcctcccatcttcactgttttcttaaagggactcactccttccctgattttctggtgtcctccaggttcatcagcagttatttggatggtcttctgatgtgcaagcccagcgtggtaggatgtggtagaaagggcgtatcacacactgatgctgcatcagctcagtttaacctcagttctactgccatgtgacccgagggccagttataaaccctcttagagctttggtttccttagatgcaaaaggggacaaatttatatatatgtacacacacatatatacacacatatatatgcacacacatatatatatatataaaaaatatattagtgcagattaagggggtaacatgtaaagtatctggtacaataaaatctaggccattgcagtgtaggtttttggaagctgatgctgagatggagtttgggttgcaagacatttattagggatcagctcctgcgcttagaaacggggggaagcaagaactgggcagagggacaggttgagctgtaatgtgggccccggagagccttggccaacccgaggagccctgcagtgagtattgtccatctgcattgtcccatgaggggctgagatggccagcccttagagccttgcttcactcagtcaccagacctggctccctgagaaggaggtgttctagggtgaggcaactccagctgcagaggcagcccctgagctgctgtcagaggctgcctgctctggccacctcctgcagctgcacagcaagtgcttcctgaaggatggtctgggtggctcattttcatgcctaccacataggcatccaacagacatgtctcctccctgctgccagaactatcctcttttttttttaaccttttctccaccttctttctgttctccatctgtcctcttctcttgcacctgcttcttccatccatcctctccacagtcctgggagcttgtggctcctctgcaggggccctagaagtggtgcgtgcctttgctactctctctgccagtcccactgcagcaggaagcatccgacacatttttgtctcacgcagataatgtacaagttacccatgacttctcttttactttggtagagggaagaaaagaaccaggctttattctgcagaataaaacaacacagatgctggtgaatgcactgtcagcccatgcctgccagctgggaccaacaataggagaggaggcactggctgcatcgctaacagatttccaagaacgctatgggcagccaaaaaagccatttgggcttgtttctttttcctctgttgcctttctgagagataaagaggctgatggatcataaatggagatatgaatttgataacatttggaaagaggttaatggaaaccaacgtacaaactacagaataggagaacacggcagatttctaaatgccaatagcatttagaagctgctcttaaagaaaatttgaaggtgagcaggcggtgggcagaggatctgaagcagctgcaagggcctcacatgagtttggaaatgtcttcctaatgtgatggatcctggcatcattccacgcagacgccaggtaggtgtccctgtccacagctctctgagctcctgggataatttcaaaacagcagagagtgagggcatgtgcatcatttgagcacatcatagagggcaccactgattcgctgcactggaagtttgtttgctctatgtgaaatctcttatgtctggcctagaagcctgcatcaaggaactgggaaacaccaccggctccctctgtgagtggcaaccatgaaatccaccctccagtggcctcttgtggactgtggactaacttccttcaggggtcccaggaagtcctagggaagtggaaactcccttccatatcccacttcaagactcagccattgtgcagaagaggccaatagcaagaccccaatttagttccatgcctgaggagttcagcctaaaatcctgaagttgcacagggttttactgtcttattccattctctcaacaatgctgtttcattcgcgaggacaatggcacttggagagattgagtgacttcctcaggtctcaccaattgtaaggagcagggtaggtcctgaattctggcctcttctggatccacagggttctggtgcatggttatcctggttctgatttttctcaaatcagagaagacaaggggacaaagacatttaatcccacggaacctcatgtcagtctcactaagtaaccagggcttcagaggatgccactagtccttgcttgcaagtagtcaggcattatgctgctgcctgctagactgtgttggccactagccacacttggctactgagcccttgaaatgtggccagtctaaactgagatgtgtgtgtgaacttcaaaggctttaaaaaagaaggtaaggctgggtgcagtggctcacacctgtaatcccaacaatttaggaagccaaggagggaggattgcttgagcccagacatttaagaccaggctgggcaacatagtaggaccctgtctttacattaaaaaaaaaaaagaaaagaaaggaaaaaaggaggtagatacctcattaataattttgtattgactatatgttgaaataatatttttgatatgttgggtgaaatacttacatttaaaaactataatttatatttataataatgtaaaatataataaaaatttattttacctaccttcttaattttaacaattgtgcctactagaaaatataaaatacccatgtggtttgcattacatttctattggattactctagattcatctgcatccctaaatgtctttagtctatttttagcttctgcttcttcactctatatcactgttactggtagcgagcgactgggtaggtcatctgctttagactttgaaatttaagaggcagttcacagaatgacggctatttcacactcaggtgagcatggtcataattgggtgctcataggggacttggcggtttaatgtcaatgaagaagcctcctaggggtgatgcctcattcattcaacaaatatttatgttaacagcttctttatgatggatgattatgctaggttctgggactatgtctgggagcaagaaatagtcacaggcattggggagcttatcatctggcaggggcagtagacattgtgatggttaattttgtgtgtccacttgactggctacagggtgcctaggcatttggtcaaacatttttctgggtgtgtctgtgagggtgattttggatgagattaaaatttgaattgatagactgagcaaagcagactctcctccctaaacgtgtgtggtgcttgtccaattggttgaaggcctgaagacaacaaaaaaactgactaagagggaacttccttggcctgactgcttgagttgcaacatcaatcttctacccttgggctgtgacttacaccattggctctcctggttctcaggcctttggattcagactggaatcactccagcagctctcctaggtctttagcatggcaactgcaaatcttgagatttctcagcctctatagttattgatatgatttggctctgtgtccccatccaaatctcatctcaaatcataatccccacatgtcaagggagggatgtgattagacatgggggcggttcccccatgctgttcttgtgatagtgagtgagttctcatgagatctgatggttttataagtgtctggcatttcccctgctgaaacttctctcttctgccgccatgtgaagaaggtccttgcttccccttccaccatgattgtaagattcctaaggcctcccagccgcgtggaactgtgagtcaattaaacctctttcctttataaattacccagtctcaggtatttccttatcgtggtatgagaacggattaatacagttgtgtaagccagctccttataataaatctctctccctctctctgcctctcatctatgtatgtatgtatctgtcatctatctcctataagttgtttcttttgagaactctgactaacatagacattaaataaacaatttgtatactgaataattatataactactgcttgggggtgtggttgtgttgtgtggtgagggggtgtagaaatgtctaggggttgatcaaccctaacaccttccagatgaccctaggttctggcctttccccaaagagtcctggtctactcagtcatctcccacaatttggccatcttcttgggtcctcaggacaataaatgacccagccagatctctaccctaagtctgacttaggatggaaaaatgtctccttatgcctttatcagtcttgacttcaggtcagggaggccagaaaaatgaaatctgctctattttgaaagtttccttcatttcctttttatgatttaaatttatttttataaagtgaattgatgaaaacaaacacctttaacacctctacccctcggtattctacagatttcctgtagttttgacagtgaaacaaaaaacgtcataattcttcacatacttcaatactattcttgcagttctagtcttgcattactggtggagagtctgggggttggagatgggggttacattgtaagggaaagcacatagtttggatgtggtgagagtataatgagattagcgtgcatgtccagctgtctatccactgtctatctaaccatgggtaagttattcaaagttacctcactacagcttccttgtttagccagtggggctcataccacatacctggtgggtttctggaagaattagagataaagtgtagaaagcacctagcaccactctggcatataatggatacccagtaagtggtctctattgatatttttccttgttccttggccctagactggtcaggttgtcagaggaacagaatttgaccacttaattagaacaatgtttcagtaatatatgactgcataacatacaattccaaacttcggatcgtaacatattattatgcacataaatcctatgggtcagaaatttgggcagtgcatgcaggggtgactgtctgtgctccaccatgtctgggttctcagtaggaaggcttgaatggttgaggcctggaatcatctagaggcttcttcacatacatctagctgggatgactcaaaggctgggatcagttgggaccactgaacaaagcacctgtacccagcctcaccacatggcttgggaatcttacaacagtgcaactgagctgtgagagggggagtcttgaaaaggggtgtctgaaagtgagcattctaaaggagcaaggcagaggttgcaaggtttctttgatcttgccttggaagccacacagtgtcatgtattctgcttctcttgtgacaggtgaattaccaaagttagcgtagattcaagctgagagcaactagattctagcagcaaggccacattgcagaagagcatgtaggatggaagatattattaagggcatctttgaaaaatggcatcagctacaaagaacaacctacattagactcctttagacttgtttgttgggcttctcaaaaggaaacagtggagcccaggagtttgagatcagcctgagcagcatagtgagacccccatctcaattatatataaaaaaaggaacagggcactgtgcagttcccttctcaaagggaacaatcacattgcttatgtcaatgtatcttcagagaacaagtttcagcaacattgttgaaatttgcctgaggtaacactgtaagttgatagtgaattagaccctgaaatttcagatattgactatattcaaaattacagtgtatttttaaaaaaataacagctttattgagttataatttgtataccatgtaattttttcatttaaagtgtacatttcagtggttttaatatattcacagagatgtgcaaccttcatcacaagcaattttagaacattgtcattacctcacctagaaatgaaatatctagtgtaacaaacagctgtgtttcagccaatcacaagcaactaataggattcagccaatctcagcagccaactcatcacaccatgtccaaataaggcagatgcctacctgtagccaatcaggtgatttctctgctttgcttgcctgttcagcctttaaaatctctctgcccacactactgggcagggctctctgaacctcttctggtttggagtgctgcccaattcatgaatggttctttgctcaaataaactgttaatttgtctaaaagttttttgctaacagcaatactggaagaattgtactcactgcaaaaatgtctagcatatgttttgtttagcttctaaaaataagattgacattttatttcaacttatcaacaaatacaactccaaaacacaaataccctaatcattttctagtagctgttctccaaggacagaggtgagcttttaatgaaactgatttaattcttcacaacatccctgggggtggtatgggagaagccttaaaaaaagtcaggttttattgaaaacactacctggaaaaatagaattgagatacactaatagtcctctcaacaccaaaaaatcctagatgtgggagatcttgcttagtcaaccctaacttggaacaagagtttgcatttgatcacatccagtgatgacatataattttatccttctccaagctcttttcaaggatcattgtatctgatcctcaaaacattcctggaggcccactttactgtgatattacagatgaggaaacaacccaaaggagctgacatatttaagacccaaagtgactttgacccaaagcctgccacccacaccattccagaccccaaagactagtctgctttttattttcacacttattggagactttctttcatttgcccatggtagtgtttctctttctagaagcttctttattgttttaagatgaaaaaattcatgaccaatttccagaacctcaaaacacaaagcaactgcttattttcctgagctgctgcgtgagtcagtgattcccagtgttgctgtgcctgaaaacccaccactaatgtcagcgccttgtgctgttgagttgcacgcggcgcccctgcagtccagggctggggctagcccggcgagcgcgcggcaggcagagcattcccggacgagtccggtagatggtagcattgtgcagccgatgcgtcctctcccagcttgcgtctcatttttccctctccccctttcctgggctcagcggtgaggctcaggtaccggcgccgccctgatgcctactatgccgcgccatctccagatggtccgcacctggcgggtcacgacgagtctcaatccacagcatggggctgactcggactcaggagtttttgtggctccaggcgtaaccgttgctttggataaaattggtccagttcacttgaccaaggagaagtgcagaggaggataaacgtccccatcccagtggtgtcctctcccgactcctttcgtgtagtgagctttatttttagagactcccgcgcctgccagccgctcatgctcgggttccccaagcggaggggctccgcgtgcagtgtgatgcccactgtcgccggcagagggcaccgtcgtcacacactgcgcaggagccggcgcgggaaggcggcggggctgtccttcccggtcagcgtcctacgcgtgaccttgggacccgcaaatgtctgcgccggaggcattgcctcttcccgactatgggggatactgcacggggctcccgatggcctcttccacgcctggcccttcacttcttgaagctcacccttttcttatttgatctttctagaactggcgctctctcccttcaaattctgtcccaccttggctaggttctggttctgagacttctgtctccctggctgttactttccgtttttcaggaattttcttcctttgccaatcctttaaacgtccctgatcccaggattatttgttcttctaagactcactctgcgcaccctcgcaaacccaccgccaccctcttcactgccttgtcttgacgacaaccacattttaatctccagtctaagtttatcttttgagctacagacccatttcttcattttgccaggccaatagggactgcttggaaataatgcttagaaagcagccagtctaagagctgctatttcattgaggatggtagtcaaggttgtcttctgtctagaaatgctttgaataacaagtgctttgctttcagccagctggtgtttctctctgaagccttcttcaaggtaaaaaaaaaaaaaaagaaagtttttagtgcttacctagagatgcagtcaccaaacttaaccttcccccccattcccctcttctgctgaggaaaccatgccaggccacaggaccaaaacctcctttgctagctccctctgtttagacctggacaggatacctaccttaaggcgacaaaaatgcgtgggaatgggccaatcagagtcttttgagattttgggactggaatgttgaaaagaatggtctggtgaaaatatggagagctctgtagcttctctgtagcgaagaatctgtagacaaaggggtgtgtaaaagatgagttgcctgagggagcaggctgaggtaggaggaggacagagcagacagaggtagtggagagggccagagtgccccagaaagctctgtttcgttcctcaagaaactcaacagtctcttaattttggaaggtttttctttttaaactttttaaattattattattattttttttttttagagacagccttgctatgttgtccaggctggtctcgaactcctgacttcaagtgatccttccacctcggcctcccaaagcactgggattgcaggtgtgaaccactgtgcttggcctatgaaggtttttctatattctgtccatagccccttcatcttgagccagtgcagaactgtagctaattcatgaagaagcagaggacatgaaaaggaaggaaagggaagacgggctgctgacagaatcagcaaggtttagcaggcagctccactgggctggcagagttgggaggttagtggctgttgtggtggtcggggaagcagagaggttaaattccacattcccatgaacttaccactccccttcctgaaaatccccacatcccacctattgctggatcttagcaggttggtcagccatgactccaaaagtcaaatgcatttgcaagtgtcactagacttgtggagtgggataataccaaaagacaaaccctgtcaagtatttatggaatgcttattttataagcatttaaggaaagggctgaggtgagaaataaaactgagtaagataagatgcctaccttcaaggagatcctcagggaacacaggcacttgaacatagcacgggcactaacatagaattaagttcaaaatgccacatgaatacatacaggagaagggaaaattaactccgcctttgatgagggtgggaaggagccagggagaacttcaaaaggggaggtgacttttgagctggaccttgaaggatgagtaggagtttgtcagacagagaagagagatttgcattctagggaaagagagcaaagtgtcaaaagaatacaagtgcatggtgtataggaagacttttagtactgtggagtatctttgttgtatgcatatggggttggggttggggttgggggtgtcagtggcagcagatgacagggaaaaaggaggcaagggccagaatgtgaaggaccttgaatgtcaagattaggagcttggacttgatcctgaggacactgtgaagccacagaagcttttaatcagggagtcttatattagctgcctttggaaggacaaccgcagactgaatagaggatgcctggaaagaggagagagcagaggaggtcagtcacatcgcctgaactcagctgcagctgataaactttctagcaatatcctggggcttagagaagaacaggcaggctgtacattttaactgattgaagcattgtcctcaaggagggctgatgaatccgtgcatgctcaccattagcacggagggtcatggttctactactgagccacagggtgctgcattcattcattaattcatccagcaaacattcattaaatgtctccaagggcccagtttagtctgtcctcttcagcctcagggattggttccaccataccgagggtaccaaatccacaaatgctcaagtcccttacataaaatggcatagaacagttggccatttggtagattcaccaaccaagaatggaaaatatgtacgtacagctggccttcggtgtcactgggtctttatcagcagctggttgaatccatgcatgcaaaaccggtagatacagagggccaactgtacagctttggtgctaaggataacatgggcaggaagtaggcatggcccctgctatcatagagtctgttgttgagggagagagacagctattaatcagatgatttcatgacctagtgcataaatttcccatttggaaggaaaagaatatagttcggtgaaagtgtataacaaagaactccccctggcctcagctttggctaagatgcagagcactactgggaatttaccaggtgagagcagggggttgcaggagaaggagcagaatgtgcaaaggccccgtggcctgaaagaacatggtatggttgaggaactggaagactgtgtgatagggcatcaaaagaagactgagatgagctagtgagagagacaggagccaagccattggatcttttcctgtccaggtcaagctttagataaagtatttgtttagaagaataggtcagttaaatctgaatgatgcaaagctgagaggacaagtggaacatttgaattgcagaatcaagatttaagacaatcttgcaggtctaaattaaaagtgatggaattaaacaaatgtaaagttctacatttatgttaaaagttttaattgacttgcaaagctttgtgtataaggatgcttatcactgcatatttatagcagtgaaaacatgggaaagaagaaatatgcaactgtaggaaaatgattaaatatgcgatgtgttaaaaaaaaatgagaacattagcactgaaggttacttgggttcaaatgctagcttcttttactagccgtaggtcattggacaagttacgtaaactttttgtgcctcagttttcttatctagcatatggggttaataatactgcctcacatagtagatactaaataaccgctacatcagttttagctattgtcattacctagtagtattatgtttacaaatatgtttaatgtcattagaaaatgcttgatagataatattaagtggggaaaaacatatagcattatgcagtttaataccattttgttgcaaattgtgtgtatttgtatttttgtgttgcttatgtcttttgcttcaacttggggtgtaagaaatgatcacatgtggccaggcgcggcagctcacgcctgtaaccccagcactttgggagagcgaggcaggtggatcatgaggtcaagagatggaggccattcttgccaacatggtgaaacgctgtctctactaaagatacaaaaaattagctgggaatggtggcatgcacctgtagtcccagctactcgggaggctgaggcagaaaaatcacttgaacctggcaggcggagcttgcagtgagccgagattgcgccactgcactccagcctggtgacagagtgagacgccgtctcaaaaaaaaaaaaaaaaaaaatgaaatggtcacatgtctccactgaactgagtcattgatctcctcttcccagcaccatgagaaccatcccctgaccagctgtgacagcgcagacaggaatggcccaaggctgggtagccaacagctttcaccagtctgcaggatggtagcatgcatagatttatcagcattaacatgctcgtttctctttcccagtgttttcctttctgtgatacatttaaggttccacagtcccagtttattcaggctaaaggatcagtgatactcccaaatcccttgtagagacagcactggaaaatatgatgggtccaccgtgggctgcatttgctgttccctaacaccagtgcctgctaaaagcagctgtccacacagccttgagctatcactgtctgtgctgtcacagctggtcaggggatagttcctacggagctgggaagagacctcttctcactgtcttatgccagcacggctctgggttctcaatgtttcagcctcttagtttgtcctcatatatacgattctcaaaccatgcccatggggctgcagtggctgctgcggtagaaggttccagccttggcaatgtgctatacctacaacacctccccactaacaccaacaatttagtaatccaggctcctgcagaggacccactgagcttatcagagatgtttggaaacgagtgaacctaaggagaagtagttgggagtcttgatttgttttctcctaggaggcttctagcccccctctcaaatgggctcaactatttagtacttcccagtgacatttggccttggtatcctggggaacaaatggggagctgagaaaaaacattgcctgtgactaacattcctgcctttggtcgatgagcgcctctgccttaaatttgcaaagctaaaagaaactgcctgggtgattgtttccagaacaaaaaaatgtgtcccaggatgacttgttagacatggaagtggctggcaacttttaacttgcagattttcttgctaaaagtttaaaattctgtctcattggggatactgctacatattcatgaaaaagaaattgactattaagaactacaccacaatattagccatgcctacctttgagtggtgggattccaatggactgttttattttttattttgttttgttgttcagatttctgacaacaaatatgtattactttcacaattagaactatagatcctgccaataagtttacttagatccgtcctatttgtttcaaatgacaaccccatccctggcaggcagatttggctctcccttggtaccagtgagaggccactgggtctgtaatacaggagttctgtatagccacagagaaggaggtttgcagttaacctccattctgggctctaactctctctgagttctaagtcctccaacaaggctgccattcacagccaccccttcccaaaggctgccattgggaagtgtgtgtagggtccccaagtccaccctcaggtttgatgattcactagaaggagtcagagaacgcagaaaagctgttatactcccagttatggtttatagagcaaaagatacagattaaaatcaacaaagaaaaaagatatacagagtagagtcaaggagaaattagacagaagcttccagatgttgtcacccagtggggtcacatggataccacttaatccccccagcactgatgtgtggcaacatgcataaagtattgccaatttgagtcttggtgttcagggtttctatgaggggtaagtgacataggaaaagaacacttatgtggctgaccttagctgctgaggctgcagcttccccagaggtcaaactgatggagcatggtcgggtgaatcaaaccaaggatttgccacacatcaccttgttagcataaactatctgttgtggcttagggatccaggtatacaaagacacgctttttttcagacaggatattccaaagtctgacaggttatccccgaggagctggtcaagggccagttcctttttttggaatgtgcagagtttgggcactccaagcctccagtgttaatccttttctgcaccacaggtcaggtcttacaagcataggccttgcccttctgtctgtatctttttttttttttttgagatggagtctcgctgtgtcgctcaggctggagtgcagtggtgtgaactcagctcactgcaacctccgcctcccaggttcaagtgattctgatgtctcagactcccaagtagctgggatgacaggcttgcaccaccacacccagttaatttttgtatttttagtagagacggggtttcatcatgttggccaggctggtcttgaacttctgatctcagtgatctgcccgcttctgcctcccaaagtgctgggattacaggcctgagccaccatgcccagcctgtctatatcctttgcatacttacagttttcctgtttttcatccttttctacatcatggggtctgagccaggtaagcaaagactagctttattctcctcgtggttttatacacttgtggagccggggggctggaactccattactattgttaggctgtttgtccccatccaaatctcatctccagttgtaatccccataatccacatgtgtcaagggtgggacctggtgggaggtgattggatcatgggggtggttttccctatgctgttctcgtgatagtgagtgagttctcccgagatctgatggttttgtaagtgtttgacagttcctcctatgcacgatgctctttcacccgctcccggggaagatgtgcctgcttccccttccaccatgattgtaagtttcccaaggcctccccagccatgcagaactgtgagttaattaaacctgttttctggataaattacccatgagaatggactaatacatctatgtagaaacttggattagcttgacattctcatagtcaatattttgtacttctgaggctgtgttcctgctccactctccctatgaggtcttcctgagaccccttgatgatgggctgcattggctgtatggctgctcagattagggtttggagcatggatggcctatcctggggtcacagacctgtacctcacctggcctgggaccagcctctctctcctggcataccttgggatgaatgccactaccttgcaaagtactttactcccctgctgggtacaaagccttaacacctgtgaagacgaaagaagtctggggattttggttgaccatgagtacaaatgaaaaaaacagggaggtagtcattaagaaactattagacggtatgatctactggaagagtgacagctttagtgtcaagacagctgaatttgaatccctgcttagctattttccagctctgtgaccttgagcaagttattttctctgtaaatttcaatattttcatctatatcatgggaatattaaaatgggccatggttaggattagaaataatgtatacaaagtggctagtccagtgtctagcatgcagtcggttgtaataaataatggttattgctaatattatttggctgtatcaacagagtagctgtttctagatcaaataaggtagttgacacacttcttagcttcatctggggaaacatattcaatttgggaccctccactttgtgtgtgtgtgtttgtgtgtgtgtgtgtgcgcacacatgcatgattaaacatttagatatttccaaggatggtggtcggaaaagcagagaatctgaaaaacatgtcgtatgagggaaatgggaatgtttatcttggcaaagagaaagttgagattgaattgcttttaactgtttgttgggtcaccctgtagaagtggaaatagacacatgggttatagctctgaaggacgtaattagactcagtggggaaactgggaggccagatcctgccagaaacaattctagccatctaacaattagagctgtccagcagtagattaggctgcctctgaattgtcctgttcctggaattatcagaagatgtgagactagtgggagcactgggaaggttttggctttggatgggagcctggatgagaatgaactccaaggctcctttgtctgtagtggccatcttgctcgtttttcttgttaagttcctgtaggaggcaccagtcataaaaaccccttgatattaaataccattatagctctccctctccctctccctctccctctccctctccctgtccgtctccccacggtctccctctccctctcttgccacggtctccctctgatgctgagccgaagctgtcctgtactgctgccatctcggctcactgcaacctccctgcctgattctcctgcctcagcctgccgagtgcctgcgattgcaggcgcgcgccgccacgcctgactggttttcgtatttttttggtggagacggggtttcgctgtgttggccgggctggtctccagctcctaaccgcgagtgatccgccagccttggcctcccgaggtgccgggatggcagacggagttgcgttcactcagtgctcaatggtgcccaggctggagtgcagtggcgtgatctcggctcgctacaacctccacctcccagctgcctgccttggccccccaaagtgccgagattgcagcctctgcccggccgccaccccgtctgggaagtgaggagcgtctctgcctggccgcccatcgtctgggatgtgaggagcgtctctgcctggctgcccagtctggaaagtgaggagcgtctctgcccggccgcccagtctggaaagtgaggagcgtctctgcccggccgccatcccatctaggaagtgaggagcgtctctgcccggccgcccatcgtctgagatgtggggagcgcctctgccctgccgccccgtctgagaagtgaggagaccctctgcctggcaaccaccccgtttgagaagtgagaagcccctccgcccggcagccacaccgtctaagaagtgaggagcccctccgcccggcagccaccccgtctgggaagtgaggagcgtctctgcccggcagccaccccgtccgggagggaggtgggcgtcagccccccgcctggccagcagccccgtccgggagggaggtggggaggtcagccccccacccggccagccaccccgtccgggagggaggtggggggggtcagacccccgcctggccagccgccccatccgggaggtgaggggcgcctctgcccggccgcccctactgggaagtgaggagcccctctgcccggccaccaccccgtctgggaggtgtactcaacagctcattgagaacaggccatgatgacaatggcagctttgtggaatagaaaggggggaaaggtggggaaaagattgagaaatcggatggttgccgtgtctgtgtagaaagaggtagacatgggagacttttcattttgttctgtactaagaaaaattcttctgccttgggatcctgttgatctgtgaccttacccccacccctgtgctctctgaaacatgtgctgtgtccactcagggttgaatggattaagggtggtgcaagatgtgctttgttaaacagatgcttgaaggcagcatgctcgttaagagtcatcgccactccctaatctcaagtacccagggacacaaacactgcggaaggccgcagggtcctctgcctaggaaaaccagagacctttgtttacttgtttatctgctgaccttccctccactattgtcctgtgaccctgccaaatccccctctgcgagaaacacccaagaatgatcaataaaaaaaaaaaaaaaaatacgattataacttccaaggagctgcaaacacccatggaatgtaaaacacgaaggtctcttatcctatacctagctttctccctagaatgaaattttaacttggtttgggagagagagagtcccagccagcatttctctttagaatgattaaagtcttgggatccatctggactcattcattttaactattccatttcccaagaatatcatctcattactttttcaatgacccaatattttcagcacaagtgaatgagtccagaaagtcatttcagccatcgattatttttggtaaccttctgatctgctctgaatcccttttcttttaatttccatttatgtcctcgtgtctcgtcatctgttctaagctgaaaatagtaacttggcttgaccttattatctaccatttaagattttatagtctttggttaaatctcatcttaataagtgttcctaggctatagattgtggtttttcctttactttttttttttttaaaggctgttctttgtcactcctatctatgatgacaggaccaacattatggcccttctctgagtatgccagaatctcacttcatctttttgataagaaccatcctcaacatcagcttagtaagttatacctatttgcttagaaacaaagaacacctcctctttagccttgacctgtgtcccaattctgtttctgaatatacctaaaatcctacttacatgggatttaaaatgccactgggtagggcaacgtaccaagtggtattagttaaatcttaatgtggctgagtttgtcagcttcttagaaataagttttgacaactgagaagagattgggcaatagaactctggatttttttttttttgctagactataactgtaactataactataaaactatatatatacatatacatatttgagacagggtcttgctctgtcacccaagctggagtgcagtggtgcaatcatggttcattgcagccttgacctcctgggctcaagtgatcctccctgcctcatcctcctgagtggctgggactataggtgcatgtcaccatgctaggctaatttcaaaattttttgtagagactgagtcacattaagttgccgaggctgaccttgaactcctgggctcaagtgttctgctcaccttggcctcccacattgttgggattacaggcatgagccactgcgcctgaccaaagaatgtcttttaaagcaaatatttattgaatgcatagatgtgattggcagtataacattgaaaaaatcatgaagaagacacagtagtggacctcaaggacctgctatgcaggagtgtgggggtttgggttaagacctgagaaaacatggaaaggagagtttcagatcattagtgacaaacttcagattttgagagcaggatctgggtggcctaaagtagttttcatactcagaagtggagagaaaggagacagaaggtggtagaaaagagtaattttcttttggctccctggcgtgcttttttttcatggatgaatcagagtttctttagattttcaattatctttctagtgtgtcctgcctagctgggcattactcaaaacccatccagtcctctgaggcttgaagggacttctgatgcatgtccttagggcctgtctttgttggtaaatccaatttgagaggaggcagcaaatcaacaggaaaggaaaatatttccctttcttaatggtaaagccctcctctttgttctttgtgccacaaagtcttttttatgttccaggacccagctcaccttccacgtccactatggaatcttttctgatcacccagctggactcgagctttgggtggctgcagtgctgtctgctgtcaccctgagtgcctgagcactcctatggtgcttaccagtccctggttggcattacaggttttcctttcctgtgtaggacaggaggctggccatagtcatatcaccatcatcaacctcaaatagtcagagaagggcgaccaggtcaaggtgctgaggatgaagtccagtactatgccctgccttcagtccagggcttacaatctgggctggtctttctcaaacgggtttgctggtgttacttgaggtctatgaattctgtgagaactttaaaaaattgtgtttatctgtcaataataataaaacattttatcagttataaatacagaaattatttttttataatgataatttgctatggagaggcattttcttatttatttatttatttatgtaactttaattttaatttttttgagacagggttttgctctgtcacccagactggagtgcagcggtgtgatctctgctcacttcagccttaatcttccaggctcaagcgatcctcccacctcagcctccccagtggctgggaatacaggcgcacaccaccatgcccagctagtttttgtaatttttgtagagatggggttcttccatgttgcctagtggtgaatttacttttttttttatgaccatattattcaggggttttacagacaatttctggtaccgaaagactattatttctccagaagaggttcttatattactcaaatatgagagacattggtttagtcaatttcattctgtcattaacaaattcattcattcatcaataaacatttatggtacgcctatttattagatgccaggccgtttgtcaggcacatgagcaagtggtcaggacctgttctgggctccagaatcctcactgctcttcctgacttaccaggtagcccctaccgcagagttcaggctatcgacttctctatgcctcactttctccaccactaataaaagggtaagagagtatatctatttttgtcttttggaggggtagaaaaacatatcctaggatttatttagttatttattttaattaaaaatttttttaatattgccctgagaaagcagataccttaggatttaaaaaccaaacaaaacccaatcgaagtattacttgtttccaaatttggtgtttttgagtcagagacaagcgctaaattcacatttctttccacctcccactaacctcagtgggagggatccaggacccatggaaggtctcaatcagctctaacagaaatgggtcctacaccgtagagcagatttttcacaagagctgtttttagatttgtttatgccgccaccgacctccaatttcacatttcagaaactcccgtggggctgaggagttactccctgggaatcttctctgcttagcaggagctcaagagcagagtgctgatgggtctcatgtttaaagaacaatctgtcacaaagctaaggggcttattactcatcctaacactgagcactaaataaacactggagtagatagagacataacctgggacctttgagcatagagctgatatgaatagtcattaaagtagcacattggcaaacccactacccactggggccattcttgttggaaaagtctgatcatctggcatccagttgcaatgcaatcagtaagaaccattccatggtgcttaaacatgtcagagtaaatctctaacagggccactaccaccccggaagagtaagtgggatgcactttgctttaaagggataccttcctttctcaatatgctcacagacagacggggagccaggatcacgcaatccagttgggcagatttttttctgattctgagcgtcgcatttagcagggcaagtttttgttcccaaagcttcaaggtctggagccagacctccactggtacatgaatcacactgtgtttgggcatcctagaagacatagggtgggcctaccagtgggccagcttatttaccagggcgtgcttgctctctgtggagcaagaactactagggcttttatggggacatgctgccttcattcatccagcaaaaattattgagtgtctactttgtgccagacaccacactagatatcagagacacagagagagataaggcccagttcctactttttaggtgcttataatccaggtggagacacagacaaataacaacacagagcagtaagagtgatgacaagggaaatggagtccttttcttcttgccagtcttggagggttagaaaagccttgttggaaggtggatgttcaaactgagacccagagaatgtacgagttaataggtaaaggcaagaggatggcaaactgtacaagtcccaaggcgtgggacagcatgtagatctgaaactgcacatatttcaagattggctgctcagagagtgcaagatgatatgttgacaaatgagacagaagaggtaaacttccttgataacattgccccttacttatttttctctgcactccttccccaaagcaggtatggcaggtacatctgtgtgtgcatatgtgtgtgtgtgtttgcattaaaaaacaacaactccagcaaacgtttcaattcaaatatttagtttgcttggctgaaaactatttagaaggtaaagtgtttgctccaggtcgggttggggaaaatatcacatgtgaggctagttatcacaggggctgtgacctggtccttgccaagcttccaaatgttcggaagaagttttagtctttaagaaagcaagctaccagggactctcagtatagaaacagaaaggactgtgccagagggatgctaggaaaaaccctcacagtttgcctcatatgaatgtaagacctctgaatgaatagttgtgtatcctatgggacctacagaaacagaaattgtggtcctgtgaataagatggtgacttctatgtgacaacacagcttgttaaatcaagctggcagatgtaattaacaataagcacagtataaagtcttagcatggcagtttacatagtcatagaatgttgcaatagttaacatattggttagatattacaataaagtaacagtggatttaataaaataagaggattatttcttctctcatagaagtctgagctggtaggtggtccaaaggtggtaggtggtaggcagctctgctttatgagtttgtacaggacccagataccttctatcttgttcaactaccatctagggttgaagatgactcactaccaccatgtccaacctccaatttgaaggaaaatggaaaggggaaagttgaaccaacagtacctttatgaaggcatggcctgaaaatggaagattatcacttctctttgcatcacactggcaggtaattggttgcttggccacatgtagctgcaataaaggctgggaactgcagtctctagttgagcggggtatgtttagctagagtttggggtgttattgccaaggggaagaagagaagaatggatagtggtgaacaattagtcaactgtcatagatgtttatctctatcatttgatcctctcaacaaccttgttagaaagcaggcacagattatttaccatcctcatttttgcagatgagaaaattgaggtggaagattaagggactccatcaatatcatacaacgaagccacatggcatagtgggacaactgcaaaaacttggtcaggaggtgccctggttgggcacagtattaaccactgagttttctgaaatgtattcctcagcctgggaacagaatttcccagtgcttgcagcttctttcaagaaaaagcttcccggtaatcacgggttagaggtcggaggagcacaaattcaagggcattttgaacatggccccacatggatgtgatctggctaacccatctttttttttaaattatttattattattattatactttaagttctaaggtacatgtgcacaacgtgcaggttcgttacatatgtatacatgtgccatgttggtgtgctgcacccgttaactcgtcatttacattaggtatatctcctaatgctatccctcccccttccccccaccccatgacaggccccagtgtgtgatgttccccaccctgtgtccacgtgttctcattgttcaattcccacctatgagtgagaatatgcagtgtttcgctttctgtccttgcgatagtttgcccagaatgatggtttccagcttcatccatgtccctacaaaggacatgaacgcatccctttttatggctgcatagtattccatggtgtatatgtgccacattttcttaatccagtctatcattgttggacatttgggttggttccaagtctttgctattgtgaatagtgccgcaataaacatacgtttacatgtgtctttatagcagcatgatttataatcctttggatatatacccagtaatgggatggctgggtcaaatggtatttctagttctagatccttgaggaatcgccacactgacttccacaatggttgaactagtttacagtcccgccaacagtgtaaaagcattcctatttctccatgtcttctccagcacctgttgtttcctgactttttaaagattgccattctaactggtgtgagatggtatttcattgtgcttttgatttgcatttctctgatggcctgtgatagtgagcattttttcatgtgtctgttggctgcataaatgtcttcttttgagaagtgtctgttcatatcctttgcccactttttgatggggttgtttgattttttcttgtaaatttgtgtaagttctttgtagattctgggtattagccttttgtcagatgggtaggttgtaaaaattttctcccattctgtagtggctaacccatctttgcctcttccagtccaagcacagacaatgagcagagaggaggacaatgtgggttaatggaaagaacactggattggggtcaggagaccccaagaacattgaattggagtcatttttagctcacatcaattgcatgcctgtgaagtgacagctactgagcttgacactggcatgtcttctcatttaatctcagaacaacactgtgaggtagatgttactatgtatatcttacagaagacaaaactgaggcccaaagagctgagtggcccaaagttatatagcttgtgagaggtagggctggaattctaacctagaccttctgactgctaaccccaagcccttctacaaaatcatactgttctttacgccaagtaactgctgggcaagctggaactgaaatgggatatgtcaccagtcacacggatgacccgtaacacgtctacctggggcccaggtacttaggttgtgtactttgtgagtctgctttttgtgtgtgaaggaaacccgtatatcagaggttggatcccctaaattggccttacccacacattctgcttgatctaccttctctgggctatgcttttttctttgttaattttcttctcttttcaaaattgctgaaggaatgtatgttcataaaattcaaataatgtagaaaagtcagagatcaattaggatgcttccctaacctctctaactccttttccagtccctttccagaggagaccactttcagcagtctggggagcacctttggatgtttcttgtctaagcatttatttttgtcaagatttttaaaaagtaaaaatgggaatgtgtgtgctgttttgcagttcactttttccacttcacaataccttgggtttatctttctataccagtatattaaaactgatctcattattgctggtggacatgtgttgcactagacacacacctgacttcaggtcctgctccgtttggtattttatgatgtgtggttaatggtgtggagtttagatccattcaacctccgtcctgaatcctggatccatcacttattagctgcgtgatcctgggaaactgacttaatggctccatgcctcagtttcttcgcctgtaaagtggggttaatatcggtaacctacctcataggatgctaggaggactgagttaacgcatgtaacacatttacaacagagcctgcaacatatgctatatgagtgctagatgaggtttagctattcttttcacacctgaatactatttcataatatatttagtctattacttgacatataagttgtttgtgattcttttttttttttttttttgctaaaacaaacactgttgtgatcagtatacgtttacatatccctttgtgcacatgtggaagtgtttctgtagaataaatttcttggaatagcattagtgggcctgagggtgtggggattttcagtggtaacatcagttggtgggctctgcttgaccatgcttttcttggttcactcatatcagctcacccagtagcagctgttgggcatcctgccagtgtccttccgtcacatgtccagtggttggcagagctatgtggcagtaagcattcctctttgtcttcccagggcctggccctttgtcagcgttcattagactggatggcttggcttcctggtgatcctgatggagattctgaattgctactttatgtaaagcatggtgcccgggggagacatgcccagggccaagaaccttgatcagacccacatgcccagcgtaaggctgaggatgagattgtacaagtggtcaagagaatcaacatggtttcacccttgaatcagtccaggttcactaggggttccatgacatggcactttttaacttggcgatcatgtctttgctcagtgatatggggtaggtgtggatgtgatgattcacacgatgcagggatcgagtgcacctcccaaaaaacaggaagtgaaataaagcggcactgtgtattgctgctatgacatttctcttgatcttattaacacaggaggggctaagcaataaatgtgataatctcacttggggaatttggggttggttgtttatccaatccttgaacatttattgaacagttattttgtgtcagacacggttattgatgttggggtatggaactatggactaaggcataatttcaacctttgaaaactccacagaagctttaagaacccttgaggagacttaatttttcaagaacaatgggaatgaagatataatactgcaggtggggcctgagctccaccctggatgaggctgggggatgggtatgcatgggattattggggtcccttcacacagaaatgctcactggagaggctttcctgtacaaatattagaaatgtaaaattacatgttaatttctttttctgtgcttagaaaaggtgcaggatatataatttagaaaaatgtaaaggaaagttaaagatcacctataactgtctcatcccaatgcaaccattgtggaatgtacgtgtatttatttctttatcatgtttgtatgtaggtgcattttaaaagcaaaattaggaatcatacttcatattctgctttgtgacttgctttgtcactcaaactgcattagaagcatttcacaaatctttgaatattcctttactacatgatatgtaatggattatggtgttctgttatatattatagtcaagttagtcaattaatgatttgaaagggcacactggttaattattgttgtcttttctcctacgcctcctggttttggcttttattattttgtaaagatgcaggagaaatcttgagttctgagtggttatcccatcctttgtgaacactgctgtcaggcacacaaaacaacatgggctgggcatggtggcgggcgcctgcagtcgagaggctgaggcaagagaatctcttgaacctgggaagtggaggttgcagtgagccgagatcgtgccactgcattccagcctgggcgacaagagcaagactccatctcaaaaaacaaacaaacaaacacacacacacacacacacacacacacacacaaacccacaacatgattccagtttctatgctcattttagaatcctgcacctgaccaccacgcaaaaattcctctggataacttcatctgggccttccctccggtggaactggaagattgttttccaaactccactccttttccatttgtgttgtccactcaccgagtgccccttcttctttcatttttagacacctcggctgcagctgactccagaaacatattccctctttaagtctcggctccacaggttgcctcttctcctcatcatttctcgtttctcaccgtgaaaatctttgctttctctctttatggcttcctgagacccgaaaatagaggtaatttaaatttggtaattatgatgacaacaaaacaacttatgttgaaatgcagagtttaaaatgccagagtttcctactgttgagatctctctgccttcattctgtggataccgctgtgggagcttacctgagtctgccccagatcaggaggccaagcatgaggcgatgagaaacagcttctgcacagaggtggtgacttctacctcttgggggatgggggctggtcagccagagctaccacattcaggttcagccccttcagaccttcctaagctccaggtggaatctttgccttcccaccttctggaccctgcacggggagggtctcgggctgtagccacgaggcggcattaggcagctagaatcacagagtggggactgggggatggggtttcttctctgacagtggttaggtgagtcactctctgtgggctgctcatggcagcctcttcctccatccttgaagcgggccttccaaagacttcacctgctccgttataaaaggctttgagttctgcaagaggcagctgtgaatgtattagcatcctgctttctgtatgaacatcctgctttctggcacatggctaggccaccgcttaaacaaccggcgccaattcacagtgaaaaaagatctgctcaaagctggtttcagaaggaggacacgggaggcgtataatatcgagcccgtctcccgacggtgccatctgttctcattaaggcagccacagcgccgaaggaagggcctccaggtgcacacaaggaagcctgctcgccttgttatcctctcagagactttgccttttgttttgtttagttttgtttttgtctggcaggctcaaaaagacactgttctactttccgcagaagaatcactctcacattttaagaaattaagtctctgggaaaaaaaatattgtttgagagggcttgtaatggctccttgaccacatgctgtgcctgccaatttataacagagaaatattacagaagttgggatccaaggttggtgtgcacagccattgcttaaagagggatggatgcttcctggggacaatgatcttcccccgggccccccagcatttattcaatctggagagaattgtctgccaggctcccactcctacatcccaggaagagctgggcacattcatcatcttgtgtattcagaaagtgatgataattcctctgagagccaactgggctggggagggtgtgatcaaacttctgctggcaatcagactgcctttggggaggggagtctccattttgcaggtatgtctctactgccagtctgcagggaagcctacccagtcaacaatatgttaccatgaaaatctccttttgggggtatcttatatcacattatagggaaaggcagaggaaatatcaaaagcatttggccctgaatttaaaatgatctttccgtagatttttatagactttgttttacaagattggtgtaaggcctaaagcatgtcttcaggcctcttacatatcctccttctctctgggggtttccttcctgcctgccctcaacatcccttaccacacacctattctgtttctccccacatgcatggtttgtatattatgtcctgtcagtcaattcctactaaaatgttagctgatgttagggtattctcgtgggaagatatttgcattttaataggtggcttgaatatagaaaagcttcatcctaaagttgcaaaactttaggggaaaaacaggcaattttggatagagtgagggatgaggggatgagaagggggaatgtatgtgaggtcagagacattctcacatctcactgtgcatcatccatagaacttgcctttcttttctctcttttttttctttgtccctgacctcagagtaaatggcacctcacacactcttgtgggccagaaagaaagtctttcataggcagataggaaataagacagcagtttttccaagagtactgaaatgcaacaagtctactggtctgttgagttaaaaaatggtcagtttggttgttcttgttcatctagttcagctgattggttcggtagaagcaatagagtactgtactacagtatagtaaaactgttgcttcacagcagccatccctaaactttttggcaccagggactggtttcatggaagacgtttttttttccacagaaggggcgggagatggttttgggatgaaactgttccacctcagacaagatcatcagctattagcatattagattctcataaggagaacacaaccgaaatcccttgcatgagcaattcacaatagggcttgcacccctatgagaatctaatgcagctgctgatccgacaggaggcggagctcaggtggtaatgctgctcacttcctgctgtggggccctgttcctaactcataccagtttgtggaccaggggctggggacccctgatttacagcactaagttaccagtttccacgtcggtgggattggcggaaacttttcaagctctgtgtgatggagtaacacagggtagaaagagtacccttgtgaaaagcctggctgcatctgcccctttataaaggagacaattgaagctaatttatttttaaaacacaaaatgaaatttggtttgaaatttgaggaggagatacattgatgttgcctctgagaaggagtcaaagaccaataaaaggtggttctttctgttcccaaacccagaagccaataggggccacagaaggagcacagtgccacggtgaccatgctgcagcattgtcagatttagcaagaagaaatacagggtgcccagggaagtttgaatttctgatgaacactgaagactcttttagtatgtatgatttttggaacatatttatagaaaaaaattatttatctgaattcaaactgagtgtcctatatttttgtctggcaatctggtaccatactgcccctttgtaattccttgtatatgttgttaaagaataatttttctgaagggtaaaattataactcttgtatgattataaaatgaacatgtgtcaaagatttttttagttcactgattaatgagcgaatcagtaagatgtcacaactggttagaagaattcagaacacacacacacacacacacacacgcacgcacacacacaatcaggaaaggctgaactgaatttgttaatagttgcaaaactacccaaattcctaggacaataatcaactgcattccactgggcaaaattaatttgcgtttctatggacaagaatcatttgcattactctcagttttctacaacttgcagtagttgtaaaataggccaaagacaatgaacactacagaataaccaggaagggtgtgttagaacatccatgaatcatctttgcctatttcaaagcctttcacaatggaaacatttgacagtgttgtgctctctcctatctcgggcctttgcacctgatggttcctccacttttttagttgtcttgaacttacccttgactgtgggagatcaggatatgccactccaaaatatgcctctttggcatgaggattgttgagctgaccgcaaataaggagaaacacatgcaggaaagcaccctgctctttccctatttgcctcaaatcaggacatacatttatgaagacaaaagacatcccacctcctcttgctccccaggcaaacagagattaaccacttaagacaactttggatccttacatgcctggagagagcaccagaggaacctacattaacaagcttcaccaactagcctttatctgccaattatttgcctttccaaaagttgctgcccctaaggactcaaagttcttttcctttgtgtcacaaatctaaaaacgtactgttccttgttgaagatactatataaattggtattcaaagccacctcttcgaaagtttcttattctctgggtttctcccatgtatgtatgaaatatacgtacatcaaacaaacatctgtttgtttttctctcgttaacctttttttttttgtttgttacaggggactgttctaagaacttataagagttaagaaaaaaaattatcttcaaacatcattacctctggaaagctcttcctgacccacaaactaggttgggttcatgtgctacaagctctcacaggaccatgtttccttcattagggcatttatgtgagtttataattcatcctccttactgaggtttctaagtccttgcatgatctgacccctgcacccatcagcttccctttcaataactgtgctctggtcatacttctctcccttctgttcctcgaccataacaagttcttccctgccttaaggactttgcacctgttgttccctgtgcccggaatattttttctcttggctcttgcaaggcatgtttcttttcatccgtcaggtctcagtttgaatgtcagaaaagcctctcctgattatcttatctaaagatgctcccttctccaccctcactttctattctagtgattcctcagccttagcacagattagaatcacctggcaggcctgataaaacaaaggttgctggggcccatggccagagtttttgattcagcaggtttggaagcagcatgaagttctgtgttttaccaagttctcagttgatgctgatgctgccaggatgggcatcactcttggagaaacactgctctgagtgttttctttcaacacctgacattattttccccctttgctgatttgctttctgtctcccatagagctgaaagttccacacgagcagagatagtgatgctcctattttctgattcatctacggtactaagaacagtgccttatataaaagaagtttaatgattatttgatgaatgaatgaatgaaccattttctatttttttgttttgtattgtaacaaagggtttgcttaccaaattactgttgaactgaggtgccagaaccaagttatagagattggctttcatcactaagatatgtttgtggaagagtagttgtcttaatttaataaaccacaacaatatttgaccagtaacttgaataaagacaagtgcctactgcggcctacactttccattagcacgccttcctgcttagggtcaatgtcattaaccaacagttggttagatgacatcagggctttaggtgctattgacaggtctcaagaagatatgagttttgccaagactggtagctatgatgagcattcagaagacatatatggcaagtggggtgagggaagggcttgtgctttggctttaagcatgcctcatggatgaagcagcttgggtaaaggaagggagagagaggaagcagggagaatccttcctccaagctaggttataggcagtgctctcacatccctggtcttggcaggtcctaactccaggcctcctgatgcccatattctgttccaaagaccacagtccaggctttagggcatagcctcaggctctcctacccactaaccctctaggttctgtttgtttccccccttctactctcttctatgccattcctctaggcttttaccttgccatgtgacaggcttatgtggtaaactaatgggtcctaatgactgccacacacacacacacacacacacacacacacacacacacccctatatataaggccacatgcggtggttcacgcctgtaatcccagcactttgtgaggccgaggcgagtggattgcttgagctcaggagcttgagaccagcctgggcaacatagtgaatccctgtctctacaaaaaagttcaaaaattagccaggcatggcggcgctcacatgtagtcccagctacttgggagtctgaggcaggaggattgcttgagtccaggaggtcgaggctgtagtgagccatgttcatggcctgggtgacaaagtgagaccctgtctcaaaaaaatatttatatatccatatgtatctccttggggtgtgtgtgtgtagtgagacacaatatggcatagtgcctaaaagcatatactctgaagccaatcctatgtttgaatcttttttctgctaaatactgtgtgtccctgagaaagttgcttacccattctgttcttcatattacggggttaacaacagcactaaatcatagggttgttgtagatataaaagcgataataattgtaaagggtttagttcctgtgccttgtagctaccaggataataggcctaatagacagcaccctatggaaacagctttccattttaacaagggactttggtaaacacatgcgctgagtacaacactcttggaagatcagatatttgatggcattcagatgacagcatgtgagcagatgcctattctgtctgggtgttaggggacagagcactaggtgacttggctgctgtctctgatcttaaaaattgctcagaccctggcaattgaggataagacaataatagcaatgttgtattcaggagcgttgctttaaataatccttctccctaatagctttgcccctggcgtgtgacaggtgtttacattattaagtaaaagcatttaaacagcgacctccttggtataagggtgaaggagattaaaatccaagcagtgctccagctatttaaatcaatgagacttgtcagatctgtaacacatgagctacttagagggcgcaggcacctattgttttggagcttcgactaatatctcaatatgctccctccctccaagtctagccaggccctgggatgctcattaaaggctggtctgaccacggcctctttccctgtggaagcagcattaactaactcttggctagatgcgtggcaaatagttatgctattagggaggatcagagcttgagttgattcctgcttagagaaatgaccttgcacggaattccagcggttaagttccttagctaaccagaagcagggaccataaacattgtccccttcttccgctagggggtgctaaaccaggctgcttggctttgcccacagccatcctttcttgagttgtgttttcccagtctttagctatgacattgacaacttcaggtccacctgctgcattgaggaaccaagtttctgaaacttaaatctctctcttttttaaagcttcatgctctcatcatgaacaagaaacctctctcttccttagtaatcaaacttagatccttcatttgtgtcaacggaagggaagtctccacgtaagaagagcagctggaccttaaagatccaactcttattcctcaagatttattgtccccttggaggtctctagctaatttctgcaggtcctacaaggctggcttcagagggagctgattcattattaattctccagttctaagcaggcgaacaaggtgggggacacttgaaccttttaattccttggattcacagctgagccaggctggccacaaaaggaactgcacacaggcagggttacaaggcaaagtttacttttcttcaatttatggcctcatatgtctgcctgtctgactcatggaatgttgccaggtggagggttcctgatgccaagagaccgcttaagcctcatctgtggaagtgctggttcagcagagggtgaagcactttcttcctgggtggtctcaagttctcttttcctggtgattgactttgggaagttcttcctgtcacaggaaagccctacttctatccatagcagcaggtgaggccacagcctttagtctctacatgacttctttgtcaaaatgcaacatcaaagggttcacaaggaaaagagacccatgcaaataatccctggctgctcacagtgtcaggaccagcagcacaagtatcccctgggagcctattagaaatgcagaatctcaggcccccagcccttttgaaacagaatttgcattttaacaagctgcctagatagtttgtgtgcatgctgcagcttgggaaatagtgacagagcagagagacagccttttgtctacactgtctctttccaccacaagaaacaactgcattaaagcttggttcaaggaaaagtcctgtgatgtccctgtcctttggagctgaggaattaacatgggctctgtggggtttttctggaggatggcagaattgttggggatgcttgaacttctgaaaatgtttgaagggagaaggaatgtaacgaaccttctgctcagagcaaagcaatgagaccgcatcatgggttagagaccactgcacaagttgctttgcttatttctataattgtggtcagtacctctgccatctgccatcttcctacagcagtgtgtaggcctctaggaggctttagcaagatcagcacccaggtggaggcctcttagaagaaaaaaccctgtcaaagtgcaggggactcccagacaatgcaacattcatttaggccaatcaattctgtcaaaaattcattcgatgaaaatagtaccaagtgggtactcaactgcttagccaatttagtctccacagcaactctgaggctacaggtaaatacagtctcaggcacggaaggaaatctggtatttattcagagaggcagtagacatccctctgtccctgacttgctagctatgtgacccaaggcaagttacttaccttccccaaccagtagcttctccattttaaaatgggttatcagaaggtattgatcttctgggtgtgttgtaaatgctaagcttactattcattctaggccagccaggcatggtggctcatgcctgtaatcccagcactttgggaggcccaagcgaggggattgcttgagccctggagtttgagaccagcctaggaaacatagtgagacccagtcccagcaaaaaataaaaaaaaattagctgagtgtggtggtgcatgcttgtagtcacagctacttaggaggatgaaataggagaatcacttgagcccaagagctcaaggctgcagtaagccatgattgtgctatttcactccagcctgagtgacagagcaagactctgtttaaaaaaaaaaaagcaccctgtaatgctattactcacacgtaaagtcttctctataggaggtaagaatgatatttcaggagtgtaaagaatcttgatgtcaccttatggaaaggggatgaaaaagaagatgaaaaaggcttgttttcattttgccagagtcatggattccagttccaggtctgttttgcatcaccatagtcccaaacaagtgtaacatccagagcccaggaggaattctggatgaaatatcagccaggagcaggagtgtgacagctgtaggtcacttgggccataaagttagttaatggggaagacagatgaatgagtgtattgtggcaacatatcagaaggtctgaggcataaatagtgttggaaaataataagacagttggttcttgaggatcaacattgcagggaaggagaaatgcacaacaaaagaccatgttgtgtttttggatggtggccggggatgcacattcactgcccctcccctcttcaaccccactctccacatcccgtgacctggtgggatgccagtggtcatgagatcccatcacatacatgagtttcaagagtcactaacaagcttgtaaagaacaggtactttctaaggaatattcactcttgcagctgtattcctagggcttaaatagcacactgttttccactgacaaatgatttcgggtagggtgatctcatgaacttgtactaatggcagacacatttgaatttcttttttattctgaaagttaactgctgaaagcaaatgtgaaaaaaaaattatctccctctgttttatctctgggagaagataaaaatacgaggtgttttaatttggcagtgatctgggcgccttccgctggcctgtttttcttttgcgaagagctcccactttcaggactgccgtttctttgatcttatattctgtctgtgttcaggtacccctttgtgcctacctgaatcgtgtgtaacaaatcatcttaattacttcaggcctggcttcctcctccagttctcattttctgaaattcctgcgatggttaccaaataaatcagtgtggggctccagcccttggaaacagcacggaggcaccagcagcagccagaggaatttcaaagttagttaaaaggcacaggaggagtgagggaattgattgagaacctccctacccaccatgattttcagcctggagagttagtgctgcctgtactccaattccatgtgctttgcggggctcagccctcacacttttccccgtagaagagagaataattaatgccgtgaccccttggcgtggtagctagagccctgctgtcatcagcagtgccccaaacgcagtaggaacacgtaccgtatttcaaagcccaggcaggcagagaagggggaaggaactggtggcgcgctgtgacctgcgggagctccccagcgcagccagcaggaggcccaagctaggcggagagagggtcgtggggaagcgggccgctcccgggactcgtcactgggttggagctggcccgcttgagtggctccagttccaggaaggccgggtggcgtggggctgtgtttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccggggctgtgttttaagtggccgtttgtaagaagaacctctggcggagaggtgctgaggcaggctgggctgtgatcctgcacgccaggcggcctaaggggaggtaattgggaaccgcgagctgacactgcggaaaaaccaaacaccgcatattctcactcataggtgggaattgaacaatgagaacacatggacacaggaaggggaacatcacactctggggactgttgtggggtggggggaggggggagggatagatttaggagatatacctaatgttaaatgacgagttaatgggtgcagcacaccagctagcacatgtatacatatgtaactaacatgcacattgtgcacatgtaccctaaaacttaaagtataataataataataataataaaagaaattggtatttactaagaaaaaaagtgagagttctgtgtaggcctttgaaaaacacaaatctcttacttggggagacattccagtttaagtattatatttgacaaagtcctaaattatgtttaaactatggttatgaattttactaggaaaggaagaatttttatagcaaacaaattacaggaatttcaaagaccaaaaagaaaaaaaagaaaatgtaagccgcgaagccgcatcaacgccttcctgacagcggtgtctgttagtccacggcgtcccctcctaaggggagctgcgaaagacccattccggaggcatttcacggggccccgtaacacccgggcgagtgagctactgagaactgcatggctccttctggggccaggcggtcctaggagagccggctgggaggcggattgcttggacgtcccccgcccgcccccgcaactctgcgtgcggcgacgttgggaggtcccattagaagctccttgggcgggatctgtccaccatgccgcggcgcggagtgggagaggtttcggtctctgccaagggaagttgctgttgagtgcatcgccgtgaacacgacgcagcacatcctacagcccctgtggatatgtggatgctgtgggggcctgttgggtccgatagaagtttcaaaatcaaaatttttcaccatcctcgttgggtgatggtttgtagaatatttttgagggagtcttgtttgaggcggacagactcactcatctggtacactctttttcgagaacatggtgataaaataggttggctctaacgagaaggtgtcattccgccactccctttcccaagagggcttcgagggacactcaagtgaccaggatgtggcttatcctgtgatagccatctgagaacgttgttctctgttctttacttgcttctagtcagaaaacatggcctgtgttaggcaccctaggggataaagtgaattagacctggacctgactccagttttttcttttaaaactcactcgttttttcttcaaaaaataactcccccggtgtttctaatgtacagctgttttttgttgggaattactacattaaattatctctaagactcttctcatttcagatattttttggtttcctaattgtctaaaatttttaattatttttatttttattttttatttttttgcagacgtgaggcctccctatgtcgcccaggctagtctcgaactcctgggcttaagcgatcctgccacttcagcttcccaaagtgttgggattacaggcccgagtcactgtgccagcttcccctagttcttgagctcttctagggccactagattctctttcaccagcatgaagtaggatcattttagttagggtcaaattataaccttaaatcccaagtgacactgttcttttgtgaccactaacccctcaaaagatttttttttttctgatttcaaaacttctcctcctaaatcatcctgcaaattttactgaatctctactgcatgccagaggccccattctaggcattggggaaaaatacagtggtgcagacaaggagcctgttctcatggagcttacattctagaatcggatccagatcgttatgaatttcccctttattttgttttagtctctttcttaaactttcaactgtattcttctggttactcaatcccagttcatcctagggcagaaacataaattaagtccacttttatacttggtattacgcactgaatgtttttgtctctttcaaattcatatgttgaaatcgaatccctaatgtgatggtatttggaggtgaggcctttgggaggtaattaggtcatgaggaaagaaccctcatgaatggaattagtgccttttagaaagaggcaggagagctagctcatttgcttgccaccttgggaggatacaacacgaagttggcagtttgcaacctggaagagagtcctcgccagcacctgaccatgctggcaccctgatcgctgactttcagcctccagaaatatgggaaatttctgttctttataagtcacccagtctatactactttattatagcagctggaactaaggcacttgtttatccttcatctgtaggaaaatgctaaatcagataatggcaaccactgtgaactatattatctctagggtattatggggtctccatggcaggtgagagaaatatctttttataactaaaaatgttgagcactctaaccatttggatgcatattttttactctctgtatttaaaagttaagtctcattttctacttgtagttgacatctgttgttatcatttacttctctgttacatgcagggaggatacattccctagtcttccatttttgtgtgtagggactttttcagaaaacactcctagctccttggtttcctgtatcccccttttcccttcccctcaagggaggaagcgtgagctacttgatgggtgagtttgggtgcagtggctgagcatgtgactctcagcccctttctattttctctttgtcacctacaagtgtgcaaacagctttctatgctcttccatgccatacatgacaggagcaggcccccatgggagactgcatgtccgtgatggggcaggcccatctaattcaggaagcaagctcatttggttaacagacctaaagccatgttgtaaggctgacattttagggcttttctacttggctcctgggtctttctctcaactggctccaaactaaggtggggcattgagctttctcaaaccccaacagtacccatatctcaattccctagagaaccaccttctccagctcatagtaagtttgaattaagtgaaactgactctacacatgagacccacaattagctccccttggctacaagatttgtttaaggatgaacatagggcccagtcagatctaatgaatcacagtgatgttttcctcgttgaggaactcttaattttatctgctggacctaaaggagggtgtagggattacagccattgctgccatcccattacaacatgaagccaagagatgtagaaaaatgctcctgatgccattggttgagttcaggtttcagccacatctgaaatgtattctacccctggacttttcatcttaagtgaaacaataagttccctttgtgcttaagctagtttgggtccgtttcctactgctttcaatggtaaatggatcattctttatattattttcatattgttagttttaattgattttagatcaccacagatcacctcaattactcacgttagatcccaggagctagaagcgattttagaaagtgttaatagcaggaggatacttaggttttaatgttgagatgttaattattttaggcaccttttattacctatttactttgtctatttatttgttattttttggtaaacaaatctgatggggtacttgactatagtaagtctttaatcaaactttaacaatgcaatcagttcattttttccttttgattaactggagaagagcaactcttggtctttaaagtcatagtgatcattataaatatcctcaaggaaacaacaaactcttgaggaaagttatttcagttacatcccaacataagagactggaaattttttaccaagaattctggtagaggtgtaatataaccaggagggtgttgtggtttggatggacaatgagaagagagaagggccttctgggaatggggaagaaaatcagtggagttaagagtgaggcacattcatagctgctgaggtggagatggcaagctgtccaaaaaaaaaaaaaaaaaatgtgagctttccctttcatttttcatagcattgctgctgggaggtggctgctcatccagggactatatttttcaacactctttgcatctagatatggtcatgtgacttgttctcaccagtgaaatgtgagtggaagctacttctatgccaaggcttttaaaaagtagcctactttcctggtacgtttcctcctttcatccctacattgtccttctagtggttagtaggggcataaactcgaagcttggctttctgaatcactgaatgagagaaaacttgctttgattttttttttttttttcaagagacaggttcttgctgtgtcacccaggttggaatgcagtggggtgaccgtagcttactgcagcctcgtactcctgggctcaagtgatccttctgcctaggcctcccaaaggtgctaggattacaggcatgagctatcacgcccagactggactattttgtgaaagggaaataaagttctattgtgtttggccactgtattaggctgttcttacattgccataaagaaatacctgagactgggtaatttataagaaaagagatttaattggctcatggttctgcaggctgtacaggaagtatgacactggcatctgcttctggggaggcctcaggaagctttcccttgtggcaaaaggtgaagcaggagtaggcacttcacatagagaaagcaggagcaagccagaaagagagagaggcagggggagatgccacacacttttaaacaaccagatctcttgaaaactcactcactatcgcacggacagcactaagccatgagggatccacccccatgatccaaacacctcccaccaggccccaacgctagcagtggggattacatttcaacatgagatttgggcagggacaaatatccaaacaatatcggtcagtgtgcatttacagatatatttgatacaaaaagatctcagtgcttctcaaagtgcggtttccagaccaggaacatcagcctcgctggagacttgttagacatgaaaattctcaggccccactcttgacctactgaattagaatctcggatccagagatctgtgtatctgacaagccctccaggtggtcctaatgcacactcaagtttgaggaccactgccttgtgccgtccctaccaacttcatcaccgctctaactgatcagtagacatgggttgtttctctcctcagctttgccttttctggattaaactctcaaagtgtctaaagtttctgagcttcattagcaatggtgctgaaagttaaggataatgttgaaaaatcttgtgcatgagggaagacatttggtgagtttgaagttctgatgaattttgagaaaaagaaacatcctgaaagcttaagatagcttaaaaacaacttttgttcagttctaaatattagcactttttataaaagggcatatatcctacctagaacaggggtcacaacccagatgccccccaggtaatctaatccaggggagtgggccaagtggagggcagcgaacagtatgaagcaacagctgattgttaagagtatgggcccagtgacttcaggtctaaacattattaaaaagaactgcagatttgcattttcattttacatcttctggtttgtaaatgttaactcacattacaaaaaatccaaatccaagaaacaaaaccaaaaattttgtatgggttgaacatgcctgagtgtttaatttggcccctgggctgccagttttacaacctttgtctggaagtaccagggaagcagtcaggttgctaatgtctcctcttactcattaggaggcaaaataacttttacacaatcatgagctccaaaagggagacgaataagagctgtacaaagtagttgccaaggtaacatcttgctgatcagaaaggggcgacaattgggttttatgtagacgcagtgggagaatgaaacataatctttctctgtcttctttctgtttaagatcagtgtggaaatggatgtggacgcggtgctgctgcctgagattagcaggaagcaattcttttcccatttggagagaccccggtgagacctgatcaactagcaacatgcggaagtcacaccattaagtcttccaatttgctagcagcaaatcaatgaactctgatagctgctgccctaagctagcatccagggaactgtggacaagctatttgatacctgaattttagtgaaggaaagttaaattttttcttaaagcagggtgggagtggggttgtgtggggaagattatattaagcagtgagagaagacagatggagttttgtagaaagagagctggttgttttaaattgtatcttaaatttattgtagagctattggtaattagtgttttgttgttgtgtgtttataccaaccaattaataagaaaggcttttatttttatttcatcagttggagctgaactttattttttattataaatataaggcattattctagggcctggcaaacataggcagccactttttttttctggggaagattataccttggtatgttttcaccactgtgagatgaaaatttgagaacagtgagagacagatgcttgcctgaggagttttattttccctttaatccttatcaaatatccagatattacctatattgccttgatctgctgtctgaaggtgggtttctttgattgtttgaagagttctgggcactagaggtgcttactttgtgacgggagcaaataacaaggtgttgcccatgacatggtcaagcctcttcttcaattagccacctatcttgggcatgttttcatagagatatatctcatcccttttaataactgcagaatcttggacatttagaggtctccaaatattggttgtcatttatggtgtatcgtgtttttgttattataataacgttgcaataaataccctagcaacctatttttgcttacaagtagagtattttcgaagaacaaattccttcatgtgaaactgacgggtcaaaatataaaaggattaaagtttcaatagttagttaattgccttacaatggaattacaacaatttatacttccaccagtaattcatgaactctgccttaccacataatatttctaatctttcccaatctgatatggagaaacatgttttattattctatttttttttcactaaaagagagactttgaacacccctccatatgtttcaaaaacacttgtagaccaggtgtggtggctcactcctgtaattccagcactttgggaagtgagaagattgcttgagcccaggagttcgagaccaacttaggcaacaaatctagacaagggagaccttgtctctacgaaaaaatgaaaacattaactgggcatggtggtgtgtgctgtggtgctagctgctcaggaggctgaagatgggaggactgcttgagcctgggaagttgaggctgcagtgagctgtgtgatggcaccactgcactccagcctgggcaacagagtgagaccctgtctcaaaacaaaacaaaacaatacaaaacaaaacttttttttttcagtgaatgtttctttatagatttcaacttctaaaaattgttggcactttttttgattgactgaagagctcattatatattaagcaatgtagactttttttttttttttttgagacagggtctcgctccgtcgcccaggctggagtgcattggtgcgatctgggctcactgcaacctctgtctcccaggttcaagcaattctccccgctcagcctcctgagtacctgggattgcaggcacctaccatcatgcccggctaatttttgtatttttgtagagatagggttttaccatgttgttcaggctggtcttgaactcctgatctcagatgatctacccgccacggcttcccaaagtgctgggattacaggtgtgagccgccgcgcttggcccaatttagactttttaaaccaacttttgaaggttggtttttaaaaaataaatgactggatcatgttctaactactcatagtctcagccaaacacaattgcggaaggcctagccaaaggctctttgctcagtgaaagtcccatgaatctcaggcacagaggatagtctggaaagacctaacctgcacatgcaaatctattaagaaagatgaagtcttaggcttatatggagctaaataattgcatgtttaatgcaatgccagggtacaggtaatggtgattggagttggaggggtgatgtgtgtggtgggtgaggaagtcagggctgagtcctaggtgagatctataagagtgatgtttatttatgcatctgagggctgggactctcatgacaggatttattttcattctctttcaaggagagccatgctgccttgctgcttcttgctcgtgtacacagagcacttggtgtcttgcgaatcccctttgacgccggtgcctttccaggccagtgctttgcttgtgttcagaggatgcatgctcaggccctaccagactatcttagggatgaggggcaaattttgtttccaatgctctgtgtgggccctccatggcattttcttcattttgggttccatcctggcctaaagcttcccattaaagctaatggccattggagttaacccaaattttctcctttggtatttataaaaagcaacactgaaaaaccttgaaattaactaacaataaaaaaaccattgatcggttctttcctggagatggttctttcttctcaaataggccactttgcagactggaaatcaccccaatcctcaaatagcctaatatttttcacatgtgattccagcaaattgctgtttgcattaacaccttggtggggactcacttaagagctagatttgttagtgtatttactgacattttcacatgatgttttcagctgcctgaataattgtaatattcaccagaaaaaaatcaaagtaatgaaaggtgcctacaattattcatatctcaacattgtaagccttaatttcctgcctgaagtgtggtaaattactcatttttaaagtcatctctagccactgagagtttatggtgatgtatatagatgttttgtagattccaaaaaaaatcaatgactatgaatatcacagactgtcaaaacagctggtgtgattataaaataatgagatcaactaaagacatcagctctcagacatccaaattgtaagaggaaaatgaagacgaggaaggggaaagtgaattgcttaatgtcttgtaggtaccaaataatagagtcagtatctgccactgccatgctgaagattttgcactgttacttacacagattcattcccctttttgcaggctttgttgggccaggagatggttttgcagcagcagaagactatgaactgggctttgggagataggatctctggttgtattctggctatccacactctgaaagaggaccgtgacaggtattgtcattattggtggctgagtttctaggttagccaacctatggcagattgggaagactttataatgcgaataaacagaagaaagtttacttgatcaaaaaagattttttctcctggtggaaactgcaattattagggcaactctttaagtgtccatcaatattaggatgcattttaacaggttaagtactcttctaactgggatgaatagggcattgacaggaaaattaacacacaagttcttatatcctccttcccttatatctggtcgcataacctaatgtgaattttttatgcctttaagtgctgatattatggaaaaaccttctaaaactggataaatatcattttccaagactcagatcaaatatcacatctttctctgattttcttgatccttcctgccaaaaagaaatagcaccatatatgcattagtataatctatttgtaattaacataaaatttctcattttacagagaatttgagtatcctaccaatatacctacaaaaggatgaaagaagatttggagtcaagggaaaacaagggcaataaaatagaagcttaccacctgctctcatacagttgctagaagaggactgcatatttggttctaagtttctggaagataaagccaaaatagaaacacaactcattataaaattttggtgtatccataaaataaaaacaaatgacctgtttga

SEQ ID NO: 546 - DNA, 301082 bp, Homo sapiens
cttatagatgtaaaatattttatttgtaaatggtgatcttctaaatctgtgtccacaaattccaaaacccataacactctgtatacttcaaaaaattcaatttttgccaacattagatactattatacagaacagaaaacaacaaaaacccggtaggacaaatactggtaggatgtcaggatattgtacaagagaagaaaaatattcaggaaacaaatttcatacagctatttatcaagagaaaaatatatacaattgatttattctgtaagataaaaatacatcatgccatatacaagttcagaactgcatcactgaatataccaacagtttacagtccacttgaattgtgcacacaaaacttcattttatacttagcctgtgaagtgtcagtaccagaattttaagtacaaaataaaaagctaacctggttcaaaatgctgattaagtttctacaagcaaacacaaaacagtgttttttttattaaagaaatgtaaacaaacagttcatacaaacacattttaaaattacatcttccaaaaaccctattgccagagtcctgcagctgtaagcataatcacatctcctttttttttttaactttttcaaatttttgtgttaaatagaaggctaaagggttagatttaagtttctgctacatgatcctattacgtttacatgattctctgtggctgaaacaaagttctaatcaaaactacttttgctgaagaaaaaattcagcctccatttgggtgtatttttaagcagttattcacagttatcacaaattgtaagcacaaaaaaacctgactgaagaagtagggatgcaacaatataatatgaaaaaattagtttaaattaccaaaacagctataaaagttgtagtcgtagcatacgccccgctctgtcagaagtaaggtgtataaaaccattgagtactaatagactgcggtttccaaaaaacccccaacactctaggttgaaattttggttattacataattataatggcatattttataacacaaaattatattgtaacatccctatgaacattttataagcccccgagctgctgcagagcctggtagcatttggtcaataactatttttatactgtattttttctcaaaatatttacatatctgtacaaagtaacagggtttgttagttctgcaggtaacagcagcagcttggctttcttctaactttatttaaaaatagcttcattcacttattcaataataaatacaaaagtttctcttattttacagaaatcaaaaactacaataaactgactcatggaatcaagtatttaaatgtatttagtgcaagttattatcccttagctctatccctaaggaagtcatttcagtacattccttgttcagtggtgtctactttatttaaaaacattttgaagttagagggcctgcccctttttaataaggccgtggccagcactctctgtccccctcgctggtgatttcagtcttacattcataggaaggcccctgcccggggcagggcagccatcggctctttgccccagtaaaagtttctccttagtgagactagaaaaccaaaacaatgaaacccacccacaagggaaaaacaaaacaaaaaacaaacaaaaaaaaaagaaaaggaaaagaaaaaaaagcaaaagtgctggaccattctgtgattccgtttaacctcggccacttcaggaacgctgcttctgtcagcttcctcctggcgctgctttaacctaaaggactgaggaaatcagaactcccagaagctttttcaaaaagtcataaaacagaaaacaaaaatctctttctgtctgcaaaattccaatggtgtgttgaatcgcctcttcctagggacaagccgcccgctgagctagcaaggaatgcatttcagttcatccacttccggcagttcacagctccacagtgacacggaatcttgtgctggtcatcttcaaagtcaaacttatagtcatagcagagctgcccacggcaaagacacagggtaagaaaggacagcaaggaaggcaatagcgtttctgcctccatctcccttgcattttaaaaccagcaaacgaaacagacgtaaattaaggaagacctgatttattgaggttccatgggaccctgggggaaccctgaaaagaggcattgtgcttgcacagaggaaatgagggaggcagtatttttaaacagcgagatctgagaacgggagcctgaccagagaaagctgtatttctgtgacttctcataatgctgtccctgcaagtggatggaggggactggaagggcaactgctttcctagccctctccctaaaacccagaagcctttcacctcccctgatttactgaatggggcatgcaattctgggtgagatgaactgccagctaactctgttttccctccttcatttttcctcactcaagactgaaaggatgtctttctatttagaggtcaccaaattaacatctcagaccaatcaaggtaggtgggagtctgcgtgagtcccacggtacaagcctcagtgcgcggccctgcaacccccaccaccccagagagagccgatgctgcaaaatgaaggggaggcccaggaatttctaggtctcttctgagtgaaatgattctagacgctagctggaaagaccttctacacagaaaggaaggaaaccagtgtttattgagcagctgttcttggcaatgattccactgctttctttcaggtatctgctgagtccttccaagagcctggtaaggaagtcattttctctatcttgcagaagataaaataggggctcatattaaactatttactcaagaatactcaagtaggaaggaggcaggtggccctgggctgagtctcttctgaccaccatggtagccattggttactggcactgtgccagggctcccacacactgtcttatttacacgttactttgagatgtataacgggccttgggtctagtcggatccttattcttgactaagaaaggagattccacaaagacccaaaatacagatagaatcccacgaatcccatggctatgttcacgaagggagaggagcaccaacaaagtcaagtcactcaggtgcctcactccccaaatgcgggacgtttcctacagaaaccaagcctgctgctcagtgacagctttccaggaaatgccaattccagaaccaaggtacctgaatcacagtgggaaagaccaaggtgggaagcaaatgcagcaattaaggccaaaaataatcccaatgggtgagccgccggaccagagtcacctctgagagcacggagacaaacagcaagcttggcactcggcattttgaagacaacaacccacacctgaactgctgaagaatgtggcgatgtgggcacttggttaagcacacactgatcgccagcgtgagcacacaatcctcagcagcacggcggcccagatttgccgcccacagcccaacagtgccatctcaggagccacggcccccttggagaaggacggggatgctcttcagaggggacactgccaaactgtgtccaggttaaggggataaagaaggatcctatggcacacagaaatgataccacctgggtgccatggggatgctgaacccgtggcacagaagggaagggagaggtgacagcaaatgctcacagagctgccatgtggaggaaggtgaactggagtgcctgaagggtgagatactgcagggtgggaacatctggcctattatggacagagtttttatcacaacaaagaattgggaaacaagtgagtaagtgacctgtgtgaggagggaactattcgcccaggatctgaacaacatggcagatgcaatctctcacactcttacctcttctcctttctggattctccgactggagctgatgataattttgtgtcctctctcaaaagtcaccacttcagccacacaattaggtgcacacgaatggttgatatacctgcaagccaccatgtcagaaaactgtattgtaaaacagctagaagcagctttaaaaacttcccatttattgataaagcagtttttgctaattaaatttctatttgcccattgttagaagcacaaatataacatttaaataaaaattctcaactcatttgctctgaatgtttagtcaccgccaggctgccgtgagagcctttcccttggcttcagtgttctctccaccagcactggccccacaagcaaaagcactccccgtcaggttcctcgctgtctcaccttgcgggccctcctgtgagcgtcgcgtcaatcacatggtcgttatccatgcggaacatgtacacaccacggttctgagggaaaagtcagtcagtaagtcatcaatgtcgacctgaaactcccctctgtgttcctatccacaccaggaggactcagtcgaaactgaacggaacggcagcctgatcatccttactgtggatattctattaggcacagatgacatttacatggcacgaatggaaagcatggaatcagtaggttgtgtgtgaagccaggctcattaatttacagttgtctatcaaagtaaactgtaacaccaattgaaagagatacaactgataaaaatacactaatatacagatatggcttttgtttaaagctgaatgcagcatgacagatttcattctgccttccagggtgtctggctggcacggagaaagggagaggatgatggtgctgtgtatacaatctcggggaccagacacctacctgagactcataaagcttctctttcctgttggctacttcgtttcgaatgatagtcccgatgtactcaatgaccatggtgtgtttctcaatgtctcgagcagcatacaggcccagcccctaaaaaaaagtgtgtacatacttccaatttatgtgacaacaagtcttttttctgtttttcatacaaaggtttcaccctcgggtcttattagaagccatacttaagtttcacttgaactcaaatcatttttgaatatgctattttctgaaattttaaaaattggacatttttactacttaaaactatgccatcactagcttattcctacatcttttttagcactaaattcttagagtctatgtataaagtagtactgtggcttggctgtcttatgtattaggctatctaaccttccagatgagatagctgagttcccaccaactaaataagcttattgacttgtggtgtttattttaccccaatactatttcaaaaaagacataataaattcaataacatagaaatcaggctaactataaccaatcactgatactgtaaacagggttcagacttggctctgagtttcccagcagccagggcaaagagcagacacaggaaacgtcactctgctgtaaatatcaggaatgttggaaacaaatgaagctcttggggaaggtaaatttttcactaatacaaaattctgaggctgggaaagaagtttgaacgggctgaaatggaagcagctctcactgcgcagcttgtactcccgtgctggtggcctgccaggtgcactattcaggttggtagcacaacttgtagagaaacatactaacaaaatatgggtctttgccataaatagttgtattttcttgtcccaattttgggtttttgcacttaattctgactagaaggcaactgaatgcaaaagtactagactagatgcaactgaatcagaagtactagactagaatgcaattctagaattgaactgaattctagaatgcagaaatcaactgcattctagtcggaattactaggaggaccatgtgctgccccagctgcatcctcatgaagcacatccgggagcacatggtgggaagggccatgtgagagactttagtatgtgaactgatttatcctctgaacaagcatctttgattatctgttctactccagatacaactcacaagtgaatgaaccagaacacacaaaaagtatgtatggagatcaatagagtgtggtttaagaataaacaagatcagtggaaatgaagagattccaaatgggccaggcgtggtgactcatgcctataatcccaccactttgggaagccaaggcaggcagatcccttgaggtcaggagttcaagaccagcctggccaacatggtgaaaccccgtctctactaaaaatacaaaaattagctgggcatggtggcgtgtgcctgtaattccagctactagggaggctgagccaagagaattgcttgagccccagaggcagaggttgcagtgagctgagatcatgccactgcactccagcctgggcaacagagtgagactccagaggctgaggcatgagaatcgctttaatctgggagccaagatggcaccactgcactccagtctgggtgacagagtgagactccatctcagaaaagagaaatagatccctgcatgtatgaaaatctaacgtacagtagtaactggtattaaaattcagtttatagtcaagatttcgtggggttagaagaaaaaggccaggtgcggtggctcacacctgtaataccagcactttgggaggcagaggtgggcgggtcacaaggtcaggagtttgaggaccagcctggccaatatggtgaaatcccatctctacttaaaaaaaaaaaaaaaattagccgggcatggtagtacacacctgtagtcccagttacttgggaggctgaggcagaagaatcgcttgaacctgggaggcagaggttgcagtgagccgagatcgtgccactgcactccagcctgggtgacagaggaagactctgtctcaaaaaaaaaaaaaaaaaaaattcatgccagccacgggggctcatgcctgtaatcccagcactttgggaggccgaggcaggtgaattgcttgagttcagaagttcaagaccagcctggacaacatggcaaaacctcatctctaaataaatatttttaaaaattagccaagtattgtggcatgcgcctgtagccctggctactcaggaggctgaggtaagaggatcgcttgagcccaggagatcgaagctgcagtgagctgagattgtgccaccgcactccagcctgggcgacacagtgagaccctgtctcaaagaagaagaaagaaaatcagttaaaaatgagtgggttacttctaaatggcccttcaacaactggttatccaatggaagaaagcgaaattgtattttaaaaatgttatgcaagaaaacctctagaatccgtatataatctagggtcttgaccaagactagatgcaacagaaaattatgtatgtttgtttatataaacagtaacttttacaagaaaaaagatgtcacacttgctggtaggcaaaggatattttgtaggggaaaattctgaatagtgtaaactgctaaaaattgaaaaatggacaaaggatatgaatacgcaattcctatgaaagcaaatccaaatggcggacatgaaaagctgcctattcaattaaggtaacatcagtctatatttatcagaccaactaaacaaaaaaatagtaacaccagctacaaatgggaaacaagaaaacagtctcacatgctgcaggaagaagtgtgcagtaagagactttttagaaaactggcaatatctatttaaatgaaaagtacacacgcttttacacagaaacctcacgtttgggaatataccccataggagtgaaactattaattcattgtgatatttgtacaagatatagcaacactgtttgttatgagaaaaattataaatcaaatacacactcatcagtaatgcaatggtttaactgcagttcatcaacactatggaacatcaggtaaccattcaaaagaatgaaatgaagctacgtcagttgatcgagagggacctctgattattacagagaaaaggaagacggagaaaaataaatataacatgattccatttttatatatgtacataaaagtgtatatagttctaagatattagcacagaaaaacaggatacatattagatcatccacgggatccccagggaggtggacagatgggagggtggcaggatgaaataagtaaagagacagaaaccagagctctcaaaaatgcttcaggttaaaggtgacaggttgaacacagttaagatacccactaaaatcacagtaaaagcacactcctcgagaacacgaatgggtataagagtgaatggactatttaaaatgaaaagtaattgacttagcaggggaaagctagaactggaaggagtagaggcaaagcactaattcacccacagaatccgagagaggctcaacagagaggggcaacagcagagaaaacacagatactccactcataatgtaaaaacaaaatatcaaacaagatcaagagcagaaagggctcgtagctaatctctaaaaatagacaagaaagattagcagataaagtagaggaagtctcagaaagaacagagagacaaggaaacaaagaacagaaggggagaaaggatataagacagaaattactctctgacatgcatgagaatcatccaggaggccccacctccagagctggattcagtgaggctgggctggggcccccgaacctgcacatcctaacaagctcccaggtgacactgctgcttctagtctcaggtccacactgtgagatcctgaatctcaggggttttagtgcaaacacagaggaaacagaggggcagaacttgcaaaagaatgaatacaaaacacatttctcagacggaaggtcacgatgctccaggttgaaagggctcatcaagggaggaaagcaatcaacaaaaagacctccactgaggtgtagttctgtgaaatgtccaaatatcaataaagagaagatcctacaaacttctagtgaggagtaaaagggttccaacaaaggaacaagaatctgaatgagtatagacaaaggaacgctgatccagtttatagggtaaagatactttgctggctgctgagagggaactggatgggaggagacagccaggcctgcagtggtacaggcaagtgatatgtggctcaagatagggctggtaaacctaagagtggatctgagagaatttttaggagaaaacagaactcgatgatgctttaggtttaatctggcagtactgaggccaatgtacacaaacggtaacatcactcagcaaggagcttgtaggatggcggggtttaggagctggacaagtttgacaaagtaagagctttgtaattccattctgagacatccaaggagaaaaatgctgaacaggcatttggatatttgggtctgcagctcaggaagtatggactataggtgtaaacttaaatgcttagcctatacacggccttacttgtaagatagtccacagtctaccaaaaaacatgcactgatttcatgaaacggtagcttccaaaagataaggtaacttccaaaattggtgtacctttggaaaatattttcatttgtatttctctcaagtgcttgaaacagctctactgagcactccacaaatccagtgtgtgcaaattacaatgctacctgcctcccaggagctctcaacaagatgcaaagatgtggattccactggtctgctttccctttggggaagccaatcaccaagtcccaagactacatattaaatccctagtgttaccaagggacaggatttgatacgattttgaaaacacgtttctgtccctgcagctatgtgaaatcattttcacatactggacatcaatagcttcagattgctagactccaccctgtctctccacttcctgtacacaaagtatttcttcacctgaatccgagaccgtgccagatacacattggatttccattcagttttcatcttccggtactgcgatgacttggagtgaacaaactgtttactataaggtgcgttcagttctccagtgactgtgctctgaaatgactttgaggtgctggtgctgtttaaggtgtgaggcctgcagacaatggcatatcaacaggaaaaaaatacaaggaaaactgaagatacctctgagtaatgcccaaaaccaggttaattcagattcttactgacagaaacatacatggaaagctgcctagcagagacacacggcgagttctcttatgtagttgggcacatacacagccagacagcagggtttgtaagcagcagacaaatcaagcacaggaaaccactaatacgcctagaaaccctgggctgtactatgtgaagttaaaacaaaataccttaacacaaacctcttgacatgggcactcattttaggttcagaacgggcacaacctgtggggttaacggcaagaggaagttccatgagaggatttcggccgtatcggaaggtataattttcacatgcctcaaccccaggaagctgaaaagaagcaaagcagacacaaagtcaccccatctgatggagactacagacaatctcaagctggtcaaaggatggcccacgacagaaataactcatcagcgttttccccgataataaaatggtcttctagcttatgttaacactattggcctgcaggtagatctacttaaatatgagtatgcaaattcagtttcaaagccaaacttaggtaaaccctgccaaatgctccttgaagaaaaagattagcccatgcaacaaacactggctgaccaatatacacgcttgtgtgatttcagggcctgactgaaacacacaatacccacaaacacagggcatgtaatgattcgcattgagttctttcccctgtattaatgccaacttttatatctctgtctggaattttacaattaaaaacagttaaaaaatcatctatatggtttctttcttgatcgtttctcactcctttcaatttgactctgatgtgatgaggttatcgctctccatgtcctgggagcataaagcataggtgttaactcaagctttactcaaagtcatttacatgttaaaggtcttttctggaatacattgcttgtgaaatttatttctctgtagtcataaaagataagtatcatttaggcagggcgattccaaagaaaacaattaggcacattactcagtggcttttggggtttcctctgcctgtccaaagaaaacacaccaatgatatttttattcttgaaaacaatgccttagaatcatacaattttctaaaactattgtgtagatatggttcagttagactcactgacaaacaggcttgtaatcttttaagcaaagaaatgtcaagagaggacagaaatcagtgctgctgcgatctactgccctctagtgacttcatcctaggaagagggcaggagagtggccataaatacccaagtgtcaggaaatgggcacactgacattctgaggtgggagaaacttcagaaaggcaagggaagaggagagtgtcctcacccatccagcacacccagaagatgtgacaagcctggtgtccttcacccctgcttgcctccagcctggaagagaacctgaagttggttaactacctcaactgggtgaataccaacacggctgagctctcccgattaatcaccaatgccttattcctctaagagaaacgggttaatgcacaggctcagtcactttctgaagagtgccacaaatgttacagcatgtgttcaagtggtcacactgaatcaggaaagcaattccaatctcaaagcctgaccaagacactcactgattccgctatgcgtgccactgcagagacggtcaggccaaacagatcctctccttttaaatacgctgggaaaagctggagcatttcagacttttttctcacacatgccacaggctccaaaatcttatcccagacacctacacagggacaaaaacataatttttataggaaataggatacagtataaaaaacaagagcaaaatgaagaataaccactcacaaggatttactaatttccaaataaatcctgttgggcaataatctaataaatctgtttggtaataatctaatgaacctgtttattaaatggcagcaattttttttaaagacctaaattttggggaaaataatagattaaggacattaaagtgaaaaaacttaatgtaactgaaattcatgcaaacagttcatttactttcatagtggccatataacataccagattttaaaatgattagtctaattggtaatgtctatagctatgttcctttcccctcagatttaaattaaaatgttaaattgatattttctttggaattatctttagagtattttcagactttttttttttaagtgctaaacttaagaaagcagctccacatacttttgtttgtgtactttctacataagcaaaagtgacaatctagacttaaccatggaggtccaaactaagtgtttaatttccatctctaaacttacgtaatatctgatgttcctatacattgtcttatgacaatgtatacagtatgatttagatgtcattcctgccttctagaaactgactttaagaaaaagggggtccctgccaggtacggtggctcacacctgtaatcccagcactttgggtggctgaggcaggtggatcacctgaggtcaggagtttgagcccagcctggccaacatgctgaaaccctaaaatactaaaaatacaaaattaaaaactactaaaaatataaaaattagccgggcatggtagcgcaagcctgtaatcccagctactcgggaggctgaggcaggagaatcacttgaacccaggaggcggaggttgcagggaactgagatcgcgccattgcagtccagcctgtgcaacaaaagagaaactccgtctcaaaaaaaaaaaaaaaaaaaaagaaaaagaaaaagaaaaaggaggtccccaatgcaaatgacaggcaacctttatctacaaatcattctcggatttacctcaccaactcgtatgttcaaagatatattgattatgaaagtgtttagacaactgtatagcaaagagagcaaggtgtgagaacacaaacattggcatttgtaaatgaaaaatacacattataaaatataaaactaacatgagacaaacatggaaaattgacaaaatacattcattagcctgacatcagagtaagtagcactgcacagcatgtgaacggcagacgttacctttaggtgagatgtcacttagaaccaggtcttcatggccttgttccacaatcctgatgacaaacactgggcgcccatccttctcctcaatggagcacaggtagcggcagcgcctattggcatagcgagtgctccagtacagccggctggcttcatagcccacagggaagagtgctttaggagaatggaatgcttgcatctgctgtggaagcagctgaccaattgtgtggaagatgaggctacccacgcgaaaggtatggtcccgttctcctcgttgcacgatgctagcaatctgtcgcacctcatcacgctgaacatagaccctcctgaagactgcaaagtaacttaattcttgctcatgaattccctttggtttgtgcatggggcaaagcatagttttgtccttaaaaaacatgcattgtgctttaatggcgcaagtgaagtgataaatgttggtgcatcgaaatctgtggcatccactagtggcacccgtcttgtgacagaagacacatttcatttgtaggcctctcctcagagctagctccacatttattaaggcaccagcctgagtctcatagacctccgtggaccacagagcgcagttcaagtggacccacagatccaagtcaaggttgagtagccttgctggtccatctgtcaatccatcaccttcttcatgacaaaagcaacatttccgatagtctttgggcacaggatcaggtttaagggaagtgcccaatttctttagaaattcatctatttcatcctcacaaggtggtttaaatgtccccttagggattacaatatgaatgctccacttcttccatttcattcctctccattttttattgagcggcctgcaatcttcaaacccaccatggacagctcttagccgaggcttcagcttgactgtcaccttcagctcatctggcttggcctcgacttgggctgcttcaaaagcaggagggaaggcgatgggtggtgaggcagggggagaagctttctctgggagctgggggagacagtgcacatccaaagtggagatgttgttgctgtactgatgaaatgctttggaaggcgtttctctcataggtgattgtggcaatgaaggaatggattcctgggcaacataaagaaaccatgacaaagaaaaataattcacaagcccggaaagcaattcttgttaagacaagaagctgagcagtatgactgaagaggatgggtgacctgaggggcagagggagagtcagcagtaagtgctgggggctcatgcaccgcagaagctgaccatgctctaaggtgcacagggatagagagcgggtgatggcagctgtgccgcgtcctttcgaggccttttccacaaagccataattctggagaatattctgctcttacactttctgggacaatcccctttctaactatattaaaaccagaaaaagaaaaaacacacacacactcacaatgctgtcagaagagctaatataatttgtacaatggaacagtgttttttgtttaaccaaataagaacgctgcagcatcgtttcttgagagcttatctccactctaaaattcacatctgttaatctcagccttaatcaattggtgtaaatgttacagaaagggaaggagcccctgtcaacaaatgaatcatactaacttttctctgaggcttctcagctctgatccggctgctgaaacagttgagctgaggggaaatctccaatagcttatttactttatggtacagagtatcataaactaataaacaccaacccacaggctgccctcttttcacatgccccaatcctgacaaggtatctgaaaaaagacatgccttataccaaatcaggcagggactgcacaccaacttaaactatctggtgaaaaaaaaaatccttcttgcatttaggctgatgtattttaagatctaaatttatttgtcatctagcctagattttattacaggcatactacaaacaactacctgttaaaaataagtcttcagaatgttcttctgtgaaagacataccagagcaataacctggatggaggaatgactggcagtattactgtacaggaaaagcttccttcaaaacatgattataaacatatcatttgtatcaaccattagttggacacactcaaattacataaaatcaagtaaagcagacctctttcaccatactgtgagcaaagtgttttctcttaaaatgcacaaatagtcttaaattttatctttaaacaggttttcctattggggtaacatcaataaaaatgattttaaaatattaagatatttacggccgggcgcagtggctcacacctgtaatcccagcactttgagaggctgaggtgggcggatcacgaggtcaggagtttgagaccagcctggccaacatggtgaaaccccatctctactaaactacaaaaattagctgggcgtggtggcacgcacctgtaatcccagctactcaggaggctaaggcaggagaattgcttgaattgggaggcagagtctgcagtgagccaagaggtgccaatgcccttcagcctgtgggaccagaatgagactccatctcaaaaaaaaattaaactggtaaaattaaagattttaatattagtgttctgtttactgaacttttaaaacataactctgcccacttctgtcaaataactaagttgaaagagtagcacgactcaaggctccctacaccctctcctcctctgccgggtcagcacctgctttggattccccacacagagctccatgaaggcagggacacatctttattcactcccatatgcccagaacacagaagtcactcgttacacattgttatcagctgagattatcctaatctcaccttgttttctgagtttttcgcttgtgcagttgatgaataaagaataaagcagttattactacagaagacaatgtccttctctaccctcttggtgctttctcgggaatcctgaaaagcaaagagaaatgtgtgggaatctcaacaagtcaaaatttaataaaaacaggatctatacattatttttatgttatattcaaaagtgacagtggttctttatcttaatagtagaaaggaaactatgttccaatatttagcatgtgataatttagctagggaaaaaatacatgtataaaaccaaactatgtggtccacggttcactctatttaaaaatacgtagtcctcataatattccctttaacagcctgttgtagctctttggtgttcagcccaagcacatctgatatacgctggtgccatcaccaggaacatgtgtccatcacaccaccataagtggtgtctctctctgatgttggaagagacactgccaaggacattttcgctggaggtaggaggtggggtcataaaaggagtagcaaagtaccttgttcaaaagggtcagatctttgaaagatttccgcacaccacttccaagaataaccactttacaatgacaacaccactgtggtctgagtgctgcgctttctgcaataccatgactagaatccttatatccagaaagacctaaaggcaatcaacttttgttagtaattaaaactgactgatgacacaaggtggcacatggtgaaaaattatgcagtatcaactcattacaacatggttcattaacattattctttaattaataaaaaaaatttatcttctaagcaatggttacagagtcgattatctgacactagggcaaaaataaagaaacatgcctattctcaaatagctgggaaagcaatggcagtataaaagaagaatctaataaaactaagtcaccaagagagattactattcagtctaagtacaaagtaagacagagagggaaacagatattacttttgcttgcaggttaagatggtaaaaaaacattttatgaaagatacaatgacatatgtataagagtcttaaataagtgtgacttgcagagtcagaaatgaggaaagagccaaggccaaggataagaaggtaaataaggactcaggaattagaaagcatcattcaggtgcagtgtgaaggcaaaaaggagcagggaaaaagtgacagaacagctagaagccaagaggaggaagccagggcctggactgagcacgcctgtaagattgccagtgaggcaggaaggaaagcgacatcatggtcggtctaaggaagttgttccattctcagagatggggggcatgaacacctctgtgggaagagaagggccctatagagctggtgcagaggtaaaacaagaggtaggtgaggatggaaagcagaggagaacaggaaacagaacccacgtcaggtcaccagccccatctgtaccaggtggcccaggtgcagcgggatgggggttgggagacaggaagaacaaaagctgctcaagggcaagcccgtcacaggcttcttctggcagcctgcacagatggctggcactcacatagcccctggtgacagcatgacagaatacacaggccaaagcactagaggtcaaaatcacagcacagaaaacagaacacccacacatggtaagttcaccaaggactatacgccagcatgttacctgtccgttgttaaaagataatcagtatctcaaagagtaagcttaacttttgaatcaggaatggatttggggttaacaaaaagctcactagctcaccattgcttgttggaggaaatggtacattaggctgcttcagccggtaagagctcactaatctgggagggtttgcagatcctggcggaggcccacggagaagtaaatgctgtcgatactccaaacccgggttgattctgtggctactgaccaaacccatggatgggacatctggagcactgctaacctcatagctgttagggattcggacgtgaagaaggtcggaaaatgcagccacaacactgctaatgttctaaaaccaaatgcaaatgctgtattattcacccagaaggcaacagtgaaccactgaagaaaaatacacacttaggataaatcctctttgcatgatacatagattctaagaaaatccaacaaattttatttagacttaaagaacctcaggaaaaaaattagctctaacgaactaatatccaaaaaaagaaatttataaacagaaatcctcataaagggattccaattaacattaaatatctagtaacacattaaactattttagatattgtaacatctgacagaccccgtcagttcctacaggtggtcagaaagcttacttccaggggcttccctccagctctgacacaacccgtaagaacagacaaaggtcttgctactgctgtattttgttgataaccaaaatatcacatcattggacttctagtttggtctctactgaaatgtcttcacagaattcagagttaaaaaaataaaaaatcctcaggaaattacttatgtttgatataagcagatgctacttgaagaacatttctattgcttctgcaaaactattactgttgataaagttctttttcattgcttaattttcttctctgttaacagttacaaagaagttttttctgagatggacatgatggctcacacatgtagtcccagctactgaggaggctaaagcagaaggattacttgagcccagtaagtttgaggctgcagtgagctatgactgtgccactgcactccagcctgggcaacagaaggagactgtgtctctattaaaaaaaaaaaaaaaaaaagagttctctaaagtatacatcctttaataagaaaatgtgagctctaatttccctttttacttgacgtaggctgagaccaattcaatgacaaacgatggcactcaaaggcagctgagaggtctgcagtgagcatcagctctgctctctgaccctttatcctcagtgatcctgtttgtgtgtgttttatggtagacacctgacccatctttgaaaattggggacatactgtttaacattaagaagtcatttaatcttttacctcagcagctgtaggatgcagagtaattgctacagatataagacctgatctgggaccatttggggaaggaccaaaaggtgacgcaaaatataaagtgcctggctcagttttgatgtcattccttcttgattctgaacctttaaaaagagagaaaaaaaagaggaaaatagtgttaatggattttcaaaatcaaaatatttacattagtaaattggcgtagtgtaaagggaaataataaggttaagtgttgttcttacttttcccagcagtgctaggaagaattggaatgatgggggacggcaccggttctggaggctcctccttgaccaatgacagatctggatacctgctcacttctaccccaaccacactctcaggagaggatgagggaacaaaactgtcaggagtatctcgatcaccacagtgatcctgtatcctgaaaaaacataaacacacacatcaaagtctgcaaatccaccactgggggcttcctgtaccaaccctgctgacatctgtgaatacagctgtaaggatactctgggcagcacctatacgatgagcagcaaatgaatcagctcagagccacactgggaaaaaaatacaagaacaatatttagttacaaaataatttaaatggtatgtttccttttaacgaaagcttcagcaccaaagtttgaagacctgccaaagaggaagatgttctgattagcatgtaacatagagagcatgaaagcaccttttcaaaatcccagatcgttgagcctagggcagcactcctgcagcttgaaaaggaaagagctgctggttggatttaacaataaaaaaggaaaactttaaaaagacaaaaaaaaaaggaaagagaagtccaacacatatgcaatggtcacacctgcattcacctgactgggaaaacagctgtcctactgctgctctttacactggcaagatgggagaaaacttagccattgacttgatcggcccttatttttcttaactgataaagtgaggtgagaaaaacaaaagactggtcccttctgttgagttcaagtttgagtctaccaggccaattgtgaggtctcagactaagttccacaaccctgtggaactgctgtctcccactcctcacgcagagaagtagctgtcatgcaggagacccaagaaaggctggcctactgaggtacagtagaaagaggacctggatcctcaattgggacagattattctccacttcggtccaaagtttccccattaataaagtaagggacttaggttaaataaatgtctcatcaaatagagggtagtgggcagattttccaaagaagagataattatttgatgaagttgtaagaaccctctggatctaaagagttggctagcgatcatctactaagggaacttgattctccccaattagaatcttacagttaaagaactgacacaaagacatcaaaccccagacagttcttaaactctcttccacgacggcgttctctgatatagcaacttctgctctttcattttagacatctacaaacaacaataaacccaataaatcacattaataccctttaaaggacaatgatttctgaaatatgttgcatggagattttccactaccttcatgtctattagattatttaattagattaaataatctaatacttaactgtctattagattatttaactctctatatgatgtaggcttaaaaaaatgcaaactaattatgtttaatggtaacaatgtcttataaactttaaatcctgaagattattcaccaaattgtactcttcaaatgtttttacatgctattcctaaagacattatgccacatacatacatttattttttttaaaagaagaaataactaagaattatttgagaaaaaaataacctgtaccttaattcttcctgattgttatgaggtggtgttgggagggaggctggcacatcaactgtcttggggccctgagcaagagctcgggccaacaagtcgtcctggggtctgaagggcagctgaaatggtttaggtcctagagttttggtaactggaaaagcaaaaacacaaaaccataaatacattcagtcaatattgataaatgggtagaactttacaattctattgccatttcacaatacacaactggcagaggcacatttctccgaggtgtgaaatttggaggctataatcataccttcatggctcactaacactccggcttttccagcaagttcttcagttgttgcaaaaccattggccatcttctgacaagccataggaggtggtgtaggaggaagagaggcagggggtgttggaggattacttaaattattctgctgcaggagaccaaaaaatttaaattatatgctactgagcgaatatgcaatgaccttgctaaaacgtagttctgtgaattttttgcacatagaagcaaggctacagaaatgtaatcaagatgtatcttgcacaccaagaaaacaatacctacaaggccaggaggcttcttagtggaacagatactcgtgattttatggacataccaacttgcttactttacccagcttgactacttaagctctgaaattaagaagctaatttcctttctacctgattttatttatgcaattcttcaagtttcgtggttatagctagtgaaggataactttaaaatgcaatcaagaaattgcaaaatattatcaaaatatcctttaagttctcattaagatatgccctagttctatgaaaaacttaagaatttctggtcttaaacttgtaatacaactcacatccgagatatgagaatctggattgactaagacctttaaaagaagcaacagtactaatgctactactaaagtaactaaatcattaatgtagttcctcttcagacacctctcccagcttaacagttatcaccaatttgtcatttactgattagtctctcaaggagagacttggaatctaccaataacaccatgcaaatcaagtgcaaagtcaaattacaaattttgcaaagataaagaatttcatgaggatgataaaataaggttggagaacagcttatgagttaagatagttttttttttttctttttggagacagagacttgctctgtcacccaagctagaggtagagggcaatggcacaatcatgctcactgcagccttgacctcagggtgtggtggtgcatgcctgtagtcccagctacttggtaggttgaggcactagaattgcttgaatttgggaggcagagattgcagggagctgagattgcaccactgcaatctggcctgggtgacagagcgagaccctgtctcaaaaaaaaaaaaaaaacctacaatagtctaggaattacttgtaattaatacctaaattattagatatacttaaaattgtttaatttcatttttcaaggtaaactactactttttttaaatccccaccatttacaatgatttttgaattcattttaagtgttaataaaggttataaggaaataaggatttccactaccatggaagtacataatagatatttcttgcaatttgtattcttacctataaaaacaacttcaaatgtttatgctagaaatacttcaccaggtaaaattttaaccctgtagctgaacttaagttttaataaaacttggaagagtagatgtaaactaaatacaaaaataagacaagctctatcaattctgacatgttacccaaagatgaagcaagacaacaccttggcagagaaacataccttgtagatcaactgagaatagtagtccgaaaccccttccagggtagcactgccaaaagttcctagaagtcgattcccactattaaattggccactgccataaggaagaaagtgcgcaaagttcactccaatgattggttccattagagggagcagagagagctgctattaaaaaacacatttaagagtaatgtacatgataaaaggaactcagtgtagctcaactttctaagacccgaagcaactttgttgaataaggcttcagaaaaatgagacttaaaattttcaagtatcaaaatgctggagtaagtgagagagactacagacctttgagacttaaaaataagctctgtactaaatgaatgctgccaggcatctaacaagaaaaacatatttcttatctatgctcagcaaaaactggggcatcaactgaggctgggtaccaccaacagcactgttagcaactgtctcccaccttctgtaacaaccacaaaggtgtagaacagaattcacaatgtgtttctttggattcagagtcacaacaaagtactgaggacagatttttttcttggtactgaggctactccttatgaacataagaaaatcttgactatcacctatcaatccatttgtattaccgtaaatttcagatgccaataggatacggtgcaattctgcttggaaaaagtctactaggttccttgtccagatgtcttttagcatttgatctctcgtgtccttgaattgtttgttttttttttgtttttttttttgagacacagtctcattctgtcacccaggctggagtgcagtggcacaatctcggctcactgcaacctctgccatccaggctcaagcaattctcgtgcctcagcctcccaagtagctggaattacaggcgtgtaccaccacgcccagtaaatgtttgtatttttcgtagagatgaggttttgccatgttggctaagctcatctagaactcatgcctcaagtgatccacctgcctcagcctcccaaagtgctgggattacaggcatgagccactgcccccagcctatatccttgacttttaaaagaggctgctctaaatgactcaccctcacctgtttcaagtgggtaaacgtgtcagtgctagagtacatagcttgtttctcctcttcgtcctttttccttttctttgagcgaggtgctgctttctcacccgtcctctgagtccgtttgcttcgctgtttcttggtttcacttcctccatctgtttttggcaactggttgccacatccaaaaccaccttgcatttgagcccccaaagtttgctaatgtaattggaaagggtaaaaaataagtgaacaatttgcatatttggtttttagttcatgcagtgccaagctatgacgcgtcatcctaacatggcactaaaaggtattaaataagtagggaagatagagtggtgtcaatgctggttttccaaaaacaccatccttttcttcaaacgttattctcgagtatggaaatcagtaagctgcgaagcttgaggaaagagcagaactcattagtaaggccacagccctttctggcaaagcattacccctcatgctgacctccctggggctggggaaccccttattcctgcttacttactgcagaagggaaggaaatgcttgtagatggctataggagcctctgcatagtggtcttggtgagttatttttggttccccttaggaactagtgaaatatgaggtgtgctgaaacaattcacaggctccagaaaagctttacagcctatgcatcttaggtgagagaacagatagcaccagacaacaataaaaagaaaaaacactggttcttcaaattagttcacaaccgtatttgactgaaaaataatggccacatacttaaagtcaatgggagagaacgtagatgataacaaataaaccttttctttatttttatcattacaaagtgagaataagccaagccctgaaaaggcctttaagggtagtcctatcagtaccttaaaacacaggaatattttcaggctccattatttctaaatttaacagcagtactctgctatagacgattatagtagctgaacttactgtaatgaattctgcattgaatctctgacggttctgaaaattagtttccagttatattctaaatagtttagcgcatggatggcaacatttttatgtaaagagccagatgataaatattgtaagcctctgtaggccatacagcccctggcataattactcaactctgcccttgtacttcaaaagcagccataaacaattcataaatcaatgagcttggctgcgttcaaataaaacttttaaaattcacggacaaatttgaattttgtataatttttatgtgtcacaaaatactactcttccttagattttttttcaaccatttaaaaatgtaaaagccatttttagctcatggagggaggcgaaagcaggcttagactgctcatctccaggctagttctgtggctctcaaggggtctccagggcggcagcagcatctagagctggtctagaaatgcagattatctggtcccacccagacctgcagaatcagaaataccggggctggagcccagcaatcttggtttaacaagccctcctggtgctcctcacactttagctttgagaatcacctgcctagagcagtacttctccccttcagatgctcaggaatcacctggggatcttcctaagtctacattctgagaagcaggtgtgtggcgggagattctgcatgtgttacaaagctcccacctgatgtggatgctgcggatccccaaggactgcactctgagtggcaagaacctaaaaattaattatatatatatatttatatatttatatttatatatatatttatatatagatgtatatatttatatatatttaaatcactatatatttatttaaatcacactttaatttggggggaggggctactttttaaacttgacgtggttgttccccatgccattaaacattcttacacccacaaattttaatataaacatgctcaaaatgtagtctacgtccttcaaggagctatttaaataatgttaagtggtacaacagaaatcgctatgtgagaacacgagcatcaacacatatttgagattgggagaggtgagaaaggtatctggaaaaagatgactcaagaactgcatttcaaaagataaaaatatattgtccagacgtatataagaagggagaacagaacaggcagaagcagcagcatgtggtatacatagaagggtaaaaagacagaaggctgcaagttattcagtactcctcagggtataagatgtcttggagaaagtggatggagactgtgctggagagttgcctatatttactggtgacaactgtaaaagcataaccagtaaaatttacaaaaattacacaaatctatcaagtcaacactcaatctctactgaatggtcaaagacaagaaaaaaagcaacacttgcaaaaagatgagcttcattaacaatcttaaaatgaaaaaactggacaactaaatataccactcaacccttaattaaaatatgaaaatgaaatccaatttgagaagctctctagggacagctttatgaatgcactggtaatggcactgcaccttctgaaagataaacaggcaagagctattaagcagaccaattcccatgactcaaactccagttttggaactatcttaatgaagttaactgaaataaaggggacagattcttgtaaaggtatatttacaagttagctcttcatgtaaatgaaaaaaaaagcaaattaaatgttaataacttaaaactgatagaaaattgatacatggaaaactacaaaacagtatctacatgtaacattacattaagtatcaatacaacactgtaaccacacaatagcttcccagtgtggtatccctaagagtgccaagggtattaataggggtgcatgggctatcctctgcattttaaagaggttaatggaaattaatcacttatttacaataaagtacatagacatttacttactttgctttagtcatatcaactcaatgtggtaataaccagttgctacacatcacgttatatatgaaatgcaatacatgcctttgctttttaaaaaatagtaaacaaattattatttaatatagtttagatataagtaaaaacatgggttccagagaggtagaaatgacaaaataaaaaatggtcctttagaataaaaaggttgtagaataatgtggaaatacagttgctggtactaatctgctgtaagtataatttaaaacaaaagaaaaaagttgtcgtttttatgatttacacttaccagtccttcagctgggttctgcttctcaactagtttattatcctttgtacagtcatcttctgaacaaatactgccctcaggtttttgattcaaaagagaagatgactttttatttttcaacaagtgtttcagaagttcattccctgagtctcctttggcagcaggggccccagcagaatggggaggactctgtgctgaggagacaggacaggctacagcgtttccttctaccttactaccattctgttcctccaatttaggctcctcttggcctgggcaggactctgtctcagccttttccagttttatctcttctgttttggcaggggtttccatggagagcttgtctacttctgaatttgcatacgtctgttgatttggagttgcttgtgagaaatcactattgggcagtttgttctctaattctgtacatagctggcctgctgccatattgggagtggatgggccgactggttccaccgactcttggtcggcttgttgaggaagctcactgggtgtgctcactgcaggagtagaggtagtttctgagatgcctggagtcggtggggcagttatatctgaatggggagttgatggagccttggtggattctgcatcatcatctcttttcttctttcttgttcttttctttttccctttttcctctgggattatatcagaatacaactgaatgagcgattgggttgatcccggataactgtgtccatgggttatagtagaatcttggccacatgggagactgctattagctactggaggtgctgctggtaaagcaggtgtaaaagaaggcctcactggggactgctggaagctggtcccagaaagatttccatgtccctgcttcacagaagaaaaatttgggcttccaacagggattgatggtgaatcaggaacaaatgaaggagggcctacctgccttcgctcattagtctgcatgaaagtttgggtggagggtgaattaattgatccttgttgtatattctgctgctgtaaaacctgccccatttgctgttggtgttgtggagactgctgaaggggtcctagaggttgcataaaatcacaaggtaagtcggaactgtagaagggaatctgggacacagatgtcctactactacttatctcagagcccaccataccatgctgctccatttccatcctctgctgcaaagctctttgtctatctacctcctgcatgagttggatccgttgtctctcttgctgttctcgtaaacgttccttacgttcccgttcttgaaaactttcactaaagggattgttgtcatcaaattctacccgaggtggtggtccactctgtggatttgcatttgagactgtccctggggctggtgtacaagtttttattggtaactgggcaattgggggctgaattctaggaggattgaggggcaggtgggcaggagcactgttgggttgccatccaggtaaactgggcattctaacagggctagtatggccagaaataactgttgtgtgctgctggtgctgaagctgctgtggcaccatgggaaaggtgggttggctcatggtgggtggagtggcacctggaattaggggtggctggggctggacactgggcatcatggtaggtggggccattgcacattgctgctgctgtttgatccgataatcttcaatcaattcagcatgttctttctgttgtttacgaatctggaataacaaaatgcatcattactcatttctatacagcataggtactgaagtaaaacactggctgatgactgtggttgaggttacacagagggcagtttggccctgcagaagcaaacatattttgcttgggtaactgcaaaagtcacaaaaaaattgaattgataagccttaactaacaactgtcaatctctttaacaacaggatttttataaagttatctgtaaaagtgcttcacatatgaaatatcaaaaacggtttagtaaaatattaaaatcttatggtgaaactcatatatactatttatactatacataaaaaatatacaataaaaaaggttacacaagcagctaattttgatgtcctagaaattacaatatacaatgttagaataacagacttaactcaaacttgaaccatttaaatgttaagatttcatttcttaaatatataaattgtacaacattttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccactgcgcccggcctgtacaacattttaagacaagatgaattaccagcacgaatatcacaccccccacccagattaaaaagactaaatttgttgaacactttcaatttaatggctaacactcaaattataatttctgaaatctatacaagctccgaggaagtattttgaatagtctgtaaatagactcttaatataatggctaatatcaattaattaattcattccaaaaacctttgtgtcccaatgtgctcaatactacaggccagatatcaatcaagacgcaaactatgttctggagaacctcaccatctcattcagcaagctagggaaagaaggaatgcaaaaggatgtgtatatctctcaacatcattcaatttttagataaatattaatatactaaactcaggagttctaatagtttttcaaagtattttcttgggttccccaggtagactaatactttctgcaaataatcgtgtttcatctcttcttcaacagttgtgtaactcctattttcttatttttcctggccagtttactggttagaactgagaaattaccattggttggtgaagtagtaagaaagtacagaaagcacctacaacactatgtgggatatataaggtggtcatccatgtctttcccatgatattttataatactttttaaaacattaccatcaactgcttatcttaatatgattatactggatctttggcaactatgtaatagatgatgtatcccatttttcaagtattagcttctaaataggatttgatctatggatatgcaaaaattaggccctcatcaaaagaccttgtacaaatatgccagatggcaatgaaagtgctaaaaaaaatatactttattaaacatatctttacaagaatattaacctacagtaaacatgaacccagagagtagatttaaagagaaaagaaacctttcattctggaataatcctagttttaaacaactggaattatgatcaccttattgttggtacattattgtggtagctgtggtttgaagataagacacgtgagtccaaatccctaatctaatagttataagcaaacatgtacagtgggggtattttttgggattttttttgttttgttttgtttttgagacaagagttttgctcttgttgcccaggctggagtgcaatggtgcaatctcagctcactgcagcctccacctcccggattcaagcaattctcctgcctcaacctcccaagcagctgggattacaggcacctgccaccatgcctggctaacttcttgtatttttagtagagacgagttttgccacgttggccagctggtctcgaactcctggcctcaggtgatccgcctgtcttggcttcccaaagtgctgggattacaggcgtgagccaccgtgcctggccacgtgtacacagtgtttataacctttacaatgaatcagtttgtaaaatggggataatactaactccttcagaaagatgtagataagacaacgtaaatggaagtgcttcctacagtgttcattatagagcactcacattttttttttttttttttgagatggagtctcactttgtcgccaggctggagtacagtggcgcaagctcggctcaccacaacctctgactccttggtgcagggattctcctgcctcagcctcccaaatagctgggattacaggcacacaccaccatacttagctaatttttgtatttttagtagagacggggtttcaccatgttggccaggctggtctcaaactcctgacctcaagtgatccacccacctcggcctcccaaagtgctggaattacaggtatgaaccaccacgcctggcctgaaccttaagtttttaatttacttgggtaaatatacctaggagttggctctgaacccattttgtacactactattgttttattttaaatacaatttttacatgtttcttcttttccagtatattattcagtttaaatattctgataaacttctggtttataatagaagataatggcaaaatgatttcatttttctggaacagtacttcacataagacataccaatgtattttaagaccaaaacattaagaaataataataatatcaactccaagtaaacaaaaatactccctgggcccccaattcttattccaaactaaacccagtatctccccatgagctcggtcctcagttaagtcgaatactctcaatgatgtataacagaaacatggtctttgcagtgatttcttagtgcagaaaaaaataacgtctccaactataccaaagttgaaaatagttcttcgaagtcgaaattatgagactcaatctcttttgtgtcatttatttagtatgtgctgtgaccgtcactttaagtaaaagactggagctgttatggctgcagttactaagaggtctcagagctgtcactttttggcaatgtacttttaatgccatttaatactagtcaaaaaaaatcactagtcaaagtcactaatgaacaacacaccaaaacattctactcattaattgttggtagtttctattttgcaaacctatttattacctgttctagctgtttctgaaccatgctttgctgttcagtaacatgcttgagttgttctgcatcttcctctggaaattcacgcccagctttcttggcagtacgttgtttagctgaaagggccttcttagattttctgtgagcaccaatttgttcttcaagatacttctgctgcatttgaagcagctgttgggtctcctggagccactcttcatactgcttacgctgtgaatcatctgaggaaaaattaaaattcagttgtgttaattttctaaagagtccaacattataagttacacaaatctattttgtaaggaagtagtttcaccatgaccacataataggaaatttgaaaacacaatactaaatattagacgattatgtaatgataaaatatcagattttagaaaaatatttaattgagaaagccagagaatgcacattcttgagatactggttaacttagcacttataaatattacaaatccaatcttggaaaagcagacttatgtaatgaaattctttttttttactaaacaaattctctaacccacaagccaaactacatactaaggtatacatgcattttatgaatacgattttacagattttgaagagacaaagacatatcccattaaggtctagcgcatagactaggaaatcacttcccatgttaattttcctgagtttataagttctttcctatttcttaataatgaaaaaatatcctaaacagagagaaaaggaacccagaatgttttagaatggaataatttaaagtctatgacttataaaggaaatccataagttgaaaacattggtaattattattctgtagttatattttttaaaataaggggagggaatagttaaccaagcaaaacattttctacttttacaactgccagtaattctccccaaatggctatatctcttcattttgtaccaatattctcttctttattctttaagggcactttacttcattgatacccagtccaaggggaaaaaaaaaaagtcatcgtatgtagtgaaattctgaatatacctttttgactcactacaagacaaagaaatgaataaatacatttctaagaaggacattcgctgaaaataacatcaatgataacagaatattgtcatacattaagaatccaaccaaagccaatgggcacaataaagccagaaaaagccagttggtatagttctttacttgtttttaatgcaaatatgtattcaaattatagtaacaattaatgtagggggaatttcaaaaggtcagactttgggtttgttcctaaacccagaagttccagtacatgtatgaacttgaaatctagtctactaaatttgaagggcattttttaagaacaggctttttcacaagatttcagaagttctgcttctggtagaatgagacctaccgcaaggaaagcctttctggtttctggaaccaggagagcagaggtgagcaaaatgaaaaataatggtgaaaaaaaagttagctaaacagtctgaagatttcagaaaggttcagtttggggagaactttaaacactatcctgaaccaccttgggacccctgcaaataactagaaaggattcaggggcaccttgcatacctgacctttacaccatgctgctaacccaacttactgctaagtataatccctttgtttttcccatttagtgtccttgtcacttaggaagacagttcttagagcaaaacgtggtttagttctatagactgtaaagtgcccaatctgtatacaaaaacagcaacaatattgaagagaatggggaagatggtttttctgtattaaaatacttttctgtaactataattcttcatgcacagtgaaaaaagcaatgaaaacacacgccttgaagaagagttgcctaatagggcagtgatgtttaataagacaggagggcacctgggcttgaactggtgtacctacactcacttcaggtttagaacagcacacatagagtgcagacaagcaatccccagaaaacattaacttattagatttatacttactgacaaagcctggaccaaaatttggaggattaggcctagaaatctgatgtgttatactgccatcctaaaataagtaaaatttacaaatatgtttattccacatttcagttaaaggggggaaaaaactttaaaagaaagaaagaaaaaaagaaatggaagaaaaaaccctttaatttcctaagatatcttttaaaggtttttttataaaaagtagagtgaatttagtggtggcaacctaattctgaattcttattactatctctgaactactatactgtctagattttggctgaaaacaattatgcttgaggtaaaggattattcatcagaaatataatacagggcaaatcaattactgctaatactaagcgagagatctatataaaaaatctcactttttgatgaagtttacctggtttcttcttcaatcaaacacaagttccagattgactaaatgccactccacagcatggttatttataacaaaaactaatgtctctaacatgcacaaatataaaagaaaaatacgttaataaaaatattagtcttattttctacacacgcctgtagtcccggctacttgggaggctgaggtggtaggatcgcttgagcccaggtgtttgaggccagcctgggcaacacagcaggatcctgttcccaaaaaaataaaaaaaataaataaaaagtatttaattcgttttattttcaagttaaaagtcttatttcttccaggtgactgaacaagcagttattaatctcacaagtccctgataatcacctaacaaattaatgttgaaaaatgtttatccagttgtcacaagttctccttaacatgagctgtatacaaggtaataattataaacttatactagcagccagaatgtattatgtgcaatcttcacaatactacaaagcagttggtttaacatttgacatattaaaaaacaagaggctaaagaatttgcccaaagttgcacagtaaattcatagtggaactataatttctttaaaaaaactcagctataaaggctatgcttttcccattatatcaaatggcttctgtttcctcttttaataatgagaagaatataattatcagcataataaatctaaagcataactggcagggcaaggaagaaaacaggacatacattatagtaggtagctccctttataaaaaaaaaatcactgacaaaaatactgcatgagttttacttccccagatactgcttgatattatattaaaaatatagcatatctttcaacaaggatgggaagaaaaaaggaaaaaacaaatatagcatattgttttctacttgctgtgtttgtttgtttgagatgaagtctcgctctgtcacccaagctggagtgcagtggcgtgatctcggctcactgcaacctctgcctcccgggttcaagcgattctcctgcctcagtctcccaagtagctgggactataggtgtgcgccaccacgcctgactaatttttgtattttttgtagagacggggtttcactacgttggtcaggctggtctcaaactgctgacttcataatttgcccatctcggcctcccaaagtgctgggattagaggagtgagccaccgtgcccagccattttctagtatttatagaagttttacattttaaatataatgggtttaattctaaaatgcaggacatgaaaatgtccttctggagttaaaaataagtaaataaaaataaaaccaaaagtcctgagcgtgtggttttgccatcaagtgactttttacccgtaagtatataaatccttttcagaaatcacagccaatttttttaaccttaatttgtcttttgtttaaaaagcagtaaagtgtctttttggttacttttggctgtgctgatagataaggctactatttaggttggtgaaaaagtaattgcggtttttgccactggcaaatggcatatggtgaaatccgcatttacttctgcacaaacctagtactactctctagcaggggacttactctaaagcatgagtttgctgggaaacagaaaagcgtgcattctagagggactcattacaggcagtgttacctgaggaatggcctgtggtccaaggttctgtccttcactgttctgtgttccagttaccacctggcccataaaagggaacctgtcaaaacagggtacacaagtatcaagtgatgagcgtttagaaattattaatattaattaaaaactgtattaggtgcttaacagttttctcttccagagaagaacagtggcaatttcttcttcatcaaaacactaaagccctacctttcatgtactgggcagatgtgatcctcactgtaattcgatgaagtgtgctcttagcaccctcatgttacttatgatgaaagtaagattcagagatattccgtaaccttccccacaaggactagtagggctgcaataagaagccagctaggctgactctagaggttttactctattatgtgcctcactccactttacgataaaatgaattcaagacttcagaataaaaataagttgatttagttttataacgaactctaaggaaatgttttctcattccagtctgtgttaaaaactaattgagagcttagttattttatattctaaaacaaaagacatttcccaatttaagaattttcatacattttcatacatttctatatctaatgttaaagcaaatcaaaaatggacgactgaccaagatcagtctgcatggttaaacgtgtttagagaaatgttactcattctaattaaaactataaaaacttcacagaagcattactgcttacatgaaagtatttcctctggcattatcaaatgctttaacgtatcaagatatacatacaattttaaaaatgtattccaaaagctgtatattactatttaagtactattaggatatagaatatgtttttaaattttttactcaggtttttcattgatctgtcaccctacccactgctacaggtctggtctaaatgatcttctaatctgaatatcacacatggtctatcatcctaactcaacatatcacactactctaagaagggactatcacttccatttctaaaaagcagtcagtagaatactaagccatatacctgatacatgactaatgtatctaaccggcagatgcatgatgctaaaagagcatcagatgctgaaaggcctcaaattctgaggtccatatttaaaactaagtgctggtcgggtgcagtggctcatgcctgtaattgcagcactttgggagggggaggcaggtggatcacctgaggtcagaagttcaagaacagcctgaccaacatggtgaaaccctgtctctaccaaaaatacaaaaattagctgcgcatggtggcacgtgcctgtgatccgagctactccagaggctgatgcaggagaatcgcttgaaccttggaggtgaaggctgcagtgagccattgcactctatcctgggcaacaacagcgaaactccgtctcagaaacaaaaaccaaaacaaaactaagtagtaaataaaactcagcatttccttgttttgaatatacatagaaactacaatattattagcaagtaccacaactatcaccaatagaagacagattattttcctatcgagtgttgcaggcacctaatagattagttatgttcatcattactttcaaattatggtttattgctaaatttgttaatactttaaggaacatatatacataaatttaattatattttaataactatatttcaagtataatcatttccttcgtaatgctatgtcttaaattttctgcatataaaacattctgagaatttcaaaggcttcactggaatccaaaaatattcaagacataaaacagttaggaatctctatgatagagaaatagtgttaataaatattgctcaataatgaaaatcattggaaaccactatctctactttgatctcaaaaatgcttcttaaccatgtccaaagtatctcaacaattgaaaagaattatacccttaagaattcaaatttctttgaaatatatacatcttaaattcgtgcaaattttatattcaattctataatcatccacattttttatataaaagtttttcaacaagataactagactaaattgaggctctatgcttactttattgacagaggttctcatatagtaatacacgtaagactcattcatgacgcttgctaaaaatacagacacacaggcaaccatctccagatattcttatttagtaggtctgcagtagagcaaaataatctgcattttaaaaaaattaccccataattctcatggtggtccatgatcaaaatttaagaaacagtgccatgtggttaacaacccttagagggcataatttcaaaaattcagatattgaaataacccctactgtcttctttaatgcgtaatttctgtttttctcctaagagagaaaagacaaactctgtaactccaacttccaactgtcctcttatctattccttgtaactttctttttctgattcaaaaccggtttgggaacattttattttagaactgaatttataattgctttaatcactcagtgtcttaactgaaaaaaatcttagataacatgaacaattctaaaggtatttaaaagagcacagacctaaatactttgacttgagtaatcaggaaatccaatcttccaaatctttttaagatgttttacatttaccatccttgagactaatgctcttaaactggttcttacactaatttcttaaattggtatagcattttgtatctgatcatatcgagctgatgccatgacaacttaaatagtgttgttcattcctagacaagggctttccattttctgtatgttttttctaaaaactagtaatgatttcatgaatgtctagatgcccagtagaaacaagcagccactccacctacctgctcatcaccattggtggcatgcccagattgttttgtgccatcactttatttatacctttaagggccaccattttggctttcattataggatctgtaattgcatcaaaatctagaaaagaaatataaagttacttatttcatagtaattagttcaacgtacactaagaagtaattcaaatattacaagctcttaaattttattatttaataatcattacagatttctgagatggcaaccttatcctgggtttaatcgcatctcagtagtccttaactgaatcatgctttaataccttagtcctgcaggaattaaaacaaaaagtcaagtttaagggagattataagcaataatctaaagcaatgcaattaatttcctttcatccaaacttttgcaatgctaatcagaatggcttctttagtaaatataacatcacaaataagaatttgcaatactaaggaattctactaaattagttatcactcttaaaagaaaaatgcaccaatttcttaagggtataacctctcaataagaagctactacgaaaaaacctatttgcatctaaatgaaaaaaagggagcaaaatgatgaaattggggatatataaaatggaatgtcaattttattatttagaataaggcacactgcttagacacgtgccctttgattgctaattcttattcttagaggcactgaggcattttgactgcattgcttttgttgtttttagaatcagtaaaccattagaaacaagttaaagaggtttatatagcaaaaaatcgccaagcatttgtcatacacaaaaggacagtaagaagctttatttccatcataattttcttaaattcatccttccatgactgaaaacatatggcaacaatggttggaatgtaggaactaagaagacaattagtttctattaaacaattccataaataatagaattgagggaagtttgtaactcagttttgaatctcttaatttacctggaaagaatctaaaactcttcgttgttttcatttttttttttttgagacagagtctcactctgtcccccaggctggagtgcaatggtgcgatctcgcctcactgcaacttccgcctcctgggttcacaccattctcctgcctctgtctcccgaataactgggactacaggcgcacgctgctatgcccagctaattttttgttatttttttttaattattatactttaaattctgggatacttgtgcagaatatgctggttacataggtatacatatgtcatggtggtttgctgcacccatcaacccgtcatctacattaggtatttctcctaatgctatccgtcccctagccccccacccccgacaggttccagtgtgtgatgttcccctccctgtgtccatgtgttctcactgttcaactcccacttatgagtgagaacatgcagtgtatggttttctgttcctgcattagtttgctgagaatgatggtttccagcttcatccatgtcctgtgttgcccaggttggtctggaactcctgagctgaggcaatctgtctgcctcggtctcccaaagtgctaggattacagccgtgagccactgtgcccagccaactgctttcattctaaagctcaaggagggccaagcagggtggctcacgcctgtaatcccagcactttgggaggccaaagcaggcggatcacctgaggtcaggagtttgagaccagcctggccaacatggtgaaaccccgcacctctactaaaaatacaaaaattggccaggcatggtggcacgtgtctgtagtcccagctactcgggaggctgaggcaggagaatcacttgaacccaggaggtggaggttgctgtgagccgagatcgcgccactgcactccatcttgggtgacacagtgagactccgtctcaaaacaaaacaaacaaactcctcaaggaggaatagaaaaactcagtgctttattccaactgtaattctaataataaaatcttataagcatatcgcatgccactctaatacccatagtaatatacgttgagactcaagaaaactcctaccaatattagggaagaacggttctgatcgctgacgaatcatggcttgcatctgtctttgctgctgctgttcttgcctttcttgatccaaaagatcctgtagaagtagaggctgttcttctagaagaaggggcctctctctattctgctgtgctaatgtttgaggaatcattagctgttggggtccagacatgctactggtaccagactgacttgtttgaggcccagtttgagttgcaggttttcctgtccccagactgtggttaactgttgattgacctggaatgagccctgggtttacctgcacaccctgagaaaaaacatggtttaccctagagactactgtcacattagaattcatggcattatccaaaacacggccaggcggtgctatgaaaggaggcaaacttgacacatgattggatggggaggccggcagagttggtggtggtggagaccccgatggcctaatgtctgaattatcagatttctcattagcaagtaaacttgagagaactggagttgatccagttatgccacaagagtttattacatcttgagcaggtagttgagtggatgcctgaatgacatttgcactggggccagcagtttctcgattggttcttttctcaaatagatctggatcacaaggatgcaaagaagtcttttctccatcatttaggtctgagtgagcagaagcctgtgagcaaggagtgtcaacattatctttattctcatcatttttttcagtttcacatttggattccaccttagaatttggagacagtacttccgtttttacctcattggtaacagtggattttttctgtggtgaatgtttatcagagagaaccagagttttgttttcttgttcctttttttttggttcaacagatacacactgattatctaacttatcatcaattggaaggtctagttcctcattaaacatgcttttcttatctcccatgtcaagttctggatctgtatatgcaatgatatcaaactctcctgaccttaagaggtcatccaggttgggatcattagtttccaaattatctaaagtatccaattcaactaccttgccatcctctgtatctaaatttaagttttcaagatcttcatcatctaagtctttgacttcaaccccctcaaggtctttaacatccagttccttcacagaagggtcatcagaatcaagtttttcctctagaccatcagaaggctgggtggttatctgtaaattatcagacgttgtttcagacggtacagatgttgacaaaggagcttctgaaaattcaccacctagtggatggttcagagtcctcatgaccatagaagatgaatggacagaatgaccttgctcttgttgagatggtggcacttgttccaaatctgggtgcacaggtagctgattaggtagaccctggggaggtcgtcgcatggggtctgtgtgtctagggcccggaaagtctggccggggaatgaagtttccatgtctcagattagaagatgcctctacaacgctgccaggtggagcactgaaaggcagccgttgccttccgtcaggagccctatgtctcagttcaatatatgcttggcccagtatgttgtgctgctgaactggcaagctctgtggtgaaaaatgctgaggaagtccaactggattattcatttgtgagttatttaaaggcctaggcatatctacagatactgatcttcttagctgtggagaaactccagatccctgtatttgctgaggaggcacaaggaagcgctcttgactcggcatggtaccatgactacctcctggaaatccaaatcttttaaaaaaaaaaaaaaaaaaaaaaaaaaagcaaataggtattatgttaaatttagagttaagttgaaaaaaagaaaagtcttcaattaaactgtacatacaaaatgttgccaaatactatgacttacaaaagcaaagctatcaccattaaaaagtatttacagtattcatatgcaagtaagattttgctaagaatcctataatgaacaccatatctgagctctaaaggcttaagatttaacagataacaaaaatgaagacaaaggaagaacaaccaagcagatgaaatcaattgttcagagataagaacaatactactggactttttcaggaagagtttcttttatctatatttagggaggttcgatggaggaagctgattcggggatgatgtttgaatgaagataggtcttcatacctattgagggacttacaggcctcagtacatgagactacaaaggcacaggtttgatgatgggatagaataaacttagagaaaaggacaagtaggcctcatctataaagattaagtaaatgtataaattgttggactattttatattgtacttccttctagacaggattacaggcaacttacacagaatacaaagcatagcaagaggcataaattataacaaggtggaagaaaaaagggaaattaagagtaagattacaggcaacttacacaaaatataaaatgcagaaagaggcataaattacaactaaggtagaagaaaaggaaactaaaagaatataacatggaggtagagatataagactaaaagacataaaactaaaaagcatatcttaaagaactatttccttattataactagggcataggtttggctttgactttagccactttgaaaaaggaaacattcttatgattcatcaccactaacttacaaccctatctcaccatggaaagttcctaaagggaaagtcctttcagttcggaaatctctaaaatttattattattattttttaaattgagacagagtctcgttctgtctcccaggctggagtgcagtggcgtgacctcggctcactgcaacctccacctcctgggttcaagtgatccttttgtctcagcctcctgagtagccgcgaatacaggtgcagtgcctgccgccatagccggccaatttttgtatttttactagaggcagggttttaccatgttggccaggttggtctcgaactcctgacctcaagtgatccgcccacctcggcctcccaaagtattgggattacaggcctgagccactgcgcccagcctaaaattaatttagaatgtaaagttaaaaggtagaaatttggagagaggacaagtctcatcacatcgtaggaggctttgcctacgcagaatagctacattttgaggatgtcatatgataaactgcatcattaagggtgcaaggtaatgctaacacagttaatacttaaaaacaaaggtaatgttttcagagtctgtagagttcttagaggaaaaaaatgtctatgacctctcattagcactaaatagcagattatatatatttcaaaggggagaaagaagtagaaagcagtaacagcttcctgattaatactaacttcatttgtctatttcttttaaaaaatttttaaatttgttgaagaggttgggggggggggggggtggtctcactatattgcccaggctggtctcaaactcctagcctcaagcaatcctcctgcctcagctagtagctaggattacaggcacaagccaccacacccagctctgtttccctcttctaatagcaatttaaattcggcaggaaattaaaagcattacctaaatccatgaggtctcatccccatactagcaacatcaggaggatagggtccacgctgatcttttgggaaaacagcatatctaggtcctaaaggaggggcaacaggagacctaatgttcccaggatagggaggtgggggtctggtgaaagcctggttaacattctctggttgccagtgttgaagaggccctggatgaggcactgcgggtgagtcctgtgaccccttctcctgtcgacctgcaatcttcttctgctgttgctgctggagaatgatttcacgtaacttctgccgctaaatgggaagaaacaaaaatcactgggatttgtggtaattaatggctttttaaaggttactggctttttatttttagatatgggatcttgctatgttgcccaggctggcctcaaattcctggactcaagtgatcctcctgtctcagcctctcaagtagctgggattacaagcatgcgccaccgtgcctgacaggttagtggctttttaaatcctgatactttcattatgtggctatggtaatgtttcaaagtttgatgaaataccagttacatttaactattcaatatattaggaaaaataatttgatgatttgggtccttttccttgccagacaactatcacaaaacaaagctttaatatttaaggattcccctgcgaattcgtgaaaactgaaatcagatacagaataaattaaactggtgttaatttcatcaatttcatttttcttttttgcagtatgacaaactctacagaataaaaaaaataaaacattaactcctgtgtagaaattactcagtttgatgaaatgaacagcttcctcaaataatacatttaaaactgagaacatacaatgtgtttacctgtctcaatttctctgtatctgcttgggccatatttacagtattctgtgtatcagttactcctgaagttggcacaggtccaggaagttgggagacaccagagaactgctggccttgggagtgcattggagagtttgaagatgcacagaagctcccctctgatccaggccttggctgatcagcaacatcatgggcagtttgacttgttccaaaagagtcagactgagatcttggagtcattggagactgatcatagggatcacgggcagcagatggggaaacacggctaaatgtgtctgaaagaccaggtccagggggcctaggtgtctgggaacatgtatcaggtggccttaccaacgggccaggtaaagctggtcctcggttttgtgctgcttgcaggaaaggatcctgatttggcatgaggactggtcttgtcattgaggacctagtaaaaccctctgaaatccttggccttggtgttgctggtggctgagagtaagggacagaaattccaggtcttggtgttccaggaggatgagcatatggatcagaatgcctctgatttgttacaggtgtaacaaacaagtcagtttgtgtagatggtcttggggtttggggctgctgactatatgggtcaacagtagtaggccggggagttccaggaggttgagagtaagggtctgtattggacctagctgttcctgaagattgggaataagaatctacaacaggtcgtggagttcctgggggttgggagtatgggtcctgagatgttggccttgatatggttccaggctgggaaaaagcccttgaaggatgggcaaaagattcattcactgctggatgtggggtaaggggaggctgactatatggatcatttgactgattatgagaaaaattatctataggtcttggtgtcaaagcaggcctttcataagggtcaacagacaatcgccttgatgcctgtgacactgatccataaggatcctgagaggatggaggaggttgcattggagtcttaaaaggtccaggaccactatcaagaggtgcaggtgtcaacaagggtcgtgcatatgagtcaggtatcctttgtctttgaaacacatctgccctaggagatggtttagtaaagtgatcactggttccagctgctatagggccttttgcagtttgttctgaaactacaggagaccgggataggcccaaggatttgggaaattgatctgtcatcacaggcctaggtgtgtctggaggttttgcataggggtcattatttgtcgtggaagaagaacataaatctctgacaggggatggcctatttgctgttgtctcattcatttgaaggggcctagataccgatgataaaggtgtacagttttccactggtgcagcagaatttcttctggaaaaactatggcccacaggaggtggtcgaggggtaccaaccatttttgcatatggatccattggagatggtggtcgtgagttagaggacccaggtgaaaacacttgcggtgagggtggctgagaagtctgagcctgagaaagactatcctggatgggaatccgggatggggctggaggaggaggtggagcttgtggctttacaaacacatcatctgaagatgtagacgtaggggtactgggtggctgttttgtaaacagttctttatggaatgactgtgcaggagacatatttccattgccaggctgaggtgtcaagggactctgtatcccactacttggtgtatctgaaccagactgcaccagaagatgctgagaaccaaattgctgttgttgctgctgctgctgctcatttttcacctgttcaagtttctgtgtggcttcaattttagcttgctgcttacttttctgacgcatttgctattaaaatagaaaagaaaaagcaatcatatttaggttaaggaagaaaactaccatcatggggggaaaaagcaacagaaagttaatttgtttgatgtcagcgctaccagattgctcccatattagattatgaattcctgaagaagagaaattactcatcatggtatgttccatttgtgcctagggcagtatattgtttataatatttcaataaatttctcaaatcaatttaaatatattttactgaaaagagaaacaagtctatcctaaatcaaattttcatggtctaagaactatattctaaaataataatgcaaagacctcccttctcaaaacaaaaatgcaacttcaaaaagtagattatccaaaaattccatacctgtctaaatttccattcctgttcatgttctgattctctttgctttaaaggatctttaaaaagctccgaatcaatacgagagctgggatcaatgctatcttgctgttgctgccttttcatggaatcatttgacatctgtactttattaatgcgtaaagcagctctgttatctctggctttttgctttgacaaaagaagagaaaaaaatttcccagattatgttaaatgttttaaggaataaaataaaactatcatgaactttctcaaataaaagaaaaaaaagtcaggtaaaatagctgaaatacttacggcacctcccaaaaaaggatctggacactaactcatcttctctctttacagtgcatagtacctatcagttgaggatatatttctatgtatttgaattaagcttaaagatcctaggtgtgatttaatattttagctcctagttttcttaacatatccttagaaattatgtctccttcaatttagaaagaaggggctggggccaggcatggtggctcatgctcgtaatcccagcacttcgggaggccaaggcgggtggatcacctgacgtcaggtgtttgagatcagcctgaccaacatggtgaaaccccacctctactaaaaatacaaaattaggccaggcgcagtggctcacacctgtaatcccagtactttgggaggctgaggcgggtggatcacctgaggtcgggagttcgacaccagcctgaccaacatggagacaccccatctctactaaaaatacaaaattagccagatgtggtggcacatgcctgtaatcccagctactcgggaggctgaggcaggagaatcacttgaactcaggaggcggaggttgtggtgagccaagattgcgccattgcactccagcctgggcaacaagagcaaaactctgtctcaaaaaaaagaaaaagaaaaagaaaaatcagccaggcatggtggcacatgcctgtaatcccagctacttgggaggctggggcaggagaatcgcttgaatctggaaggcagaggttgcagtgagccgagatcgcaccattgcactccagcctgggcaacaactgtgaagctccatctcaaaaaaaaaaaaaaaaaaatttagaaaaaaggaaaaatatccaatcagtcttaaaaaaaaaaaaatctggatatttgaaacgtatcattaaagaaatcacttaaaaatttaaaaattctgtcattacctaattcaagtcaaaataaaacacagcatattaacacatctatatatatatatgtgatagagcatatacacacatatatgctctatccaaaataatcactgtaactgaaaatatgtgcactggggaacaagctggaaaataactatatatattttccaacaataatacagatttaatatgctttaaaacgaaagcaaggatttggttccagctgacaatcttaatttggctctttgggagaaaataatttaccatatgaactgcgaatcttataaaattacctaatagttcatggcaaagatcatgtgtcaaaaactctttaaacatgtctaaatatttctctttcaagatgcacaaagattctctatgaaacctaacaagaaaagaggtgactgtggaagacactgaggcatgccaatccagtctccaaatttagtacagttgtccctctgtatccatggggtattggttccaggattccctgcagataccaaaatccacagatgctcaagtcccttatagaaaatgtcacagtatttgcatataacctacacatatcctcctgtatactttctccctttttattttttgacctagcagggtggtcttgctctgtcacctaggctggaatgcagtcgtacaattctggctcactgaagcctcaacctctcaagtctctcaagtagctgagactacaggcatgcgccatcatacccagctaattttttcattttttatagagatgaggttttggctatgttgcccaggctggtcttgaactcctgggctcaaagccatctgcccaccttggcctctcaaactgctgggattacaggtgtgggtcactgtgcctggcccctcctgtatactttaagtcatctttagattacttgtaatacttaacacaatataaatgctatgtaaatcgttgttacattgttttaaaaacaatgacaagggaaagagtctgtacaagttcagtatagatgtttttccaaaatatttttgatccatggttggttgaatccacagatatagaactcatggatacagacggccaactgtacctctgctgaagagataaaacaattttaaagtgaaatgaattactccttcccccctaaaacagctgattttcaatcttcaacgttttggttctattaacttgcttataaaaatgtcacactctctattaagacataaggagttagaaaatcactttaaaaataaagttgcttgttgtacaggtactaacaagcattttctgaaatggaaatttgttttttattaacctaatacaaataaggttcaagcactgtatttaaatatttaaaagatagaggagtttcttaaaataccacatatggtgctctttcttgtgagcttgcttttctccacaatttggcaatttgcttcactctagtagtccaatctgcaacaaaagaacagagtataacactttctcagagccatgctaatgatgtgttgtaataaagaatgttgatgaactgctgacagttaatcttattcaggccgtattctcatgaggtcatagacctatattaagttttttacaaagaacaaagatcgtggcacactgtaggccaaacaaacgttttctaaatgaagtgctgccttattaacaacgtagcttgtaaagttgggaagtttttagattcaagggacaaagtagcaaaaatgcaagccagacataataaattccctctggtggtaagacaccaccagaaccaaagtacaagtttgtaaaacatctgtgctaaacagaaatctatcaatttgacctaccagaagtaaacaaagtcataaataagcatctcactagcatttgtggacaacaaacacatggaaaagtaatgagttcaaaccatttatatgaaactcagtgtcatgacggtatacaaaatgaagaagcctgggtaagatcaacagttaatgataaatacagaaattatttattccacattacaaaaagaaagcaagcttccaaaaagccaatgaaaatgaaaaatcagttcacagaccaacagctttaacacagtatttcatgaggttcttgaatcacaaagtaaaattattaaagaaaattacttttaaaaaagttacagctctgctgtaaggacaatttgtgctgacacaaaatgacaacatacccatgtacgttcataaacagcaaatgtaagcatggaaagaaagtggctgaagaatgggatactgccttcacaggtctccctgcatcaaaccactgatttctattgttagataaaaagcatttcatttattacaatacataatgaataaagtcccatgaagacgccaatccaaaaaggtacctaaatacaggggtcatccaaatgaaaagtcacttccaggtacccctctagtaatttaagagtttgtgtattgatagatagctgggaaactattgcaaaactgagtttgaataactttttcaatcctagtttgtctgataccatgaactcaaaataataaaaccgcattgcttgcatatattcaataattgacatttcattaatccaaatttctcattcactggttaatcagaattttcacaaactgtactattatcatctgtttttttcaagaggcagtggtaatagctgggcagtcagggaaagtgagaggggaagaagggaagacaatattgaattcgtttcataaaaacactatttaggattcactgatttagcctagcagtatttttgattaaatgatagtttgggttctagaaattttttaaagaatcacataacacggatttctgcatattaataagtactgctaggagctgaaaaacggaccatttcactaattgaaactaatttttgggaaatatgaggatggatgcagggtctaggacaaagtaaaatgcaagatgtttctagacatctagggaatcttcatgttgtgggtcatcatagacaaaaattagttaagctacctttctattgcagttaaaaaaaaaaaaggtattgcacatgtgaaaatgttggtaaaacagaaataatatattcatggcttaccagggaattcttcctttaagttggggaaattaatattggtgtagagaactggggcaacagttgccatttcacccagagcctcctctttctcccacttaagcgtgcttctctgggcattcgacattgtgtcattttctccttccacagtgggagctgatgatgtccaagagttgttaggatcacttgccattggattaaaggctgaatttttatccctgggaaaaaataaatatctttactttatgaacataaaataacttcttaatatatgttcaagtatagctttcattaaaacctattacaaaacagttaaaagtaacatatttatagcaaaagccacaataaacgcaacatacaataatatcatacacaatcatttaagcagactaatttatatataaatcaaacagaaattagtgcaatttaagtttccatagaaaataaggcttgtacctggcatcaggataagaggattgtgcaattgcagagaaagttcccagtccgcttccaggtggcaaagaattatgtgggagatgaggactggatccaataaggccattcatgagaggcatccgtgaaaaagcatcttcagagaaaaaaataattccgttggcatgatattcacaagtaacaaggagttgaagtaaagctggcccttgaacaacatggtttttaactgcatgggtccacataaacacacatttttttcaactgaatgtggatagaaaacacagggaaacccatgcatagagaggaccaacttttcttgtatgccaagctccatagggccaacatttgacttctgtattctcagattttggttatacctgggggtcctggaaccaaagccccaagtacagaagagatgcttatacttctaaatcaaaacctttaatgcaatttaaaagtaggatttttttcagtattttataatacttaaagagtgacttttggctataagattttgaaatatgatctctacagctgtgattatttcattattgtgtactagaaatagcaagtgttctggagtccaaaagcccagggtgtgaacctcaattttacctgttagaagcagaatcaatttctatttctgtaaaccgtaggtattctgttatttgggttaattgagataatgtatgtacagctctaaacatagttcctggtatgcagtaactattcgacacaattaactcctaaaaaacactaatgaatcacagcaaatgctagtaagttttatcaaatattctttctcttcattaaaaatttacaaacagatgtttcttatattttattcctgttcctcttaataccaaaaaaaaaaaaaaatctatgattctttcctttttttttttttttttttgtttttgagatggagtctcactctgtcgcccaggctggagtgcagtggcaagatctcagctcactgccacctctgcctcccaggttcaagcaattctgcctcagcctcctgagtagttggaatcacaggcacttgccaccatgcccagctaatttttgtatttttagtggaggtggggtttcaccattttggccaagctgatctcaaactcctgcctcaagtgatccacccacctcagcctcccaaagtgctgggattacaggtgtgagccactgtgtccaccccacctatgattcttaaattgatactttctctaaattagttttgagtaagcaatatatctatcactaaaaatcagatgattattcctaaaaatacatacactctggttttggcctaatttttataacttacagttcagcccccaaacacatttgaattctcattcgagcttattcacaaacatcaaataccttatcgttttctttctgaatagacattaggcaaataaaaggaccatcttatgcttctttacaacactcctttaagcatgtaactccagtccttattgtgaaagtctacttgtctaaactatttggaactaagccaactgtccatattggagcagtttccagaaaaaagaaagaacaacaacaacaaaaactttgtttaccttcaaaaagccctcccaattaaacttgatgatttgtggaaatacacaaggcctctgttaattgttgcaacacttagagccatactattacaggagatccacatcaccaattaattacacaaatggcaatacagagttgaccaatacttggtataactagagaattcctaacctgatcacttgatttttttttatctaatgtcattccattagattaaaaaaaaagtctcatacacgtacattttacaatgtataatgatctttcacttaaaccacatcatttgaatgttacaacactaaaacctacatagctccagtatgtatgtgcagatactaaggatgatcactgacaagtttaaaagattttgtctcaaagacttcctagaactctctgactttcacaaacgggcttaccctactaaatgccacagctgggtccactggatcaggttttcacaatgacaaatatctcatgacacttacatttactccaaggattaaagggcaagatttctgcttttttcaaactagaatgccacatctattttcaacttcagtgaaaagcaggttccattaaggcaggggtccccaactctggggccacagactggtaccagtccatgacctgttaggaacccggccgcacagtaggtgaacagcgggcaagtgaccattaccgcctgagctccacctgtcagatcagtggcggtattagattctcatagaagcgcaaaccctattgtgaagtgtgcatgcgagcatgttcctatgagaatctaatgcctcatgatctgaggtggaacagtttcatcgcaaaaccattccccaacccaccaacctgggtttgtgaaaaaatggtcttccttgaaactggtccctggtgcgaaaaaggctggggactgctgcgttaaggaatgtgcaattttaataaacaatatcaaatgtctttcatgtaattaggagaaacaagagtttattgacaaggagaatgtgatccatactgtagctaggtatcagtgccatctaccgatattacaataataatcttgtaataatctacaatattaacatattgaaacttttcccaatagtaatattagctattatttgttaagtactttatgctatgctaagcactgtcttaaaagctttacagcttcatgaaaacccactgaaataggttattatgttcagctccatttaagcaaagaggacccacagaaattaaataatttgttcaaggacaaataagtaaaagcaaagtatttcttcttattttattcaagaagtggtcttttttttttccaagtctaccatatctacccaaactagtcatattagtttataaaagttcaaaagttacttcacaacttttacataaaggtatttcaagttactctatctcaatcttgaaaattctattctctactttctgaactttattaccatcagacaataaagcatattacatattacataataacatattacactttgcctcccctttctcatcaattctattgaagttactccactgaagattagcaacaaccttcccatggtccaatgaaacaatgtttttcaagtagtcatgttacttaactgtacaacctgtctctaatgatcattcatttccaagatcctatacctctcactcaatgtctcaaatctctcaccactttttttactttcacctaacctttaaaaggaagaaagataagaaacatgtaattgcacacctaatataaatcagatgagttaagcatatacttaattacatttaattaaaaagcattcctcgagattctatactctactggcagtatattctcttaataaatctcatccttcccacatgtgcaattagcacaattacacagataattcctacattttcatccatctccttgactaactgcaactgcctgtaagtcaaaatagtgtatatgtcccatttctaccaacctaaaagaggtctaaaactaaattcattgtacctccactaccttctaccagcacacacactaagtcttcctctgtttcatgattatcctctgggcccctggtttatacatagtctaattcactttaatttccccctttcctcacaccttatatccattcagtagcacagtcctacttgttctaatgtcattttctctcgtatctattccttcctttcaatcagcacggaagtatctttacatggaacctactttttaacttagtctcaaccacaataacctcattagtacaattcttctcgtcccaaatttattcccaatattgacaccagagctaccttagcaaaacacataagtgatcagatcacaccagtggtgtaaggtcttcaaaggctcttggaagcctctagggaaaaggctagctgcctctgcctatttctcagagccctttacaatcagcaccaatgtccacttctagttttgcttccttaaacaatgcccactccctttgctctggaaaacattaaagttgccattcttgaataactatgtgtcgccctatatgtaacttgatcatgctttgcccttacattagaactactattccttcaaacaagaacaatgaaatcttagtgattcacaaggctgtacttgaattatactgtactataatacacattagttgtatacctgaaagtctacagtattagaattacaaactcctaagggtaggcaacctgattcaccttgtattacacattaacaccttgcaaaagaaaaaaaaaaaaagaaaaagaagtcatcctcccaagaccttttaaaaatgagactgcacaatgaagtgattttcataatgattgtaagatgttttttataaagaaatacatctttgatttttaaaatatgcactttcagttcagaaaacataaagacaggtcatttttatatgttgaaaagagaaatactgaatagttcttaatcgttaaaacagcatatgggggctgggcgcggtggctcacgcctgtaatcccagcactttgggaggctgaggcagatggctcacaaggtcaggagtttaaggccagcctgaccaagatggtgaaaccccgtctctactaaaaatacaaaaaattagccgggcacagtggcaggcacctgtaatcccagctactcgggaggctaagccagaagaatcgctgaactcagagggcagaggttgcagtgagccgagatcacgccactgcactccagcctgggcgaaggtgtgagactctgtctcagaaaaaaaagaaaaaaaaaaagcacataggaacaattaaggcaagaatagttatatgataagtatattacccaaatgtaaatcacatgtttagcctagcaaaaatcaaggtaaatttatgtttagaggctaaactggtaaaaacacaaatatttccattatgtgcattatggaattttcatgtatatacaaagttgttagtaaaggttacaaattattcacacactttggcacttacacaagaaaaggagaagatatcctcatgttattcaattcagggtatagtcatgaggcagtgacaataggatagagagagatgttcctatgctcaaatcatcagaaatatatactagctgcgcacagagggccacgcctgtaatcccagcactttgggaggccatggtgggaggatcacttgaacccaggagttctagactggcctgggcaacaaagtgagacccccacctctgcaaaaaatcaaaaaattagccaggcatgatggcgtgtgcctgtggtcgcagctgcatgggaggctgaggacagtaggatcgcttgagcccaggagatcgcagctgacgtgagttgtgttcacaccactgcatgtcagcctgggtgacagagcgagaccgtttcaaaacaaaacaaaaatacatatagatagagttatatacacgccaccatgcaactccataaactccttcctatagattcccatacctgtaccaatttccctatctactcatacagaccttaatcctaggctatcaaatttcagctctacagaaaaggggagaaattggtagctagttgtaagtaggcagaagaaaaatgaacaaaataggcaaacattcacaaaatttcatagtgtctacagggatagaaaggtcactgatttactatgaaagtatgtactgaacacatactctgtggcagggcatataagcaagacatggacaactctagcctttaaagagctcacaatctaaagggaagacataattacccaaacaggtattatatttgtgccatatgctacaaatgaaaaacatgggggtggggtggtgaccagctaacctctgagagatgacagtgaaaccgagggcagatcaatgagtacaggcagccaggtgagcggggacagttccacacacacacacacagcaagtgcctatgtggcaaatgactagagtggagtgagctgggaatgggacttgcagggagggaagagggcaggcactgttacatcctccccactggacataaggataattacagaattacagagaatttcagggagaccgctatgtgaagtcagtatttttcaatcattacaaaagggtttttctccctatcagtttgtatacgtggctactaaagaatagggcaaaacttgcttgtgtgtgtatatgtacccacatatatacacatgtgtgtgaatataatgtagaattataaagtcataacataccctgattgtgtattggcaacagctgtgttggtgggggaggctgtggcaatggagttggctgagtgttcgcaggactaagtacagctgtaaataagtcttcaacatcttttccgccaagctctaggagataaaacaataatagtaacaagattaaaagactagtagggtcctggtatggggaacgccattttcattaactagaaaatcaaaacacatttacctggaattttatataattttccaagaattgctcctagaataaattaaaaaaaaaaaagaaacattaacagctactaattcaatatactgatataaaatagtatttaactgacagaaataattagaagttaaattataaccatgcaaaaatctttaaaaatcatatttactcaggtcttttagaaagcctagatgtagggcaaatattttaccatctgtgaccattttgtctagttcaggactgaggatcccatctagctgttcttcacttaatggtcgtgaactctgattgacatttggctgaggcaaagaggaaggatcatcagtgacaggaccaatatctacaagagtaaggaaaataaatttaaaggtacattcagaatactcacacaaaaatgtatagcactatttacctgtacttagtatataacaatatgattaaaatagagaaataaagtctgtaattctgaatcagaattctcatatcaatttggagagtcgctcagtaaaaattaggcacaatatatttgtattcggtgccatgtaaagttctatttcaagtaaaaacatttcctgaggaataaaagaatacatctgattttaacttgccaactcctgccaaaaaaaaaaaaaagcttaagataggagtttatgagaaatcgatatgcaaataattgctttaatttggaaaatagtgttatcaaatgtacagttcaattattatgcacagtatgtaaaaaggaatatgtttcatatgaattaatgaaaagccctaaaatgctcagtgtttaatattatcctttgtaaataacttcaattataggtaatatttttaaagtattctataggcacattctgattatgtacattacattttataaaattgtaacatgctgcagctcaaatttgtaagagtcacatgtaaaagtggtttatcatctacatttttttcatgctttctcaatattattactattaaaaagtaaaaatttagtctgttcttatttgatcttatattaggaactagctctacgacatttaggtaatattgtaaaccacatattaacaaaaataaaattattcattaaagaaaaactactgagaaagtcacccgaagtacagtacagctatactatgctttagccacacacaaaaagggaaaagcaaagtatggattagtgacaaattagcactactgataaacagcatgcacctacaggttgtttcagctgaaatcactataaaaaaagaagactacttctagtcagccgtcatccattgctcagtttcttaccaaatggaaaaggtgagctctcaacctggaaagtgcataaatcaagacctataagacccaaaccaaataaaatggatgattaccacaggagcaggaagtgagggaaaatacaaacaaaagaagaaaaaagatacagcaagactttaaggcaacatgccttaaatgtgatgcaattagaaagacgacagaaattaactaacttgctatacccctcctaaagcaggaaagctgaggcagatcaaagaaaatgctgagtcctttaacaaagccaaaaacaaaaacacagttactgggaaacagacaaaaggctaaacttgttccacacatcatacacctctcgctcacatcagaaaccagaaaaagggtaaacagtattcatatatacctgaatgatcaactgattttgctagatcatctgaaattattccaagaatgtcatcatctgtgtttaaaacttcagaaatatcagctaatgggtcatcagcaggacctaaatatagtaaatatgttttttaaaatttcagtattttctcagatattaagccatttgctaaaaacctagagtacagcagatactgagtgaggcaagtactggaataaaaacctgagactcttaattttacagtaaaaattttccatagcaaaggagataatgttttgaattacaaaaatttactaaaaattcagacgattttgtcttgtgactaatgtatattgagacaaaatttaaagacctgtaggcaataaaagtgaaacagaataaatgctgtaagaaacaaagcaaagaaaaaaaagtttttcattaagaaagtggcatgtctaaaagtgacattgagaaattaaaacacagtaggaaaagttaaaatatgaaagacaaacctgtcactctttagaaattccatatggagcacaagccagaaattccatatggagcacaagccaggtaccatctagtaactacttgcagctttgctgttcatactgattactcactcatttattttaaaaagtatttcactacccacagaactgtgtctatggatcacgtatcaggcattgcccactcagtaatgactgaaacaaagtgcctgccctcagagggcttactttctcagggggagttagtaaataaacgacatcgctgtaagtgctatttaaagaaaaaacaaggaaaaaggattaaaaataagctgcggggatgttgtattagacagagtggtctatgaagacctttaggagatgactgagcataaaactaaatgagggagtaagttatatgcacaaagatggagataaccctccaaactaaggcaaagcagacataaagcccctggggcaagccgggtttgccaacgagaggccagagtgttaacagtaagaaaaactgtggtaaggataaaaaagaggcagctagggcaagattatgttaagattttagagattatggggaagactgggttttattctgaagtgtaatgagaagttgctgggaggctgaaagataggagatgactaatattttaaagggaacatactggctgctatatgtagagcagatgaggggtgggaattagagaggggctggtaagattagaaaagggcactggtgcagtctgagaggtgaggtgatgacagcaccagggttctaaggaaagctgagacaagtggtcggctttgggacgtattttgaaggcagacacaaacgtggatgaatgaaagggaaagaaaagtcaaggaggattctacgggtttgggcttaaccaagaaactattggaactcttgtttaggctagctttaataattatattagtcattcagtaaagagaaactgaaatttttaatccatctcaagcttatttttacttaaaagggggaggagggcataaatgtaatattccaggtcaaatacttctgtcaaacagtcttggtcccattatatagttttcaaaatgtaattcatatgtaacatatcacattaagttttgcgtgcccaaatatccaggaactttttagagaaaattatttcaataatgacaacactgtagttgaatgaaaaaaaatctggataatttttttaggagtcatatagcagttttttgttttaaagtaatggaattctactatacaattataactaattttttaaagactgttttacaagtttgcccctacctaaaggattttatatctgaataaatcattaaaattgatataataggctacaatgaatgacatgttaaaaaaaagcctttagtcattaattttccattataaagtgaaaagagtagttcaattgcaaagaacaattaatctaggttttgaaatgggtatatttttctagtcctccaagttttggccttattgtaaaactgttctctcttcagtatttttgtggaaaaaaataaataaagaaaaaaaaaaacttgtatcaatatctttcctatatgttctctgtccaatttcaatccttttgcttttaaaactcaagtgcaaagagctcctatttaagtcttcaaagtggctagttatgagagttataagataaactttatcgtaaaatatcctttgaaggacccacaggtctttcattatacattatttttaacaacatactgacaaggacaagagcaggtcatacttaaaacaacagaattaaagtaggaggtaaaaaatatgtaagattgaacaaacaagaagcatgacctcactaccaacaatgaggcagactggacatgcacatgtgtccaacacggggtaagattgcttctaattatttcaaaaagtcaaaatcaaaaatagttgtcagtatttcaattcaggataatgccaagttaatgaagcattaactacttaacatccaaagtcatttttcagtggaagattgctttaaaattgtttttcaaaatgagtttataaaattaactgagtaacaaatgcaattaatggtaaaaaaaggaagcttaccaaaagaacaatgatttacaattgacagaaccataggggagaagtgggagaaacactgatcaagacacttacctacccaatgagttaaactcctagagccttgctgacattgctgtaactctgtaaatacatcaagttctcatacctttctctgattgttaatagttcctgcatttaggataatggttctcaaccgggggtgattttgcccaccaaaaccaaaaggtatttggcaatatctggagatatttttgatcatcatgaggccaaagatgctgttaaacatccttctatacaccagaaaggctccctcccacaacaaagaattactggtgcaaactgtcagcagtaagaaaccatgacctagggcaacagacttcactgtagtaacacagtatgccagcaagttcccaagtacccccacatccatttcggtttctctgttttgaatttaagctgtatgattaacaaaaatctatcttagatttttagtcaaaaagtcactgttggccaaattataacccctcacattgccctcagcaaagtgtaaaccaaatgttttccttcacaactcttgatgttggtactagttacacaggtaaattaatttgctacatcttatacacctgtccacttaaaatagttccacttactgaatgtaagttatacttcaatgctgttgatttttaaaatgcatatgaggccaaacaaaaacatttcaaaaagatttaactgaaaggaagatgtatgttatatgatataaagaaaatatctgtgaataattctacataccgtgagttccagattttgttggagccgaggatgaactaagtagtggatctaaggaaggatccaagaaacctgtgttcatgtttgttttatataaaagctgagctccatcttctgacagattatctaaacttatcttgctttgtctacttgtatctagaagatcttttccaaagaaagcttcctagatgaagataagcacatacaaaaatggttagaaaattctaaaaagacaatagattattctgtcatggtttttgacaaggaagcagaaataacagaaaaggtttatatttaacaatatagaaactgaatacagaagtattaaaaaatagaaatatcctgtcaattattttatatagattctccttattttaaaaataagattttttggtagctttactagagacaaaattatggaaataaaaccacacaattataccaaaggtttctagaaactgcagaatagcttcatgagtattattaatttttatagattacttgcagaggacagcataagactttgatctacggctttaatatttacttcaggtagatttgtaatctattgattcatataaccacacttacactataagactacttacatcatcaatctgaaagacggttttatagtcagtttagccatactatgtgtgcaatatttacagctactaaaggcttgtggttttctatttatttaggcatattaacatttttccatttcaatatactttcaagctgggttccttgcaactccaagatctctccaaaatttctcaaaaatcaataccaaagacaaaagggaagcacagttccacccctttaccctgcttcaacccaggaactctgctttagtctatatcctatgatgtagtctatctggaaaaaggatcctccatacaggacaattttgcaatacaacatttaacacattcttgccaaacatgcacaaaaaagttcactgtagcatattttgtaatgtcaagaagtaaaaatggccttaatgtctatcaacaggcatagaactatccaaattatagacacttatattacaaaatacaacaattttttaaaagtatatagttctatgttatcaaagaaaaagccctaaaatacattactaaaagaaagtaagttgaattacacatacagtaaattataaaatacaggtcgggcgcagtagctcacgcctgtaatcccagcattttgggaggccgaggtaggtggttcacttaggcccaggagttagagaccagcctgggcaacatggcaaaactcttgactctacacaaaacacaaaaattagccaggcatgcgccaacatgcctgtaatcccagctacctggaaggctgaggcacgagaatcacttgaacccagaaggcagaggttgcagtgagctgagatcacatcactgcattccagcctcagtgacagagtgaggctgtctcaaaaaaaaattagaaagttcaaatcaagactattataagtttgcaaaaataaattataaaaaagtttctgaaggacaaatgccaaattattaacaatactaccctttgagaaaagagattgggagtgtgtgaagtctggtggaggcaatgatatatctgatttgaaatgttcacattttaaatgaaaaagtcatctcactatgaaaaatctaaaaattcacaaaactagaataccaggtagaagaggattcatttcttataataagcaatgcttttatcattagaaaaaatgatgaacagcagaaagcgttttagaagtttagaggtcatttatttaatgccttcagtataaatctgagaaatcttacaccatcatcagcaagaattctgtctaatgactcatgactttactggtgtttatcaaaaactgtgtcacccttattaatttagtgtgttttacattccctgtagataacataaagagggggctccatccatatcgtctctaaaagtccaagaaaactaccattaaaaaggcctccctcatgtcacacatacagacacagacacacacacacacacacacacacacacacacacacacgctgaaagttactgatgtgcaacaggggaacaagacggcccaggagactaagatcacagcagtaattgggaaattagacctaataattttaaagactcttttgccaaagtattaaatggctagttttcatacttgcagaaacacctaaagaaagcttcttaaatttatattacactttacagaaggatcaataggaggaaaagtaggttgccatcacaatattcctagaaaggactattaagaagggaggtaaagggaatcccaggagaaaacaacaacaaagatgaaaaaaaaaaaaaaaaaaaaaaaaaaggtaagccaacctataaatggattttttttcctgaccaattaaatgatcgtttaaaaaaaaacaaaggtgcaaacctaggatataagagattgaggggaaaaacatgtatgaaggatatacaaaaagtaaggcacaggctaggcactttacatacatactctcactgaacttctgagcatttctgagaggcaccactatgtcacaaatgaggaaaccgagacacaagagatgttaaacagaacaaaatcacacagctaactggtagtggaatggtgtttaaatcctgactttataggctgagctctaacatgaatactgccattaagatgttagtagctacaaaaaagaaaattgaggaagttgtatgctagttgaaaggcaatgtattttaaaaccaattaaactagtaatacctaactggaaaattgatgtaaaaaataaatgcaactcaggcaatgaagggttatctgtgtaagccatagtttcttaggaggaacagatcagatgaatagttgtctacaatgaaatgaggatggcctctcaatgatagtctgttccagttcaattttaacacatgaagaaatagaggccaggaaggatgaataacacgcttaggaatttacaattagttagatgcagagccagatatttaatctcagtacaatttctaatattgagctgtttccgtatcacatggccttaaactctgacttaatgtttacaagatgaactagaaaaaaattttttttgtagtctacatctatcaaacataatttattcgtactgaaaggtatttttctgatgtgtattttggaaaacaaaaagaatactgcttaaatctttggttctccaggcctctaaaagtggtaacgattattaaagctataactttggctgaaaagcctatctttaatcaatgaatataattaatgtaacttgtattggcaaaggaaatttcaacagaacttgggtgtggggtatacatagctatcaatgacttggaagattgagtttttcctatcccaaagtgtccttgttacatcttatagaatgcttagaagtgaacaactggtattaaaaaagcaatttatgacaagtatcaaagcacacaaaaaaagtaaatttaatttttatggacccctgaaaggtaaaaatggcatttatgatgactaaatgacaacaaaacaagtaaaacattaacaaaaacaacaaacctatgttttaaaactcaatacattttatttcctcaattaacaaaccatgtaaaataatgtaaagcaaaatattacttgtaaataggcagggaaagtttcttcaagcttatttttcctttttcggtatctcttctttattttttcagtgctttcagtaacagaaacagattcatcaactaaagtatctggtaactgctcactccagcctgaaacaacagtcacatttataaatatgtgacatttaaaatttctagacaaacccactgaaggtaattttataccttaccaacatacacacagtttcatataaacaaacaagctttttgaacaaaaaaatctcaaatcaagtttgttacttttaagtgccataaaattttgatttcatgtctacttagtattagcatttttcctattttcttaataatcgattacaaagcaaaaacgtatttatttaaacatattttgttaaagagtaaaataataataataataataataaatacccaaagctcatgagtatgacgaaatggcaacttataaactattaagagaaattctgtgggtgtaacttttttgtagggtgtattgagaatactcaacaaaaaccttaaagaaaaagtgtgtcctttaatacagcaattccaagttcagaaatttattataaattatttgtaggatatacacattgtgaaaacatgacgatgaatatgctaataaatatgcaatgaacacttattcttgaaatcagaaatggaaataaatttggggactatgaaactagcaaagaaacaagaacacagcttaaatttgacaaataaacaatcaaatgatattctcagatgcttcataatggcagggcaaatggcacatcccttctgaaaatcaatatgggcactctaccaccagactacgtaagtgaattgactcttctgaaaactagaaatagacaaacattttttacaacaatctttttaaaggcaccagtaacctagccagaacataaggaatccatgaaaaacaaaaattaagataaataaggaaccacagaagtaagcaaaaaagtaaaagctctccgaaatttgctgaaatccaatgacctcaaactccaattttcagagcattgcgaggaatagggaatagaagacaaagcttaaggcctctctccaaggcagacaggccagaggtgacttgcataaagctcagggtcagtttaataagaaatacaccttcacacaaaccatcacttgccacctcctgctcaccaccaatagcaaaaaaaaaaaacaactcctggctggatgcagtggttcacgcctgtaatcccagccacttgggacgctgacgcacgagaattgcttggactcgggaggtgaaggttgcagtgagctgagacggcaccacagcactccagcctgggtaacagaggaagactgtctcaaaaacaaaattttttttagatatcagctgggctcacatttgtaatcccagcactttgggaggctgaggcaggaggatcgcttgagcacaggagttgcaggccagcctgggcaacaaagtgagaccctgtctttgcaaaaagccaaaaaattagctaggcatggtggtgtgtgcctgtggtctccagctacatcagaggttgaggacaggagaactacctgagctcaggagtgcaaggctgcagtgacccatgattgtgccactgcatgccaacctgggtgacatagtgagacccctagatagatagatagatagatagatagatagatagatagatagatagacagacagatacataaatagataaaaactgaggtgcactgtcacttgagaatttcaaattatatgataagtagctaaggcagtcaaagaaaggctttggagatgaccagaaagtaccttatgtaactaagttattcagtccctaaaccatttatatttaaatatagaaaatatatttaataatttgatacaggaaaaaagagcttgtcaaaaaatctcaaaagaataaagtctattggatttaaaccatttccttataaaacctgattactgtattacagatatgaactctatacgcactcaaatcctttcatcaataaaaggcaataagactcttattgagtaacaataagaggcaataaggctcttattgactgtaacattatttaggatagttttttccaatagaaatatcaagaccaaagggttacattaaaaaaaaaatttttttttaagtcagtactataccatcatctctgcaaggtaactgctcggaaatagagcctgaggaatcttttctgatcacagatcttttggttttcccttgcccagttcgacttctttgccgcaccataaatccaccaatacctatccaaaaaagaaattaggtaaactgataagtaatttctccctacatttccacagtacacaggataaaactgctttatcttgaatagtaagtcattttccaaaattaaatctgtgctaatctaaatcaataacctgatttttaggtaaaatagaagttaaaaacgaccaaaaaaaaaaaaaaaaaaggcaaagccactcttatcacttatcaaacagaatacaaaaagacctgtgtgcacttcctcttctcaacagtatcagtgtaaatatcaaacactaaattacgctggcttatctatttgacaaatattagtgcctcatacatcacataacagtcatgcactgcataatgatgttggtcaacaaagggctgcatgtcaaggcagtggtcccataagattataatggagctgaaaaattcccaccacatacagacatcaccgtagttataacaccgtagcacaattactttatttttttaaatgaatttagcgtaccatacagcctaaatgtgtagtaagctataccatctaggtttgtggaagtgcactctatgatgttcacgcaacgatgaaaatgcctaatgatgtatttctctgaacttaagtgatggatgactgtctgtatattaaccggctaactggtacattagctggaggatagaaggcacaaactacctagatgacacaaatattctttgactgatatgatttcagggggacggtgtctggtactccaaggtatgagggcatttatacatgggacacatagagccctgtgtttaacagcatggaatctggagtcagactatgtaattctgcttactaaatacttctcaatgcctcagttctttcactggttaaaaaagggggtgaggcaaagcagcttctcatacacatgttaaaaggacaaataacataagtgaagtgcttagaatagaggtctggtacacagtcaacactataagcttttgtgaaatgatatcgttgtctagcaatttactccgtgacctaatgggtccctcaattagagggttgacttccatgtgaggcagaggaaaagaaaaaaaaaacggtaaatacaagttcctggaagaaatctgcaatgtctaaaaaagtacacttataagcctcatgatcaggaagaaatgaaatcattttcataaaacaattcagaagcaactaatcttaggtccttattatagatatgacctatttaaaagataggttatcttttaaggtctcatggaatacgaatgaagtaagaaagttcttccttccatatcaaaagggatttagatcactcttaccaataaaatataagcaataagaagcataaagattgtacaaatccaatttaaaacctcattggtaaacaagatattaataaactgcctaaggaaagcctactcaacacgtgtgataagcgggaaaaaaattttttaaataaatacataaaagcctacaacttctgtattgtgacaattttaataattttttccaataaggcaaataaaactgacaagcaagaccgcttttctctccactcctgaggcagataagaaatgagtgtttaatcagtcatggtttttaactggactataaattctaggagccataataactctgtcttattccccttcacactgtatacttactggcactcctgcataaacactgaaataagttttttcaaaaaaagatattagaaagtgaatactgaaaattaaaagcgttacagaagtacacatccagaggaactatataaatggccttcaaagtccaagtatgaacaaaagccaatctagtaaagcctttaataaaatggttaacatttgggacaaggcattcaataatgattcattgtgaagtattcacacattcaaaataaagaactctagagctaaaaagtcgtattcaaatagtttagttctttaatttatgtgcacatatttttgtttagacagttctgaagcctgaatatttaattttaattgaagtcttcagtattgtatttttctttaattaaccaagtgttgatgatattgaaatgtctacctcaggcactatacctggtctgtatggtttcctttttctctttttgacaccatctgttccttccactcccttagtttcatcatccacagcttcccgctcaggactagattctgattttccatcacaatccataagttctccttctggaaaaaagtaaatgtatacacaaaactggaaaaacctatcaaatatataatccctacataatggggaataaaaagtagggttgttgctgagccattttaattgtacatccctgttggtagggaaagtatgaaaggagatagaagaagccccaaatggttgtagaaattgtgctgcttagtgcagtgttcccatgaaataaaacataatcagagaaggggaacacagaactcagagttctgttaagtgcaatccatttgcacttaacaaattcacttgcttttaattatgtcttcaggtccaggtctctagactagaactctcttctgagcttcaaccacagctataattgaatattacctagttactgaaaactgtatatccaaaatgaactactaatttaaaataaactttctcctttttcccatgttacctatcatcattaaaaggcatggaaatgtaacccggagaagacagaggcctggaagaccacctcaatcattcctaatctctttcctcctacaaccaagacttctcaatacctctgaaatgcattttatcactctctactaccatcttagtccaacctcagatgactcactattaatacaacatgctcctatctagttccccaccttaaagcttacctctctccaatcagttctttaaattactgcataaatgatctttctataaatatgtatccattttctgcttaaaatcctttcatgtcttcccaatgccctcaaaataaactttaaattgcaaggcccattacaacagtctcttgtaaactttccagcttcatctcactcccaccagtgaactacactcagttctttgaatgtatcaagctctttcttccactatcttccccaatttctgccttctacctaacttatctttcaggatttattctaaacttcactgtattaaagaattcctgatatttagaaaagattatgtcaaacagttgtatgctcctatgtattaatgtcatgctttatttttattggttctttaaaatctgtgtccctgctagactatattctccatgagaacaggtacacagattttcttagtaacagatgtattgttagtaggatacctaatacatgttcaataaatacttcactgaatgaggtaaatggaatgcttagagaatgctattttagagaatgctattttaacactatggtaatcaaacttttccaagttatatatgctttacattgtattacaggaaaaagacatgtttatcaaatacattttaaaatcaagttgttaactccttcaatattctcagtattagagataacatatttcagtaatggcatgaacagggtatttgtcttttgttttttattatatttggtctatatttgaggccaattccataacaatctgataatggctatcggcttatgactaagccatgaaaagaaaagtttataggccaggcacggtggctcatgcccataatcccagcactttgggaggctaaagcaggtggatcacttgaggtcaggagttccgtaccagcctgaccaacatggtgagtctctactaaaaatacaaaattatctgggcgtggtggtacacgcctaaaagcccagctattcaggaggctgaggcaggagaattgcttgaacctgggaggcggaggtttcagtgagccgagattgtgccattgcactccagcctgagcagcaagagtgaaattccaactctcaaaaaaaaaaaaaggccaggcacggtggctcacgcctgtaatcccagcactttgggaggccgaggcgggcagatcacgaggtcaggagatcgagaccatcctggctaacacagtgaaaccctgtctctactaaaaaatacaaaaaattagccaggtgaggtggctggtgcctgtagtcccagctacgtgggaggctgaggcaggagcatggcgtgaacctgggaggcagagcttgcagtgagccgaattggcaccactgcactccaccctgggcgacagcgggactccgtctcaaaaaaaaaaaaaaaaaaaatgacagggaattttgagttaagatggcagactaaattcatatgttaaaattacattctcctgaaaccctactaaaaaacacactgaaataatctatttttaaaagataaaatcaagctgtggcatggtggcatgccggtaatcccagctatttgggaggctgaggtgggagaagagaattgcttgagcccagaaggttgaggctacagtgagttatgatcacactactgcattctagcctggacaacagagaaagacccaatctcctttaaaaaaaaaaaaaaaaagacaataggaaaggagaaaaacaacttaacaaaggcaaattctcagttgagagcagaaagaactgaaaaaaagaatccagtttataacactcctcagaaggctgagaaactaggaaaactggccacctttggaaataagtgggagaaaacccaagcaacaagagatttaattatctgcagaagtcatactccctacatctgcttcctaggtttacacactgagaagctgctactctcatttgtgggatgcaggattcctgggtgaccttaaatggaacaatgggatgaagactgaaaataggaccaagaaaatatgggcatactaaatgtggacaaccccatcctgctcccgctgccagaccccacgtttccccactgaattctcagaaagctagcagccagatctctagcctccaagtatgaggtttgaaaagactgcagtggggaacctgagcagttcaagaagaacatctaaagatacggaaaccagagggttcaccaaatggtcagcacaaatcaccccactaaacttacaaatcgacaagcaccaccacatacagaaagctttctaatcaactacttaattccttttttaaaaaataaaaatactatctatccagtctccatctttagttcttcacttttaatcatgcatgtaccataaagattatccgactatggtctataacaagcttgtccaacctgcagccaagatgctttaaatgcagcccaacacaaattcataaactttcataaaacattatgagactttttatgagtttttttttttttaaaaaagctcatcagctatcattagtgtattttatgtgtggcccaagacaatgcttcttccattgtgggccatggaagccagaagatctgcaacacccctgatctgtaacatgaaagacagagacctgagaacataaaagacaatttggaattaacagactaagtaggaagaaaaaaaatcttaaaaaagattaaaatcctctgagggataatataagatacccatgaggcaagaataggatgctacaaaagaaacattcaaagggaggaaagaaagctcttgaaataactgaaatagaaataaaactcagtagaggaagataaaataaggacatgaattggaaagaagcagagaaaaactgagtatgtttcacatctgaaaagcagaattctggaaaaacagagggaattgttatcaataatatagttcaagaacatttcctaccactgaaggatataagacagcagactgaaagagaccactcagtgcctaacaaaacagattttaaaaatcaaaaatagacaaaaacagacgttatcctcatgaaattttagaacactgaggacaaagaatttcccaaaatcttaacagcttccaagaaaacgcaggtcacatagagagaaccgagttcttcatatactagaaactaaaagacagtggatcaattgactaaaattgataaatgaaaatgtatttccaacctggaaaagatgagtcaggtaggaaggtaaaataaagacattttcagaagtatataatgctcaaaacttaccttccacacattctctgtcagggagctatggaatatacgttccacccaaatagagggaaaaaataaagagaaattcatgaaattgcagaaaacacatgtaacacaggagagaacagaagatgatctccaggatgatgaagaggaaatccccaagttaatcatatgtaatggtttgtggccaaggataacactggatctagtacaaaggccacctttcacctgaaacaatgcacacaaggacagtaaaaaccaagagagcacttttattgatgaggttcatagtgacaccagtaagcatacatgttgagacaaatggcataaagtagcacatacagtgccctcacacaggtggtatcactgtaggctaaagtctcttctaaccaacatcttcacaagggccttctgattcccacaggctgaaataaagaaaaagaccgtatcggccaggcacggtggctcatgcctgtaatcccagcaccttgggaggctgaggcgggcggatcacgaggtcaggagatagacaccatcctggctaacacagtgaaaacccgtctctactaaaaatacaaaaaattagccgggcgtggtggcaggtgcctgtagtcccagctactccagaggctgaggcaagagaatggcacgaacctgggaggcagagcttgcagtgagccgagattgcgccactgcactccagcctgggcgacaaagcaagactccatcgaaagaaacgaagaaaagagaagagaagagacgagacgaggacagaaagaaagacagacagaaagaaaagaaaaagaccatatcacccaaatatgagaaattctcccatatatacatacttgtatctagatgactaatctctggaaagctataagaaaacactggttctttccaaggaagggatggtcaaaaggtaggctaacttaacactgttcactctttttaagacctctgtatttcttgtatcatgcacaggtattgcctattcaaaaacaaacctacaacagggaaagactgaaagcttttcttcaatatctgctacaaggcaaggatgcctactcttaacacttatattcaacatagtcctagccagagcaatcacataagaaaaggaaataaaaggcatcagcagaaaaaagcgggtaaaattatccctgtgtgcagatgacatgatcctgtatgtagaaacccccaaaaattccacagttactagaataaatgaattcagtcaagtagcaggatacaaaatcaatatacaaaaatcagatgcatttctttatacaaataatgatctgaaaaaaaaatgaagaaaacatttccatttaaaataacatcaaaaagaataaaacactgaggaacaaatttaatgaaggaagtgaaagctttatatactaaacactataaaatattgacaaaagaaactaaagacacacagccgggcatggtggctcacgcctgtaatcccagcactttgggaggccaaggcgggtagatcacctgaagtcaggagttcaagaccagcctggccaacatggcgaaaccctgtctctactaaaaatacaaaaattggccaggcaggcgtggtggcaggcacctgtaatcccagctacttggggggctgaggcagcagaattgcttgaacccaggaggcggcagaggttgcagtgagcggagatcacaccactgcacttctgcctgggcaacagagcgtgactctgtctcaaaaaacagaaaaaaaactaaagacacaaataaatataacgatatccccatgtttgtagattggaagaatattgttaaaatgtccatactatccaaagtgatctacagattcaatgcaatccctatcaaatttccaaaggcatttttcacaaaaatagaaaacacaattctaaaatttgtattaaatcataaaagaccctgaatagccaaaagaatcttgagaaagaaaaacaaagtagaaggtatcacactacctgatttcaagttatattacaaagtgatagttaacaaaacagtatggtactggcataaaaacagacacatggatcaatggaactgaatacagagcccaaaaataaacccaagcatatattatgagctaatttttgacaagtccaataagatacaatagggaaaagatggtgtcttcaataagtagtggtaagaaaactagatatctatatgcaaaagaatgaaactggacctgatgcctatcttacacatcatacataaaaagcaactcaaaatagattaaatacctaacacctgaaaccataaaactcctagaaggaaatataggagaaaaactccttgatatcctccttgacaatgattttttggatatcacaccaaaagctcaggtagcaaaagcaaaaataagcaagtgggactacatcaagcaaataagcttctgcatagcaataaaaaaaaaaaaaaaacaccggggtgaaaaggtagcacagggattaggggaaaatattggcaaaccacacatctgataaggggttaaaatccaaaacatataaggaactcacacaactcagtagcaaaaaaatcccaaataactggattttaaaataggcaaggacctgaatagccatttttccaaagtcacacaaatggtcaaatggtatatgaaaagatgctcaacatcataatcatgagaaaaatgaaaattaaaaccacaatagatatcatctcatgtctcttagaatgactattatcaaaaaggcaaagacataagtgttggtgaggatgtgtagaaaacgaaacctttgtacatggttgataggaatgtaaattagtatagccattattgaaaacagtatagagtttccttaaaaaaaaaaaaactaccaccataagatccaacaatgcctctgttgggcatatattcaaaggtaataaaatcagcatctgagagagacatctgcactcccatattcatggcgacattactcccaatagccaagatatggaaacaaactaagtgtcctgatggacaatttacttacccattcaaggacagatgaatggataaagaaattgtgacgtgtgtatacacatatattaagtcctcccttaatgtcatcaataggttcttgggaactgagacgttaagctaaatgaacatacagcaggtcctcaagtaacactgtttccttcaatctaattttggcataatgcaaaatgaaaaaaaaatcagttttgtcatacttttttccccctcttaaccacagtttctaagaacttactgatgacaatgaggactttatacaatggaatagttagctttaagaaaggagacactgccatttgtgacaacatggatgaaccgggaggaaagtatactaaataaagtaagccagacacagaaaaatactgtatgatctcacttaataagcagaatggtaggcagcggggtgagaagctgaacgtatagagagtagaatggtggttatcaagggtctggaggtaggggatgggtgggatgggcagaagtaggtcggagggtacaaatctgcagttaggtaagacgagtaattctagagatcaaattaatacacagcatgagaaccacagttaataatattgtaatgaaaatttgctgaaagagattttaggtgtacacacacagagagtaactatggaaggtgaaggatacagacatttgtttgaccatagtaatcatttcactatgtatacaaagcatgttgtatacctcagatatgtgtaataaaaataaatgaaaaaaaaaactgtatcctacctgccaaaaacagttttaaatgcattatgtctttggatttagcaaggaattcacctttgcaggcccacttacatacaacattataaatataccaggtgattcattgtactattcacagtaaaagactgaaagaaagccgagcgcggtggctcacacctgtaatcccagcactttgggaggccgaggcaggcagatcacgagttcaggagattgagaccaacctggctaacatggtgaaaccccgcctctactaaaaatacaaaaaaattagccgggcgtggtggcaggtgcctgtagtcccagctactcgggaggctgaggcaggagaatggcgtgaacccaggaggcggagcttgcagtgagcaaagatcgtgccactgcactccagcctgggcgacacagcaagactctgtctcaaaaaaaaaaaaaaaaaaaaaaaaaaagattgaaagaaacccaaaggtctatcaacaggggaaagaacaggtaagttaaattgcttatatttccatacaaaggaatatttgcagccataaaaaaatgaaggacagtaaatagtagtaagacaaaaggaacaaaatatatatatatacacacacacatacacacacaaaatatatatatatacacacacacacacacacacacacatttccttatacatgcataaaacacatctggaaggttacacaagaaacctctgaggtttctggagatgtaaactgggggcatgaaggcaggggaaagggagagacttcactgtttaccttttaattattttccaattttaaatcatttgaatgtataacttgtctaaaaatcaaattttaaaagttgagggaattaacattacagaaagtaacaaacctcaaggaagcagccaccttcaccagatggatagtctacctcactcttcccactctccagtagttactgaatgccagtcccctccctccattcagtctgccccacctgctggccttctagagcctcagtgcagtcctattcccacacctcccaacacatccatacactgtgatggtcgatctgggaccaccagttgagaggaaatgtgttgtgtttccactcttgagacaaacagagtgttattttattgaggtatgggatttttttcttgcattaacagggtttctagatcccaggaggtgaatgagaaagaagtatgcttttattgcataaggaatttgtttctgatacaccaaagtgatgatgtatgacttttcttaaggaagcggttattagaagagttaaaaataaatagaaacaaaaagtcataggtattgttccaatactccaggaacatcacagtttggattctgtagatgtgtgtaatataatgtgtaatattacattctgacaacctcaagttgaaaactgcacagctgaagatcacttatagtcaataatacttttcaaactttaattttaaattcatcaagtctctccctaatgtattgtactttttaataaaggaaactgtcagatatgctataatacagaggaaaacgtttatatactctttcattataatttttccacaacttccaaaatgaagaaaaagacatggaaacattaagctcatagaataattgtggcagacaattccctcatcctaaaagttcaattaccccaacacaggcataatttcttactaactcaaaaggaactgaattcacatataaagacaagcatgggattctgttgagttctgttggacacaagacacaattgctcaagcactggttgagcacttgtattctaatagctcacggttactgagcactccatgtgtgggaagagccagtgctgggtgcctggcatgcatccttgcacctcatcagcacaactatcctatgggctcatcctggttcacctattttataaatgagaacactagcatcaaagaagttaaaaaatttgcctaaaaacacccagagtaggtttcatcattgcccactactttataatgttttcccaagggtactgagacattatcaaaacacgttagtgaaacagtctaaaacatcacaaattttaggtttaatacaaaatacccagaaaagggcagtgttattagaaatctcagcataatgtaataataagaacttacgatgattgtattctttccctattttttctcctgtacaggcatatgaaataccataaaacttattttaggggtgtgtgtgtacatgtagtttcaggataatatagtaatctaaaacatttttaatatggcaaagtgtggcaatactgaatttttaaaagggatttttatttagcaaacagaaagcaaaaatgttgtccaagtaacatgcacttattttatccctaggaatgtacctttccttctgcaaaggatgtgagatcctggcacgtaaatgaacatgagggactagtcatgaaaatgctgtatattcaattccttaaattctaaaattgtcttagcatttaacatccaacacactaaacaatcttttttcatattcaataaaaataaggacaaattcagtaaattcagatgggctattttatcacgtaaattttaaaaaagcaagggtaatttttcaactgattttcttttaccctgatacgagtcaatgagaaaatatgaaattgaaacatatcaccatttctcagtttacaagtggtagtcacaaggaaaaccttccaaggtcttttgtgttgtttttaaaaggtattataatctcataatttgggaaacaatgtgtactattatcaagaaacctttcatattttgtgaaatggagcacttcccaaatttaagagactatggaaacctttttcagacattttttaacatcctcagaaatggaaattcttgttaaagctgatctgatcaattcctcctaagtatatggactacttctttgcaaactccaactgcccaaatcaaattacctgttcaattgtatctgaaaatcagttacatacaagcatcagaaagtgtttctcccagtaacatagacccaaaacacactacaaaacaaaaattatcaagaacatacaaaagacatatcttttcatttatttatttattttttgagatggagtctcactctgtcaccaggctggagtgcagtggctcgatcttggctcactgcaacctctgcctcctgggttcaagcaatcctctgcctctgcctcccgagtagctgggattacaggtgcctgccaccacacccagctaatttttgtatttttagtagagatgaggttttaccatgttggccaggatggtcttgatcgcctgacctcaggtgatccacccgccttggcctcccaaaatgctgggattacagattataggcatgagccaccgagcccggccacaaatgacataccttttcaaagccacaattacctctcacctggaccattgtttctcactgatctacctgtcataactcttgcacctaatcatctatttatatcataggagagtgttcctcttaaaatataaataagatcatggtgttcttcttttcaggaacattcaatggcctcccattccattgctattaagcacaaactactgacacatcaccttatggttgtgtgagatatactgagccgtccttcttgtcctcacatctctaatcttctcaccttctgactgtcccctctgctcactctgttggtctccacaacactctttcttcaaacatgctcagcacactctcacccagagcctttacatcggcttcctcactgtctgggatgctcttctctcaggtaatcaagtggctcactcactcacctctttaaaatctgtgctcaaatactgctttctgttcatatggaccctaaacacccatctgtacttccaattcctttttttttttttggagacagagtcttgctctgtcacccacgctggagtgcagtggtgcaatctcagctcactgtaacctccgcctcccaggttcaagcaattctcctgccttggcctcccgagtagctgggattacaggtgcatgccactgagcccggctaatttttgtatttttagcagagaatgggtttcaccatgttggccagtctggtctcgaactcctgaccacaagtgatctacctacctcggcctcccaaagtgctgagattacaggcatgagccactgcgcctggccaggcaattcttatcaaactttatttttaccatgggacttgccaaacacattataattaactgattttttttaagagttgggttacctaacattaaaatataaactctatgcagagaattctacctgctttgtacactgatatgatttccaacatctgacatacagtagatattcaataaattctattgtctcaaagccagctgcagtggcgcatgcctatagtacctgctacttgagaggctgaggcagaaggatcacttgagcccaggagttggaaaccagcctgggcaacgtaacaagacactgccccttaaaaaaaaaaaacaaaaaactatgaaataaaatataatcaaacaaataattatcacttcatttctgaatcagttgaaaataaataaccgccccaaaaatgagcaaaccaacagtaatcctctttaactcatattggattttgggttactattaaaatattttgctatctcaagaactcagcaggctgagcagagcagatggtttgagcccaggagttccagaccagtctgggcaacatggcaaaaccccatctctacaaaaaaatacaaaaattagccaggcgtggtggcccgcatccatggtcccagctactcaggaggctgaggtaggagggtcgcatgaacccaggaggcagaggttgtagtaagccaagatcgtgtcactgcactctaacctgggcaacagagcaagaccctgtctcccaactgaaaaaaaaaaaaagaattcagctagaaaaaccttatatttactttgatcaagaaaatgtttataaaccaatactttatgatgcacactggtgaatatgaagttatacctgaagtaacattaaatgacagcttttccatttctagaatgtatgcatcaactaccttaactgaaacatggtattatccaagctcacagtatctgagaaggtttgtgtcgttatctagcaaactaaagtcaagccctctgtagttccccacctgtgatcttcaaagatatggtgctccttgagatttctgtaaggtaggtctgttctaaaatgtgtgaaaggaagagaacctgaaaaggcaaggtctaagaagatcactcatttggaaatggcaagggtcagtcacatcaggggttaactaagtcagtgtgatttaccctttggtaaatcatacacatatttcaaaagttactttatatgctttaattcttgcacacatatttcatggaaaataaattagtattacctcgactatcatccatttcaccatcccttgaatgctctgattggatgtctggaggggtctgaaggacggccacgctattctgatttataatcttcaatttcaattttggttttgaccgttttcttcttggaactgtaactgtgaggctctgtaactgagtcatccctgattcagtcaaacacacaccatcctgggtataagtcttgggtgggtctaaaattacaaaatcccaaggatacaaatttaaactttcatttcaaatttgactgattactgttccaaaatacccatgtcaagggaatgtgactgtagttctagaaagcaattacgtatctatgaaatgcatgaataattaacttcatgatacccaataaaaactatgaacaataggtcaaatttccttggattacaggcagaaaggttgcatgtttttaaaaaatggtcttcctgggccaggtgcaggggctcatgcctgtaatcccagcactttggggggccgaggcggcaggcagatcacgaggtcatgagatcgagaccatgctggctaacacagtgaaaccctgtctcttctaaaaatacaacaaattagccaggcgtggtggcgggcacctgtaatcccagctatgcgggaggctgaggcaggagaatcgcttgaacccgggaggcagaggttgcagtgagccgagatcgtgccactgcactccagcctgggcgacagggcgagactctgtctcaaaaaagtcttcctggaatttctattttcatgtcccaataaaaagagttagaagcactgcaactaaatgcaatgctcagctaatccactatgagcttcttcgtagaaaagatcaaaaggcagggatctatttacgtaagagaagagagaatactccagaagctcatctggaaaaatcagagtatcaacataattactaatagggagaagtaataaataagtacaaatcctgcagatttaattttaaatgtacaaaactgttgttccttagaacaattcctgtactatccaaacatttttgtatcaggtgctattaaatacaaatattcaaaagaatgactgtttaataagaatatcatatgaatcaccatactaggcttattaattattttaaaaattaagagattgaattaattctaaaagaaatctgttcgctaactaggccgtgttttctgctaactgataattaagcacagtaatatatcaatgaaactaaagcaagtatggcattaatggttattctaagagctgttatttttgttgcctacttgctgaaatttataggaatactgccccagtaaagctggatgacattttatatatcattgtggaaatgattaccaacattacagaatttggatagaacacccatatgattgaagcaggtttgacaagtggtaagccaattatgtaaaaattaagcaaagtaaattaattaaatcaagtaaagcatttcaaattttacctagctcttttacttttgtgacaatttgtgctacaagtgaagattcacagcagtctgaggaaggcactgaaacgaaaaaaaaaaatccaggtaattcttttcagaaaaggtaaagtgtatttaaatacttatatatgattataatttctgtttctatactcattttattaaaataaatgtttgaacactaaagttaaaagtgctttttaaagcaacaacaaaacaagaagtgatgaaggaaatactcaagtcatggaggaaaacctggctaagaaacaatcaacatattggattctgacatattgtcaataactacaagatcatgttccttggaagcaaaattatagtttacatctaaagtatatgctttttattgtttcatgtaaattgttttataacaagttgtgataagtcatgtataaccaaaaataatatttttcataaaatacttgtcaaagtaagtttcacaaagacaaaatagagtagagctaagctaattcattggttatggacagtaaggtgcaagtgagtggtacaagagtgcagactcacagtttaaattattctcttaccattagacgcaggcatatagggtctgcacatgctacaatcaaaaccaatgtctgctacattttccacttcttcctcagtatttaagttctgacaaactgcatgcatccatctaaaaagaccatatttgtacattttttttaaaaaatggaatatactgagaactgctaccttttaaaacctgtaacactgagtcttcaaacttaaaagccctaagcctcacatgctcctcctaccttgcccttttctcctaactatctctattaacagaaaaactttcatacagctaagaaggaaataaaaaggaatgagaacaactattagagaggaagcaaagcacattacataaggaagctaattattttatcatcatatattaaatatttcaaagacagaaaggaagctagttagggcaaacacaaaggtattcagaaaactgcaaatggcagtgctagcaggtatgtgctccaggtaatgcatctaacttgaagtagacatatctcacggaaagcgatgttgaatggtaatcgggaaattaagtaaaaagttgtcttgcaatggaacaaataattagtagccagagtcccaagaatactgtactactgataaaataatactattaataatatatgttcacttcttaacttctaaagagtacaacaatataccaatgaaagcaaggaaacattcttgattatgaaattccacataattacgtagggagggcagaaggtgctatctaatatctagatatctagtatctagagctttaagaaaaagtggtttaaggagaacagaatgtgttagatattttttataatctattagaagattcagaaacccttcataagaaacggcatagatgaaggcaataattctccatctaatttcaagggattcctaaaccctcaaaaaggcctaaattaaaaatctttagtcttgggcgggcacagtggctcacacctataatcataaaactttaggaggctgaggcgggcggtcaaaagatggtcaaaagatggagaccatcctggccaacatggtgaaaccctgtctctactaaaaatacaaaaattagctgggcgtggtggcatgcacctgtagtcccagatactcgggaggctgaggcaggagaatcgcttgaacccaggaggcggaggtggaggttgcagtgagccaagatagcgccactgcactccagcctggtgacagagcaagactctgtctctaaatttaaaaacaaaacaaaacaaaattttagtccggagttgagaattcaaaacaggaaatcgcttctgtaagtttctaggtgactaaaaatctacaaggcaaaaagttctgtacctaaaacttgtgattaaggaaaagctattttccatttgtttttttttttgctacatttcaaagagaaaagctttaaaaagatgaaaaaatagcacaatacctatcacattgtctacattgcagaataagatcttcttctctatagtttcgatagcagactggacaggaagataagcttgcacaaggagcgcactgtgtgtaattgttctgccattcacatcttagacctgcagatgttgctccacagtgtctgcaccaaacacacctgaaatccaaatccccccgaaaagtctcaattttattttcttagttactcagttactgtaattcaggaagctacatacgaacataatgggggaaatgatttaatgtgtatgtgaaaatttttctgattactggtatctatcatagaatatgtgtattattcaattaaataggtgtggctaatttttaaaaaccaaagtggtatgagaaagctctgaacttgaaagactaacaaggcaaacaaaccctagagtaccatttgcacttccagcctcctttgggaactgtctgcaatggagggtctaggcagtaggtgtgataacttatgtcacagtcatcacacagcaggagtcttcctgggtcagttgccttcccacaggcctcacacacagtgcactcaagacacctccaacctttgctaagaaccactttagtgatctgtaaaagaaacaaccaatccatgtgatttatgcattaacctaacataatcaaatatactatataaattaatatggtgcttatgtacctagaagcagaaaagaggcaatcaactaacatttattgagcacctacggaggcccaatactgggttgggcatgttcatacacgcttttagaagcctactgagcagaataatagaaaatggcacatattttaacgcctttttaaagtccacataattaccttatgctgtacatttaatgtccactatatttatagatatagtgaccagattttaaagaaatcaagtaagcttccctattattgatacataatttgaaaatacatcaacaaaatctccatctacatttccatgcttagaatcaatagaaaaaataccaaaaaaattaatgtaaggcatgagttcttagggacattttatgatcttagaggatttctatttagactatgaagctaggaattctgaagttcacattcactcctctgtttattctcccctctctcaagggtataagttagtagaatatttgggaatctccaaatccctaataaactcctgaaggaagccacaccatgtaatattaagattgtggaacttcttaaagatctcaaaagactaggatcctcagacagaaccaatcaagtgcccacattataataaaacagcaagtaatgagggtacagaataaaaattcagatcatgaggtacatgaaagcctaaaagctaccagagaagaaaataaaagagttaaattcaaaggaacacccatcagaatggcaccaaacttcccaactccagatgctagaagagtataagtttccaattctacaggaaaatacttttcaaagtacaattctcaacctagctacacaagcaactatgtgtgaagacagaacacgttgtagacacaggaagactcaaaattcagctccctcattctcctttctaataaagttacttagagatatgcggaacagaatgaggatgtattataaagaataggaagacttgggatctataaatcaacagatccaacaaaggacatcaggccaggaagtttaaggatgagaacaacatacctagaagccactggcacatatcagagcaggagaagggaatgtctagaaggagggtaggacttctcccagaaaaaaacagtactttaaaaactaatcttatatgatagttctagagtaggcaaaaacaaagaacgaatggagagtcactattactttcttgttataaaaaactccatgaaagacaaaagaaactcatagtatactgtttagacctgcagtgaacatttactgagtcataaccaacaccttattaattgaactaaacatagtaatacaactatattgggagaaggatggaggtgtattttaagacctaaatcagaatttatttattcatagcagaaagtcaacaaaatctagcattgataaagcagtaaaccagttgattatttagagctatagcattaaccacaagaaaaaaagacctgaaaagattaaaagcgactgcctcagacgtggaggtagagtaagacaagagttggttgttcattacaaggccttttttttttttttttttttttttttgagatggagtcttgctctgctctgttgcctaggctggagtgcagtggtgtgatctcagctcactaaaacctccgcctcccatgttcaaataattctcctggctcagcctcctgagtaactaggactacaggaatgagccaccacacccagctaatttttgtacttttagtagagatggggttttactgtgttggccagactggcttgaactcctgccctcaagtgatccacctgcctcggcctcccaaagtgctgggatgacaggtgtgaggcaccacacccagcccattacaaggcttttaatgtcatttgatttttaaacatgtatatttattattttgattagcttattgatttttaagaatttgtcttagattaccaagttaatgtattatttgcccaaatgaaggaaatggcctaggggtaagatcagggtggcttatggcagtagccagcaaacatttccaataaagggccagagagtaaacagaaagttttgagggccatatgatctgttgcaactttataaaaactctgccagtgtaatgcaaaaaccgctacaaatatatgtaaacaaaagaacatggccatatttcaataaaagtttatttgcaaacacaggaaatgggccagatttagtctatgggccagtctgcgtgaccctggcttaaacaatgacctgaagataaagtggcagacagatctgaggtgttcagtggcagaattttaaaaatatttatcttcattcctactaagttttcttcacagatacctgtggtcccttttataaccaaactctcaagtttctcagcttatattcactcttcaaaacactacagtctggtctctacacccacatccactcataactgcttaagccaggcttgtcaagaccttcttattctcaaatctaatggaaacattagtgtttgtgtttcttgacttctagtacttcaacacttcaacaatttctccctctttgaaatttccttttaacctaggtactggggttgtactatcatttttttcttccgttgaaccagtctagccttagttttaaaagttttttcaaataagatgtcatccaggattccatccatggtaccatgtccaaagttgttacagatatgttttataatctaatacggatacacgcttcaactataatggagtaggtgggaccagcctgttctcccataagatagtagaaaatgggacaaagtgtatgatacaactgttttcagatattggacaacacatagtacaggagacagtggtctctgagaggaaggaaacactcagggagtcctatgatattctgcctagaaacattttccagaatgctgcccagggagggagaacctcagcagagtacaatcaatggcctcgctgaggttagggaaggcaaggcagtggaatttgcaggacacagtactcaaaatgaagaagcaataacgactaagagctccagaaatctacaaaggatcccctgaagtctttggtggaacaccaagccgtacttctagaagcccaaagacccacaaccaggggaaagtacatctactgggaatttgtaagctgcacaattaccacagcttgcaaaaggctcaaagacaagtgaagcacaaccagtcagagtacaaagacactggtgaacagggagcagaattcagtagtgatcccagaaaggccaagtcttaagtatagggttaaattaatgctaggaccgcagctaccaaaatgtggtctagggaaccccagtgagtctgtaaagttaaaacaagtttaaataatactaagatttaatttgccttttttcactttaattcattcacaattatacagtggtgtttatagaggctacatgttgtatcataatattacattgatattgtacaggttgtgcttctgtagtcttgtgttataaaatgttcctagttttaatttctaaaatgctgaacagtccatagttaaaatcctcataaacaaaaactatggagtccccagtaattttaaagagtgttaaggttctaaaaccataaagtttgaaaatatccaccttagagtgaagactttctagacttgccccagcaagcttaaaaagaagcttcaaaggtatcaaacttatccacaaacaattgcctcctacaataaaaatgcaagctgagccaattcacatatccctagtatatttctagatactgctgtatttctcaatgagactgcagtattctatactgtccaaaacagtgtcatcgtgcaaaaggaaccatacataatttttaaaaacaggaattcaaattctagctctaccagtaactatgtgtttgatagtgcactaattgtccaatcttaacttatgtaagtcgtactcatctgtaaaatgggaattcggtaattgttggatgggttaaaagaaatacattactatcttgaaagggatcttattcaatttccttaggtccaaaacattaagtattctaaaaaacaaaatctaatgatagcagcaacttttatacagaatataaagtacaaagaagaaaagaaacatgttttatgcatatataactctattttttaattggctttatatactctgtgtttttcagtcacataccatgagcaactaattttaaaagactacataaattaaccgtactagtcttctattttggatagtattaattacaatctttcattttgattcctaaactcacaaaaacctgtattaccctataaaataaatactagtgtagttatcaacaaagaattctgaaggagataatgttgatttgcttactatactgacattttactgacaatgatataatacagtgatgtttgaagggcaggggagaaaggtataaaaatcactcatggttcacaacctgttactgaaactgaggttagtatttatattacatggtatggcagtactagaaaagatttccttgtggagtatacagtttaagacctctgctgtacagctatacctccatgcttgcttccagtggccatgacactttattcaaatatgtaagttttattaagactgagttcttaaaaagaaaaaaccaagaaccttagatacaactagtgaagtattgagacctgtccatatttaaaaccaagcacacgataccacttaaaaggttccccagaaagcctctatcctgaaatgcttcaaagtgagcagcgctgactctcgattattaccaattgcattaaatatgacacttgttttgtttcttttggctataaggagaaaatgtcattttgtatacgagtgagcatagaggagagagaatgcgggaaagaacagaatgggctaataattttttactaaatattccagttctcagctttttaaatcagcagacaaaatgaattagctaaacctaaaatctttgtgaatactataaattgtcttttaaattaaatgcatatatttttatgttttactttttcaagacaagtatattgtacaatataagatttatagaggagcaaatttcttgagataggaaacccttaaaagcagtattttaagtatttaaatactgtcacatatgtttaataatcataatacttaattgtgagaactgggagctcatgttactactaaaaccaaataaaaattcaatacatatttgttaactcaatttaaggatgtttaccttaatactgacacagtatggatggtaacactgaccacactgagaacaggcaagtaatcttccttctgctccttggccaaaactgccacaaactacacacatatcctgaagttaagaaaacagaacatattttaaatggagactaagctaaaaacctacaaattttactttaaaaataccttcttaactaatatagctctatagctaaatattgaatgacttctgtgtatatgagataaagcagaaatgtgcaaggaggaattcaatgaggaagacagtaaattgtcaagttcaaacctgattcaaagtgaacttgtcactgctagaaaacaacacaactgtattgtgcatagagttttcttcatcatccttatttgatgaaatatctgcagtagacacctataaaaagcaaaatacacagaatacgaagttatatttttcacttgttttacacttaactggaaagcttcagaaaattcataatcaaaacatatattttggctaaggtctagaataacaattccaaatattaatgctaagatactaccgtaaaatggagtcgtgacattttattattcacctaattctctctttagaggtagaattcctatagaccaagaagtaatgagaaaatataataaacctgtcttagtaagacttgattatgcagaattctaatcaggaaactataaatgataatatatgtatgtacccacacaaatctatcactattttaatgacacacacttgggatctgcaatgtagctagtctgaactgagatgtcctgcaaacataaaatacagcacataattacatattacgtgttgaaatggtaatattttagatatatcggtcgaaatggaaggcattaaaattaatttcgcctgttcactataatctttattttgttttgagaggagtttcactcttgttgcccaggctggagtgtaatggcgcgatctcggctcgttgcaacctctgcctcctggttcaagctgttctcctgcctcagcctcccaggtagctgggattacagttgtccaccgccatgcccagctaatttctgtatttttagtagagacggggtttcaccatattggtcaggctggtctctaactcctgaccgcaaatgatccactgcacccagctcactgtaactttttaatgtggttactaggaagttttaaattgcatatgtggttctcattatatttctattagcactgctttagaatattattttgaataacatcaaaatttcagtattagccatatgattatcaaccaatattgctcagtctggacttagttctatttgactaaatcaactaagtacccactggtttgttaataatttctagagtgattatgaaacaaaacaaagctctgaactagaagctgtagaagaagacaaggagggcattgccaaaatcataaaatacaatcctctttctttaaaaagcttacaacctaagcctggaaagacagagttgaaacacaacaggttatgttcaaggtcaaaacataaaacaactgaattacttttcttgaggaacaactgaaagaagattaaccagctgggtgtggtggctcatgcctataatcttagcactttgggaggctaaagtgggtggatcgcttgagctcaggagttcgagaccagcctgggcaacacggtgaaatcctgtctctaccaaaaatacaaaaaacagccaagcgtggtggcacacgcctgtagtctcagctactcaggaggctgaggcaggagaatcacttgaacccaggaggcagaggttacagtgagccaagattacgccactgcactccagcctgggtgacagagcgagaccctgtctcaaaaaaaaaaaagaaggaaggaagtttggttggttaactaaacagaaggactacatctcagtatttttcaatacaaatacatttaaaagcagtttttttgtttgtttgtttgtttttgagacagagtctcactatgtcgcccaggctggagtgcagtggtgcagtctcggctcagtgcaagctctgtctcccaggttcacggcattctcctgcctcagcctcccgagtagctgggactacaggtgcctgccaccatgcctggctaattttttgtatttttagtagagatgaggtttcaccatgttagccaggatggtctcgatctcctgacctcatgatctgcccacctcagcctcccaaagtgctgggattacaggcatgagccaccgcacccagcctaaaggcagttttaatggatagtactaatgctttataagagcaatttatagtcatatgaaccctaatgactacaagtgttaataatgccaatattcatcattagggagtaagtaaagcaatgacaaatccaaacattagaaaattacgcaacattttaaaagtagggaggtagaaacttgtatagactgccatgaaagaaattatcaaaagacgttgttgagtgaaaaaataaattgcagaacagtatttgaggtatagcactataatataaaaacatgcaaagtcattatatgtagtctatgggcatatataataggttgaatcataagaaattgctgcttttcatcagttcagaaataatattggcaatttcatatggatcaacctaatatataaatataccaaactgataacagggaaataagaaggactgaggagttagtaatggtaaattctgatctacctataatgctttaattttttttaatagagaaaatgtattgatgtgttacatgcatagtattaacaaaatcagctttctaagattttagagaatcatccaagatgattcacaaaagtagaatcatcatcatcagtaagaaattaagtgactactaaaagtaatcattaattcagtcatagaactaatgatgcattgacaagactattgagatatataattatggaaatggctaaaatagagataaagtatctatttctacctcccaaccactaacagaaaattcaacacattatacccactgagcagctcaaagaaattgtaaagatccattattatttttaaaaggaaatttaaccagtgaacgctttcactgaaaatgataaacaatatattcccagtataaaccagaaacaaagtctgcagtagaaaactacaatgtccctagattcaagtgggggtggggagtcatactgtcatatttaaataataagtgcagaaaaaccaaaatattttaaaataattgtccatgcaagaaagaaaatagtatcatctagcttgaagacccactgtttttattttataatttatttcatgaccgttagactgctagaaaaataaaacctaccttgagggcaaaggtaatctttgagaaaatacgtgctattgttgcctgcatagataatagtgtgatttatccagaaggtgatagaaatttcattttcctagaccacagatatgagccaaggagaatagaaagttctgacctaaacttcacaagtgtcccttccaagcagggacacgtaagagtaaacaaaaaaagaagatcaaattaaactcaaagtgagaagataggaaaaaataaagatgataataaaaatcaataaaacagaaaggggaaagaaaatagacaaaagtccatgaaaacaaaggctgactcaagaaggtcaataagattgataaatctctagccagactgatcaggaaaaaaataagacaagatgcaaattattagtatcaagaatgaggaaggtgaaatcattacagattctacaggtattaaaataataagaaacattatgatcaactccattcctttaatttgtcaagatagacaaaatgaacaaatttcttgaaagatgcaaatttatgcaaggagagacagataacctaaataggtacctattaaagaaataaaatttgttgttaaaaactgtcccacaggctgggcactggtggctcatcccgtaatcccagcactttgggagacggatcatctgaggccaggagttcgagaccagcctggccaacatggcaaaaccccatctgtacccaaaacacaaaaattagccaggcatgttggtgcgcgccagtaatcccagctactcagaaggctgaggcaggagaattgcttgaacctgggaggtggaggctgtagtgagcagagatcacgccactgcactccagcctgggcatggtggctcacgcctgtaattccaacactttgggaggccgaggcaggtggatcaggagttcgagaccagcctggccaacatggtgaaaaactgtctctactaaaaatacaaaaaaaaattagccaggcgtggtggcaggcacctgtaatcccagctacccagggggctgaggcaggggaaatcacttgaacctgggaggcagtggttgcatgagctgagattgtgccattgcactccagcctaggcaacaagagcgaaactctatctcaaaagaaagaagaaaaaaaaaaggaaaacacaacaaaaaccccccacaaagaaaatttcaggccaagatggtttcactaataaattaacgtataatataagaagatacatttccactactacacaacttttccagaaaactgaagaggagaatatacttcctgattcattctatgaagctgtagttatgctgataccaaaaccagacgaagacattacaagaatgtaagactacaggctggggcatggtgactcacgcctgtaatcccagcactttgggaagccaaggtgggaaaactgcttgagctcagaagtttgagaccagcctggacaacatagtgagatgctgtctctatcaaaaattttaaaaaaggagttgggtgtggtggcacacacctatgggcccagctacttgggagacggaggtgggaggtcgaagctagagttagctatgatcgcaccactgcactccagccaggaattagaatgataacctgtctcagaaaaaaaaagaagaaaaaaaagtgcacaggtctacaaccatggtgcatccacagttttattaatactcagcaagaaaagggagtacactgttaacaaatgcaacagcacagatgaatctccaaataattgtgctgaaataaatcagtccaaaaagtgtacagttctgtatgattccacttatatacaactctagaaaatgcaaactaatcttggggacaaggacggatggcagggggaatgcagaaaattacagaggggcatgaagaagctttgggagatgaatatattcactatcatgattgtggtatcgttttcaagggtgtatatatatatatatatcaaagcttatggaattgtacatgtcaaatatagcttatatcaactgtacctcaataagcctggttttaaaatttttctttttgaaaaaaggacaagaatctaagcttccttattcctggtttagtagtaaacttgaacaatttcacctgtctcctatacttaaaatgacatttcagaattttaaaaacagaattttaataaaatagcgaagttattacataaaatatttgctagttagcaaatatatttgcaatacacatataaataaagcctcataacatgatagtaagcaaatatctatcaatcttaaaattttttaaataaaagagcaactatattacatactgactttttagagagggttggcatagaaagataaggagtcaaagaggaaggtaagaaaagagaaaggatgagaaagtaaatatacaagaaaacataaccagaggctcaaaaaaaaaagcaaagtaggacagtaaaataaacattttgacctatttatatgactcttaagatcaaaataacttgctatgagattttcatcattaactgacatttagattagagaaaatatacatgaagcaagcctcaccccaggtaatacaacagctccgattccacttttcagctttgacctgcctcggccacctcgccccgacagtcctgcacctcgaggtctccgctttcctggaaatccagacccacggccctatgtaacagattgggaaaagtcaacattctgtgacagaccaaaataatttttaaatccaaatgccactgagataaaacattttattaaatgttacacaaacacttccttagataagtattaagagacctggcttattatttttatctttaaacgtatactccacaacttaaaaatctaaatataaaatgcttacaaccttagaatcataccttaggcctgtcactgtgaatgctatcagcaagcctttgcatgatttttctctttcccactcctacattcttggtgacgacaacaactatagcctgatccagatatttcgaagtgcaacaaattgtattcaatatagagtaagtataaggaagaactctctcattaactggtctcgcggtgattacaataatagctaacatctattgagtacttactatgtactaatctaagtattttttactctcaacaatcccatatagtaggttttattatccccatttgagatgagtgtgctgaggaataaaaaggttaagtaacttgtccaaggtcacttagctagcaagtctggctgcagcgtcccggggttggaagcatattctgtactgctacatcagcgtgaaagttcatttttgctagtgttgtgtaacagtattcttcctctcattaaaattaagtcagtttccttcactattcaacagttctcttatgaactcaacatttctacctcattcaccattgtatttagaggaaaatttatcattattgttattacttttatttttgagacaagaacttgctccgtcactcaggttggagtgcagtggtgtgatcatagctcactgcagcctagaactcttgggctcaagtgatcctcctgcttctgcctcccaaagtgccaggattacaggagtaagccaaagcgtccagccaggaaaaattatttgaggattataggaaagctgacaaaaggctttgtgaaagctttgctttaaataatctgaataataaatacttgaaatggaaataatttatctgacttcttacacaagaaataaacctatgggaaaatgtgttaaattccctgataatttcagacattaagtaccagagtatggtgttccctgccccctcacccttgtttgtactaattaattactccttgaaaaaacctggcacctccctaagtagatgaattatgtatatttaaaattatccagatgctcaggaaaatacttagatgtttccctcacagttaagttaaataatatgtcatatcttcaactgatgtcccttatcatagtttgaaatgaacttattccctatttagcagaatggtttccaagtcaaaaatttatggtgatactgtaagcataaaatagatacacatgaacaaaaggaacgggaggaatggcttttttccctttggatgtaacaaatacagccagctcccagtttcaaactgccactcctgtcttctcttaccctgctctccttgagatcccttttgagaagtgcatcagcttctttgcacaacagatggatggcgtcaggttagttttttgggggttttttttgtttgtttatttttgagatggagtctcgcttctttgcccaggctggagtgcaatggtgcgatcttggctcactgcaacctccgtctcctgggttccagcaattctcctgcctcagcctccctagcagctgggattacaggcacatgccaccacacccggctaaatttctttgtatttttagtagagacagggtttcaccatgttggccaggttggcctcgaactcctgacctcaagtgatctgccccctcagcctcccaaagtgctgggattacaggcatgagccactgcgcccggccgagtttgttttgtttttaaattggtataaaagatttttgaaaaattaagttagtgattaaaaatcgagactacagtaatctctcaatttattttctcgaacatgaaatgctgacccagaaaaaaagtaagtgaaaattggtggtctatattatcaaactgtcaaatgaggtatatttatacctcaatatcttggatgatatcagggggaggtagggaggttaaaaaacaatagttcttccagtcatgaaagaaaataaagtataatctagaattccttaaaatccttgattagtctaaattaaacagccatattccagaatattaaatatagaatatgaagaaaaactgtcatctccagtcaatgaagtattttaacttttgagttaatactttttcaaattaatttttttctcttcaaaatgcatcacactacttaactcacttcaaggactggcagagccatcaaccaatgtcatgggggaaaaagccttgtcattttaaggtattaaccagacaatgaaatatgccacaattttggtatttcttctccatgagaacataataaattaatggagctttttcttttgcttttttctaagcaacaaggttttatgatatcatgaatgaaaaggtccttaattaccttttggtctacatgtcaaggacttctccctcataaaaacagtagtaatcacaacaaaaggaattaaccataaaaagaggtattaaaaatgtatacttgatttttaaatgcaagcatattatttctttacattaaaatttttagatttaaaaagtgtttcttggaagctcaatctagaaaagaaagatttaattcttaacatccagtagggcaaaacaaatcagacagaaatgatatatgaatgtaaatgcaattttatttaccactttgatgctccaaatggcactgccaggaagctgcctgggtttaaaaatttcccgaccttctgaaatgtctggggaccaggaaggtgggctcactgtattatgggtactccaagccccctaggatatggcagttgagaaaatagatgtgtaaaactcagcaacataaaaggtcaaagccagcaactaaggaattttagaacagcaaaaacaaatgcaaacgtatggaaatttaggacaaattgcttcaaggaaggcaaaataagttaatcactaacagtgatttaaacatttaagtataacttaaatgtttgctgctacaatttacattaaatattttattctgcctgagacatcactacaatgaaacattaaaaattaaggtttataggacatcaacattgactcatgaactgcaattactgcaccaaaaagtaaataaaagtcaatcacactttaagaattaacactagaagaaagtattggggggttatttttcttctaacaactatcactctacttaaaaggagaaatggataaccataaggaattctatattctatagctataaacaaccaaaaccagtaggccaaagaatgcaaggagaaacataagcaatcgataaatgcatacacgttaaactgtagagagctggtaacattaaaatgcaaataccattataatctaagcatttaatcactctttcttcagtgaccattagttgtcggtttggttttggtttttacttagggaaatgaatactttatggaaattacatccaatggacaaaagtgaagaaacgttaaagcaaattgtcctaaatttgcaaattaaaatgcctaaagtacctgataaattatatagaaagtagtatcttattaaaatctatataactaaaactaaagcattttacttccaaacaaccacattcagcaataccctgaactaatctgatgaagatgctaaacagcataaagaaaaatgtttactccacaaagataacattttaaagaaaaacaagacaaatgtcaaacaataaaagaatatattttgaattaggtaattcaatggtgcatgctataattttaccaattaagtaaccaaaacttaagacaaggtacatagtacttaccaggtttctagaatatcatcaaattaaaaagtactatctcattaatcacataaaaataccaccaggaattaaaataaccagaaataagaatgtgactactcttggggtaagagataggtaatggaataacagtattttgagaaaagccacacaagcaatagactggtttcatttttaagtcacaaactgaatccacacacattgaagtccagcaatccaactcattctctccagcaaacactttatttttttccctccaggattaccgttaggtgttctttcttacccatcaaatctctaacctagctcaggtaatcactatgctgatttcactgagcagcaaccactgcaggtcaattacctcactttcataatttccaatcaacttgaatctgtacctatgtcttcttccctactattagtaaggaagtgttgtcaaaagccatttctcttttctcattttactcatgctcctgacatctggcatactgttctgctggatttggcagcagtccacctgtggatatttcactgccttcctcgctaatctttcttcatctcctgtacgtgttcttcctctatttgacttccaaagccctggagtttcccagggcttgagcctagatcctaaatggtattatctacaatgagggcatcttggaagttgatgcttcccatattcttatttctagttttaatcaaagatctccaaattagcaggattttcaacttccttcttagcatttccattttctcacacaaaacccctcttaagtttgccatgtttaaaatttctcccttaaccggtttcatcccagtcttccccatccttataaatggcatccagtcccttgtcactctcctttgctccttcagtcctctcccccaacacttcatcaatgcaaatcatcagcaaattcaagactttttatcttcaagttttgtctccaatccttctacttcttgtcacttccaccactagcagctcagtcgtggccaccaccatctctcacctaacctgctacaagagtctactgctggttatgcttctccgaccctgcatctactgaagcctttccccacagcagccagagaaacttttcaaaagtacaaatgtgatcaagcaagtcactattctatttcaaaccttcaattgcttctcagagcacttaaaagacaaacctttcccaatgcctttctccaactaaccttgtggcatttgtctccccgctgctacgctccagctattctggcttccttgctgtccttcaaacatgccaagctctttatcaatcagagcccgactgactcagaacacttcactatatcattccagcccctcaataaatgtctggcattttctttctttctttctttttgagatggagtctcgctctgtcacccaggctagagtgcggtggtgcgatctcggctcacagcaacctctacctcccaggttcaagcgattctcctgcctcaagtctcctgagtagctgggattacaggcatgcgccaccaggcccagctaatttttgtattttaggagcgataccatgttggtcaggctggtctcaaacacctgaccttgtgatccaccagccttggcatcccaaagtgctgggattacagacgtgagccaccacggccagccatgtctggcgttttctaacccttcaggtatggccttacatattttctcaacagcagacctttccttagtgctcccggtgaaccatcatctctcttaccacaccattagtgcctctcattgcatcaccacctaggacgttttattgtttgtaattttatttagtggtaggcagtgggggcaaaagatacctaaattacttctctcaatatttccattggtttttctctgagatttggctaacatacatcttaaattccttttagtcgatagtttaatattatgttggcagtagacagttctcaaaaatatgagacagaaagtcgtactctaagataaaaataatgttgaataattttatttcagaagtaagaattttctggtaattatgtattattcatcataatttaaaagttagctttgatgccaaaattttatctcacttcaaaaagaagacagactttgtgtaattttatagttctgaagaaaaattatcattatacttagatattctgacaaattatctagtatattccttagaccttaaaactaaaatatagctataattaccaaagtttaaattatccttcagatcttagctttgatcaagaacttacacaaaccactcagaaaaggttagctgcccctgtaatgtatgggctcttcccctacaatccagttgcagcactttttacactgtaattaaagatcatgcccctttctgttcactgctatgttaagcaccctgttcagcacttattgaactttttttctgctgagcatctattatctttttttgcatatgtgtatgaattcatcaataaacaatgaactatgatatgaaacacactaatgcctccaccagtaataacctagaatcttgaatttcttcacttaaaaaaagttactaaaaattactaaaaaatctatataatgcctccttaatctacaaactgaattaaaagcaaaatagttcctaatgtaatcattattaagttgtaaatagaatcaacttgctatcaaatactacagaaactaaaaaaacactacctggcagggactgaatttgaacccaagaaaaataatttaacccaaaaacagtttaatattagcattaagtttctttctgttttgaggccaatttctcaggtaaactgtccaagctagtaagttatacaaggactgtgggatggggaaatgagaacaataatgacacgtggaggataggctatttagaagcaactttctattaaaagtcaaattctattgctggttgttaaatatgatcaaagtcactcttacagcccaagagtactatcagttttaaaagcagccagagaaggtttggtgtctcactggcaaactttacacctccaaatcctaaatcaaccccagccccacactcttccaacatactatgtaaaaccaaggttgcttataaacagtaagtctaatttaggaaaagtgaaagcaatgaagagagagagccgaaaggaagataactggtaaaagaaacaaaagagtttacagtttgtctttttggtaaatataatcacttgtatacagtggagctacagcagcaaacacttcactatttagggaattcttaaaagaagtctcatatataaaattgagttcgatatcaagtagaacaagaaattagacctaatcctgttttgataactacagaaacagctattatcagctttagccttcaataatttcacaatacaaattaggtggcactagcaacagtaatatctccaaaaataccacaacaagcacaagtgaactaaaaggaaagtctggtacttctaatcggctgtgttgttagcttggtgttccaaaggggtaggtattttttaggtttaacactatggttctctggctacttttaaaactgaaagtactcttcttataatataaagtaaacttcttataatttgtccaagagatatcaaaatacagtacctatgttttcatttatgaaattttcttgaaatatttactgtaggctgggcgtggtggctcacccctgtaatcccagcactttgggaggacaaggcgggtggatcacctgaggtcaggaattcgagaccagcctaaccaatatggcgaaacaccgtctctactaaaaatatttaaaaaattagccaggtgtgttgacgtgcgcccgtagtccccgctactcaggaggctgagacaggagaactgcttgagccagggaggcagaggctgcagtgagtgaggtcgtgccacaactccagcctgggcaacagagcaagactcaatctcaaaataaacagataaataagtaaaaataaaataaagaaatgtctactgcaaataatacgtttcataaaatgcttaataaaaactttcaataccatcatgaaagcaattagaacatgaaggtgtctgaactagatcatagtagtgtgattacattcaatatctttctataagacgtgatgatacatacagggtaaataatacaagaagacctaagattattatctcagaatttcctaattagaatgggaatacaactgtgcaatgagagaaatggactgaagacagaaataaaaacaaatgttatgatttaatatgacaaatttaaaatttccactttattttccaccatttttaaagagcattccttacagtattcagtttaatgcatttttaaaaatcagtaagacaagtagcacatttctctagttcagaactccgctttcagggttacagttaaagatgatcctagaagtgcattttaattggtctagggtagggccattagcttgatgttctaaaatctaccgagttgattacaatatgtggcagtgtcaataatcactttcttaaacccaggtcgcaaagtacatacacctataaaaatgctgaaaaatgggccaggcgctgtggggctcacacctgtaatcccagcactctgggagacccgagatggaaggatcgcttgaggccaggagttcgtaaccagcctggtctacacagcaagacccccatctctataaaaaaataaaaaatatttttaaatgctgaaaaatgaaatactaaattatttatgaatagataacttcaataaaagatgagaaaatacaactaggtcattaggacaatttgtatgaaacaatatccaatttgctgtctgttacttctcctaccttatcatgtctaatttttcctcatctttgtgaaatcctgcgtctacaataggcaagaaaacaaaaaacaaaaggaatcttattctattcacagccatcagaaaaatgtgttactattcctgtagtcagttaggttctaaatcatacatttgagatatatttgaaacatgtcataaagaaaataagcatcatatttctcactaaatagcacctgaaatattccatatgaaaggaaaaatacaaaaaactaaactttaattactaacctccttaaaggaaaataattctatatgatttgatatttgataatggatgtccaatacctgagatataaattccattttctgtgtcctaacatctcaccttcagaaaatctccaatattgggttatttggattatatatttaaaactgaatatacttgaaaatgtgaaagatttgttgcagcaacaaatggtttagcaattatctgcattaaaatgtgttccatgaacaacagaaaaagaatatttctacttcagtccttaaaaattgtgaaagcacagccacagtcttagtttgtcgatcttgaattcttttggtattttaatttcaccaataattccggaactgctgtttttatatttctcaaaatgttttgtcttgcatcgtccaataaggcagccaccatcatatgtgaccactgagcacttctaatgcagctagccagaactgatgttttaagtataaagcatcttgttcatttttatactaaatgctgaaatattgttttgaatataccaggttaaataaaatagattaaaatttatttcacctgtttttgtttttttaaagtgtaactacttgaaaatttaaaattacacatatggtctgcattatatttatattagacagcactggcttaccgttctactagttggctagcttgtacctccagataacatctgataatccaatcactagctatcacaaactagatctttcagatgtttcctattaaaatgttcgtttaattttgaagtgaattcctagaaaagctcatataatactattatagaaaatcattaaaatcaacttaataatttgcccaccatgaaacagaacttaaggtaaatctacatttctttggttagtatttactttactggtaaagaccaaagaattggtaatgttcaacaaaatatgaaaatgccagtgatgttaacaaaaaatagctggaaaccaaagaatcttgcttacatcacaatcacagccaggaaaatgcagcttattttacagccaatccccaacgtgaagaatatgtagaagaaacagtaaataaaaacagaagtataatacagaaatgcctaataccaaagaaattcatgtaacagaatactgaacttcagtatttctaatatacggatatacacattcctgctaactgtagaatatttcctgcaagttatggtcccagtgcctcaccaatggaagatctatcttgtactattcaattcatactctccctaataacagcactatattagcaggttcatcatcaagtgaaggctgtttgctagataactaaaaccaagattggaaaactaaaaagctggagggagggaaaacacagcctacaaaatacttacaagagtagcagcaaatgatgaagtagtaacaagaggggcagaaaaatagaaagattatcatcggatttgggaatcaaagacagctcagcaaaatactaggacatggctcatataagatggaataagcctggaaatacacccccctccccaatatttcggaacataaagtctacagaaaaagagtcctaatgtattgaacctggtttctcaattgaaacaaaagtctacaaggaaggagagataagtaaaatttaacaggaatacatatgaagcagtatctttaaagaatgtaaatatatcaaccaaaagtaaatttgagattcaaatttccattggtaaagtcttttcagagtcagaacaacataattattatataactattcaaaacaaaacaaaaaaaaacttactagaaaggagcacaactggtttgagaagaaaaacttttcatggtagagcagaaataactgtcaaggaaaatacttagaaaaaggcatatataaagagtggcctagttttactgcacacgtcttttgccatgcagaaacagctaaatcccatctgacaactactttccctttcgtgtaccttgtctttagagaataaaatatatctgggtttgatatagaggagactaattttcacattaaaaaatgattttcttaaaagcttggccttacagtttaaaaattatacgattaaaatcaatatattattcctataaaaagccaaactttaatccatttaaatcatgaaacttaaaacttaacttgaagcaatttcaatcatgaaacttaaaactccaaattactattgtgaattaacacttctccactatttgttatcttgcaattttaaaaaacacttcagaaagcagcaattttgtaaaacaataaataattcgtacctacagtatcttcattttgccatgcagttttacttaaatctcacttaaaaagaaatggaactcattcttaaagggtagaatgtacatgatgtaaagcagacaaaggaagatttatctttacttactgaaaatcaacagtacaattctaagatttttttccatgaaactactgaaataagtcctacttgaaaaaagaaatcccacaagagttagcaattaataaaaacatcaaaatgagaaattccccagcatggaaaattcctgtcataaatgttgatgtttatccagttaaaaatatatacaatgaataatatcaataaataaatatattagaaggaaataatagatgttagttactgtatacccaaaactatactgtattttaggctctatatttactgcagcacagaactaaaagaatttttaaagttctttctattagaaactattatcaataggttgcatctttatggcccaactgagttgaaattccaaataagatcacttcaaatttaataaatggcattcttcattaacagcatttaaaaaataatggctgaaacacataatcaacattacactgaagttctatctgaagacagaaaaagttgccatccacaccaaagctacacatataccttctgattttatagaattgttccaatatcttttctgtcaatatcattaaaatcaccctacctgtttggaccgaggtctaccaggagaaaattttctcttagtaatagctggtttacccatgccaatttttggagtgactgagatgtaagttgttggcatgatgtttccagcagaggaactaagagctgaagggtaattatgcagcatgtcatgcgaaggcaagtctgaagaaggtgttggggaggaagacacatctgccttgcttatgtctgctgatgatgaaaatgatgactctgtctcagatgataactttatagatttgcctccttggtatgaaacatctttcacacaaccctcaattgtaggagtcatttcagagtccatcaatccagtagaaagttcagaattttctttctgttccttttctccttgtagcctttctataaccaactgttcctcaggacataatgaaatactttcctcatgtggggacactaaggtttctagtggaagagtgacagattccatgactaattttggaggccttgattcttctctggataccactgtttcaggttcctctaacaactgcagttgttcttgctgcacagtgatctggtgtgtaacgacttcaatgttttctgtcacttccattttatcttcaatttgatcttcgccacaaatatgcttcacttcagaagacattttcaggtcttcactatcaacttcattagaaatctgtttttccaattcagtattcactgtatgttgggatgatactacaaaattcagaacatttgttatggcaatgtacaaacaaattttaaattttctaactatagatatataaaacatttggctacactagaacttaaatcagaaggtattcatcaaagcagacaattattaagtgaatgaaagccaaagtacacaaggatttatggattagaatcagccacacaccagaaaacctaatgaaaacattatgttttacaacttaaggatttccaaatggattgaaaattacacaggaaaagttctcatactcattttttagttaagaaaatgaggatcaatcatgttatgtgaggtacctaagttaaaaagtaaagagtgatctagaatgtgtaggcattttctaatagtagatacccagatgtaacaaagttactatagactcaaaagcacagacagaaaagatttactaaccaccaatatttattttgcttaaccatacctgccaacctacccaaaatattctttggatataatccttgttcttcatcactgtctataaattaaaagactaatctcaggaaatctataaacttagatatcagaaacatagtcactggtaaattttaaatcaggataccagtatgttaaacctttaactcaatctcatcaaggtaatttttaagttatagtaaaaagacactgctagcctcatttaccaatcagtgactaaaatttatctggtttttttttttttttttttttgaaacagggtctcactctgtgacccaagctggagtagagtagcacaaacatggctcactgcagcctcaacctcctgggctcaagtggtcctcccacctcagcctcccaagctgctgggactgcacacatgtgtcaccatccccagatactttttttatttttgtagagacagggtctcactatatcgcccaggcctatacatgttctgatatcaaactgaaatctcatcttctttcccactttattgaaagactacaggtagggataaaagaaaactaccaagtaacagatctgaaagtacaaaatatttttaatcatgacctcccccctccaaaaaaaaaaaaaaaaaaaaaaaaaacctttcaagagaaactaaccttctttagatccattgtcaattcttttccagaatctcttaactaaaagatttagttaccgtaatgtatatacatacagcaatcgcaaaaatgtctttgggataaagacattatcttgtaactcaatcaaattagacaatatgaacatactgcttaccagcaataagaagactatctgtgtcaagactttctgagggatgactcttctgttgctcttcagtgtggacttgaaccgctgtgagtaacacatttataaaatctctaaggagtcaaaatttctgtaacactgttccctcaacagtaatttgagtaaagagttttattctactaaatgtcaatttccaatataagcatgaaacattgtaccacttattagtaagttatgaagacaaaattagaagtctttgcactatggtaaaaattttttaattgtctttttctctttttctttaacaactagacctcacaagaaagattatagaaaataattttaatgagagttattatacgtaaacttaataaatttcaaaacatctcagtggctttttatgtatacattataatttttatgtatactatataattgaacatacaacttcacatacaacaccaaagactttcagatgagcctgtgattaaatgtaacaagtagttttcccccaacatggtctcttattaattccagatctgcaagtacaataatagctcttatcaatatttactacaaaaagcttaattgaaacatcatggaaataagtgaaataaccctcaataggactgctgagatgatccaatacagtaaatttttcattatctcagcatgaaacatctcatcatcagcaacagctctacttagcaactacaactaaagaaataaaaatacgaattgctttttaatagaaaatcacttggtcccttaaccaagtaagtacttatgattaagtctagatggtagctgaactacaaatacacgcatgtcctttctcctattaatttgtctaagattattttactaaaaaactcttcctaagtgactgcatcttggcttttactgaagttttagtcaatattcacatatttattgtatatacacattttcttcaaaaacagagtatatccattaaacattcttaccatctggaacaattccaggagtggactcctgaccgttgacatctttattagctgcctgctctgagaataccatttgatcttcagggccttcaacttccatttcattgttataatcttaacaaaaaattattaattctttagctcagaatgagtttttttctttgttcattaagtcaacaattatgattttgtatgagtaagggcaaatcatcaccaaaaatgctttaagtttttcttcagatttttctctgttgaaccacatgtatatttacatttttaaaaaacatgaaaattataatgcatcaaaaggtgggccaaccgtggtagttcatgcctgtaatcctaacactttgggaggccaagacggaaggaacgcttgaagccaggagttcaagaccaaccaggccaacatagtgagaacccatctctaaaacaattttttttaaaaggtaactggcacattattttaaaaggatatttcaaaactaaatactgatggcattctggaaatgaaaggttagtaattaagatgtttagttatccttgaagatgataaagagaagttttacaaaagctgccactcataatgatgaaaatgaaaaacaatctggcgagcagttctatttcctttactctctaagactcatgtttttaacagtaggatactactaaaaatattccatacctgaacaaaatcttgggctgaaaaggtgataattaacttaagaaggacattacaaaactacaacatgcttagagaaaaataacccacattataaagaacaaactaagcaaacccaaagactggggaacttccactgtcggcctgaagaacacaagtgaaggaaagcacactagacccggaattcaaatactaaaaaaaactatcttaagttagattagattttagccatcagattcagagatgaccaagataacaaatacatttaaaggttgagaaactgagaacaagatggaatctggaatacaggatcctctcttcctgattaaagcaatatattggtgatacaatggcacaacattacaaaaacaaaaaatttaaaaaaaaatcattctcaaatttacctgtagtgagctcagctatctccacttcctcacctggctgtaaacgatccatctcagctcccaggtgtttacaatacatgcagatatactcttctttgagctgagtatccagttcatgatctgttggtttgtcacactctaggtgaacccacctgcagtgataagtatacttaaataaaaatttctaacatcgagttattatctaggtaaagagaaggcattgctgaaaagctggatatgaaaacagttaattaagtatgagaggagagaggttagaggagttgctaactgacaaaggttttttaaagcacatttgtgcatgtcactagagatgctgccgtatttttacttgacatttttaagctattttctctttacttttccctattagtgctcatttctgatgtggtctggtcttatcttttgcccatttacttccttatgcctttgagactcaaaaacatcatttaattccatctataacagcaatcagtactgatggaattgctagagtgataaaaacttagaagctgtaagatggtagagcaaatgaccacatgaataaaacaatcgacaaaacaactgaatagaataactatcttcttaccttttgcacatattacaatgaagcatgtctttctgcaattctggatgataacacttcccacagaagggacataagttatcctgctgttggtaacaattgtcacatatcaggcaattgtggtgccactgagaactagaccgtgtgccacactctatacatattctgcaattctaaacaccaggaaaaataaaaacaaaaacagtttgttatgcatttgtaattgtagttctgatgtaaacctttaaaaagtcatgaatcatttgtggattatacattaagcttttattttcatgacactaatttagggtacatgctttttttttttgagatggactcttactctgttgcccaggctggagtgcagtggcgcaatcttggctcactgcaacctctgcctcctgggttcaagtgattctctcctgcctcagcctcctgagtagctgggactacaggtgtgtgccaccacacccagctaatttttgtgtttactaaagacacagggtttcaccatgttggccaggctcatcttcaactcctgacctcaagtgatctgcctgcctcagcctcccaaagtgctgggattacaggtgtgagccactgcgcctggccttagggtatacaccttttaaaaagctgttttcaatgtctgatgtggcctcacaaaatctgcactaaaatctccaggaaaatttaaataagggaatggggatatccaggaaaacatataggtggaagagataaaaccaaaaagacagcaactcaaaattcaaaaaaagaaacatatgctaggagcaggaagtaatttttgtggagtaagtctgctcaactctaaaacaatagcatggccagcctggtgtgatggttgatgccagtaatcccagcactttgggaggccaagatgggaggatcgcatgaagccagggatccgagaccaatctgggcaagaaggcaaaacacctctttctctacaaaaaaaaaaaaaaaaaaaaaaaaaaaaatttaattagccatggtggtgcacacctgtagtccctgctacttgggaagctgaggcaggagaattgcttgagcctaggagtttgaggctgcagggagctcacgccactacactcaagcctgggcaacaatgtgagactgccatggtgggtggggaaacacagagcacggtcaacgccatgtgacttggtgtctgaaaatgtgaaaatatattgctccacatcaaaagtccaatgatggcccttcatgtttttagaatagagagagtgtcctatccttaccaaattagaattgtttatgaagtaaaaggccaaccagaggccagccaaaactacttctgtgcctgtgagctagtcagccttaaaaccctgggtatccctgggtgtaaggttaatacattgtggggctctcattacccaccccaaattttgaatctaaaatatcaataaaagggaactttatctttctgtgctaccaggttgatatgaaagggatgctcacttaaaaagagaaactaccaggaaccatagatcagctagtcttaaagattaaaatgaatgcacttaacaacactgatgcaaaaatcctaaatagctgggcacggtggcacagaactgtggtgtcatctacttgagaggctgaggcagaaggatctcttgagcctaggaggtagaattcagcctgggcaacacacagagaccccatcttttgaaatacatacacatatattttttaaaagaatgtattatcctttatctaatgagaaggagaaaagaaaaacaatcctaaataaaatactatcaaacagactctaataccacattaagaaaataataactatgcccaggtggagtttatacaagaaattcaaagatatttaatattagaaaaatccattaataaagtttaacaaattaaaaggtctgaggagaaaaaattatttcaatgcaacagatgattaaagaaagaagtctttgggaagaatcaaaacccattactaataactcttgagaaagtaaaaatggatgggtatttctctaatgtgaccaacataaatacttcaattctaaaggcaacatcttattttatgggagagcccgagaggcattcccactaaggacaggaaaaagcaagggtgcctattatctccactactattttaacatggttctggagccaatgcaagcattgaaacaaatgaaaacagaaacataagaccaggaaaagaagaaacaaaactcttaatttgtaaacagagttggaacatcctagaaaattgttcaaaaattcaataaaagaattcaacaaagtactaggatataaaattagcatgcaaaaggcaatagaattcacacacacaaataacgagttaaaggatggtaagaaaaccccatttataacagcagaaaaataaatattcaagaataagcttaaatgttgaaaatcagtatgaagaaaattataaaacactcctaaaagacacaaaactagactttaacaaacttgtaaagacatcccttgttcttggttaggatgtcttaaaatcaagatgtcaatcaactctcacttatatatatatatatatatatatatatatatatatacatatatatatatgtgtgtgtgtgtgtgtgtgtgttttggaaacagggtcttgctctgtagcccaggctggaatacagtagcatgatcatggctcactgcagcctcgaactcctgggctcaagtgatcctctcacctcagccttctgagtaactgggactataggcgtgtgccactacacctggctaatttttttgtatttgtagagaggcagtttcaccatattgcccaggtttgtctcaaactcctgagctcaagcaacacccctgccttggcctcccaaagtgctgggattacaggtgtgagccactgcacccagacactcaataaattaaatgtgattccaataaaaattccaatgaggtttttattggggctacatatggtgatcctaaagtttatacagaaaaacaaatacacaagcacagataagaaacctgtgaaatggataagttctgaaggggcccaacattaccagatactacaaaggctctataacaaaaacagtgtcgtactggtgaatgaatagacagatcgatggaatggaaaagaggttccagatataagttcaatcaaatctaacattgtagtctggaatctcaagtcactagggcaaagacagtctttttaatgaatggtttttagaaaactgaatagccagttggaaaaagatactcacatcatacacaaacatcaactccaaatagatcagagatttaaatgtaaaaaataaaacaatgcaagccatacatggtggctcacaactgcaatcccagcactttgggaggccgaggcaggcagatcaattgaggccaggagttcaacaccagcctggccaacatggcaaaaccctatctctactaaaaatacaaaaattagctgggcgtggtggcgcatgcctgtaatcccagctacttgggggagctaagacatgagaatcacttgaacccgcgagggggaggttgcaatgacccaagattgagccactgcactccagcctgagcgacagagtgaaactctatctcaaaaataaaataaacataaaaactgcaaatcctagcagaaaatatgaactcctctataccctcagtgtagggaaaggctttctgaatatgactcaaaaatccagaagcaaaagaagattaataaatctaactccataagaaagaaacttttgcatggcaaaaaaaaaataataaaaacaaagtcaaaagacacataatacagcctggacaacatagtgagaccctgtctctacaaaagtaaaaaattagctgggcttggtggtacacataactcctagctaactcgggaggctgaggcaggaagactgcttgagcccaggtcaaggctacagtgaactatgaccataccactgtactatggccggggtgatggagtgagacactgtctcacacaaataagcaaaaaaaacaagaacaaataagctggcagaaagtatctgcatcatgtaacacagataaaagcttacatccctaacttataaagaactcttaaatttaggggaaaatgccaaaatcttcaataacaggcaaaacacatgaacagacaattcacgagaagaaattaaaactgacccttaaacacatgaaaaaacgatcaacttcactcaggataaacaaaaattaaaactacattgatacaccacttttcgcccagaagacagacaaacattcaaaagctgaacaagtcatcctgttagcaaagacgtaagaaaagttctctcacacatctctggtggcaatgcaaagtaccataagccccaagaaagggaatctgacagtatctaacaaagctacatatgtgtacactcctgaggcaataatcctacttctaggaatttaccctacagatttgtccctgagaattcaaaaacacacatgcacaaagctagggagtgtaaaatcatttataatgcaaaatatcgtaaactactgaaataccaaagcacaggccattggttgagtaacccatagcacagatacacaatggagtgctatgcagctgtttaaaaggagaatgagatctcttgaacttgcctaacttgcctggaagtgatttccagattttattacacgaaaaaagcaacatgcaaaagaacatacacaacatgctaccttcactgaaaataagagcaatatatcttcttattcttagacgaaaaataacaggaggtttaaaacagaaaacaatgaagttagttacttccaagaggttgggagaaatggagtataaataataaacaagaggcagtgacaattctgagtaaaacttcatatagtattgagttttgaaagtatactaatatcttctatatttaaaaaattaaatcactaagaaaagaaaggggaataaaatctattactgagagcaaactgaagcagacttgctttttagattgagcaactgaataaatgtgctgatgttgctacaacccagaatttttattgtagaagaacagacatgcaagaatgagaaggcaaagaattcagtggagaaggacaagaactggaggtactggtgtaaattcattatttctaagttatgcatatgtatatgaatatttatgtgtatatacgttaagtgtaggggtgttcaatgttttggcttccctggaccacactgaaagaagaagaattgtcttgggccacacacaagatacactaacactaacgatagccgatgagctacacacacacgcacacacacacacacacacaaaaaaaacacctcataatgttttaagaaattttatgaatttctgttgggccacattcaaagccatcctggaccacatgtagcctgcgggtcatgggttggacaaacttctgtaagtgtatacacacgcatgtatttcctgacaccacctgctgaaaggatgaagaagcaaacacccttcagtagcaatgagcacacccagcacccattccccactaaaggaatctgggttacttatttaacaatggacttattccagggctggggcacaggaggtataagatgagcttgtaacatcttgttacaccaaaaagtatgaagtgttcaagtaagtggtgagggcacaacaccagcgccagcttgaaggagcaactgacagcaagtatgggactatttcagccaaaaaataattaggtaatgagttgtaaatgattgaagataataggagctcatgagtcagtattaataagtaagtttaacatgtgaaagaagtgttcttgcttacaaaagaaagcagagggctaactggtaaatgcggtgggagtgctagagctggaaatgcatcatttgcaaccaaaacaaagcaggttaaaatggcatcatcaggcagtaagtttgttgttgttgttgttgttgctgttgttgttgttgttgtttttgagacagagtctatctctgtcacccaggctggagtgtagtagcatgagttcggctcactgcaacctctgcctcccgggttcaagcaattctcctgtctcggcatcctgagtagctgggattacatggcacccactatcatgcctggctaatttttgtatttttattacagacagggtttcaccatgttggccaggctgatctcgaactcctgacctcaactgatccacccgcttcagcctcccaaagtgctaagattataggcatgagccaccacacccagcctagggagtaagtttttcaaatctagaaggaaattctgaggaaaagcaagatatttgcatggtcttaaagtgtccttacatactgctttattagatacaaaggagggggaaaagaaattggacaacagcctgaccaggtgattcccatgagggaaagtggaataatgtgtgcttccagctgtgataccctgaggatggatcagtactttgcagtattctggccaataatgcatgcctctcatctaattataaggggatatcaaagacaaaatggggaaatttgtttgaaaaaaagaaaaaaacaagtatatcgagaagaactctattcttcaaaaataccaatgacaaaaactaaatcctagaacctacttggaggaaggggtaggttatgaaggacataagatcaaatgacataactggaatatggctagtacattagataaacatactacattgatgtaagtttaggaagttgatagcaggattgtgattttttaagaatattcctactattaagaaatacatactgaaatggtggtaaaaaggcacaacgtatgtaattaaccctcaaatagtagggggttagggggaatagagacaaaaacacagacacacacacgcgcacacacacacacacacacacacacacacacacacacacacacagagaaagcaagagagggcatgcccagtgacaatgaaatgctaacaactgataaatctaagtaaatgcgacatgggtattatttttattttctccaacttttagagtttgaacttattttcaagtaaaaactttctaaaaacacataacataccaacaaacagacattcttgagataaaaataggaaaaagaaacctatctgacaatgactggtttacaataaagatcctgaaaagattacccccactccagctcaccagggagcagccccaaactagactgacagccctgtgggggcacactgatttgtcccaacatctccagccttcactacagtttcacacacagtaaacactcaaaagttaaatgcaaacaaatgagcaaattatgactcaagactacagagagaactacagaagaatttaacagcagagaaagatgatcactcttcaaatggttcaaaggacaaacctttcaatccatgaaaaactctggtaactatttctgtacttactttgtgttaggcattgtgctgggcactttatagataccacttcattaaatccaacatccctgtgaggtaagtaccgttaaccttctatacactgacttagggaagttaaacaggtagccaaagatcatcaatttagtaactgaaaaaactgcattttgactccacagcataagctttgaaccaccacactatagtcccttcatagaacaggataaaaagattaagtatccaatagtattcccagaaattatgtaattctgtcactctcaaaagagaatagcagattacaaagagcaaattagaaagaagcacaccaaaggggagacagaacaagctgagaaagacacccagaattctctaccagttctcaagataatgaaaaccctaataaagaagatcaagagcaagaacaaaaattatccagtagttactagatattattagagagtgtaaagaaggtaattttttaagtaaatatatttttttaaaaaggtgctggggtggcgtgggggatggggactcacacatctcccaaagctttcaggaagaaaaaaaggattatgattaaattttttaaagttaagatttttcttgtgacagcataaactgaaaaaactgaagaaaatgttttcagagtataagaaagaaaaatttgtaatatgaaacattatactgtgccaagttcttatagcctaaagggaacagtctctttcagacatgtagggtttcagaaaatttataattatttttaaaggaacataaccaagactccgaaagattgagggtaaagttggaattaacagaggaaatatatttttgaaagaaaattgtgacaaggtttataatctaggttaatcaaatcaaacagagaaaaggggaataaaaacttcattttcagtggggaatgggagaaattttatatctttaacatttataatcatttacattcacaaaatgagattctgaattataaatcattgcaggaagtaaaagaagagaaaagtagaaaggaattataagaacaattttgcctcaaaacagccaagcatttcaattacaaccatcaatccaaacagttacctctattaagcttttcaaaagataacatttttataacacaaaagaatccaaaataaaaagatgtgaaaagataaccattcaactgttaaactaacaccctacgtggccatagtgtcaggcaaagcaaaatacctgcccttcctgatccctcaacaaaaaacacattacatagaataaagaacaatttcatactggtaaaaagcacaatatattaacactggcgtgacctacttgctaaataacagccacaaggtatttgtttaaaaatatgataaattgataggaacaattaatagtggtcaattgtaacaacttgttgaatcaacaagtcaaaaaataaggtaaaaggacttcatctaactaaatgaaattaataaacacaaatgctacacctttaaaaagtcactacaagtatcaacacatttattttaaaaaacctaccttagttaaattatctgattaaatgaaatgaaagcataaattaacatacttcagcacaacttaaaaaaaagataaagatattcggtaaggtatatacatacataaagttacaaatacaataaatttggcttcagccaaagctacagccgaaggtaaacttatagtcttaaatgtcctttttccttaggaaaggaaagaaaatgaattacaaattcaacttcatattaaaaataaaaaggcaagtagaggaactgagtgaagataagagtgtaaatatacaaatcagtcaaatagcagagtttttcctttccaatgataagtcattcagcaagagaaggaatctgaactacctgaggaagcaggccagagttcatcacaatccttcagccctcagaccccacttcccaggtagccacagctgagcacagttacccagcagctctttttccccccaggagagaaagcccctcccctcaacccccaccactcaggcagatgcctaataggacttgctgaagaccacaaaagaacctggtaatactgcttgcagttctaggtgccaaacctcactggcgaggacagggtgcaggtacagaatctccctgcgtctgctccacctcctcccccagctggggacctggggttctggccacatcaccctcctttcccaggccctccacctcctcactagaaaaagcagttccaagaagagcaatgacaatgctgtgccttccactcccgcacacgggccatcatgccctctccagctccaggaaaaacccgctccaggcccatgcagcacctgagggtcatctccatccctcaacctcgcaacaccagcagcccaggaagactaagcttaaaagctaaaccgcaccttggattccaagggctatctccactaccccactgcccccaacccggctctgaacgcctcaccctgaaggggcagaagccaagtgaggtaggaagttagttaatgagctcatcggcattttttgtaatagctcaaaattttgaaggacccaaatgttcaccaacaggtgattcaatacacaaattgtggtatctccagcactcagtaataaaaaagaatcactactgatctgtgcagcaatatggatgaatttcaaaataattacactgagttaaagaagccagaccaaaaacgagtatatagtatatgaagcttttattaaaaattctaggaagtgaatactaatctatagtgaaaaagcagactaggaagacagagtttgggtttgaacagccacaaagcaagccaagaggcaccaggaaacttttgagggtgatgactatgttcattatcttgaagagtgtacagtttattatatgtcagttatatgtcaataaagctgtttttaaaaagctgatggtgatgatgtacagatttgaataggtatccgatttgtctggtctccatataaaacatagagaggatttaaaaaaataaataaataaacaacttactttgcatttccagccattggttggtactgatttcataactggttgaagacaaaaagtatgataccctttgtcacacgtatcacacactagcatcttgctatcttctcccgattgtctaaaaaataagatagcattaatgatgccttatctttaaacttatgttttgtaacataagtaatcatgaaaataatcagtcctgggaactgcacagttcataaatacctcagtatctgttttgtctctgcagatagtaacagaggtaaccctgccataaggattacctcctaaatggtgatctttactcaatgctcacctatggttaacttgctctagccattttaggattcctgcaaaggaggaagggttaaggcaagatgaatagcctctgatctttacttttaaaatagaatttttgagaggaaggtgctataactgataggtgctactgtgtggaaaggaacaaatcttggcacagcgaattgaaaagacactgtcgtataacgtaaagaggatcaaatttggcatcagatctctatttgtattcaggctgctgttttctagctgtgtcactaaacaacttagactaaagctctctgagttccaggtataaaatgggaataataaagattactgcgagaattaaaggtaatgcgggttcaagtgcttagaatgtctattaagcaattaaatgctgaataattatttcaaaatacgaaccttgtcataattattaagaattatagttgaaaacctaaaatctttctctaaacactcttctgcccccaaagattgggcccctgtcctacagctttatctctgttgagatttttgactataatcactttcagatactatgattttaaattcaagaggaggggaaaagaaacaacagggaaagcaagaagagctgagagaggaatctctgaatgaaatctgggggataaatagatgtcaacaggaagatgggtcagttagcctccaattattattcagttcagcctctccataaaaagtcacgttttatctcctcagctacgtggaaagatcttggaggacaagtactcttccttcaagttcttttaatccttcccaagaaactgagcgcagatataaggtatcgaataaatgtttactgaatattttatctaatttttaccaaaatatggaggtacatagtcctatttatgtcacgtaactctaagatactgacgtttatttcttatcaaactaaataataaaaacagactgatcatggcagttgggcataattcttgctggttacaacaaaaattctcagcctgtaaatgaagatactggtaacatccccaaattatcatgctcattagaatcatgggggtgcaagcggaaatcacagaaaagactggagaaatgaccaagagatgaaataccataggaaaatataacccccttacaaatttgtaaatgccacatatttcgttttggaattatgctgaccaggatctactcaaggtggcttttagagagatgcagatgtacattaaaataatagtagaaattgtccttcctggaatggaaattcaaacacatgactgattttttggctcaactctaattcttctacttctgtagttagacgtttaaatcctattaaatctcctccccagtaccccttaagaaaaactactttattcttctgtttgttttaaattgttaatatcgcttattttttaaattgttggcaaatttaaattagctctttagacgaccagagcaatttaaatgattaaaatcagttttgtttagacttctttcaaaattatataaatgttatttatattataatataataacaaattatattatggatatatactggataaatgttataatatccagtaatttttttaagtatgatgaagtcactgaatgaatatagctaaaatatgaacaacctctattatattacacaaacctttagcacctagtaatagggtccctcttaaacccaatacacagctttgaattgaaatgaaaacttacttgcagttctggcacactttgcactcaggacattgccaacctgcacgttttaatggagtaaccgctatatccaggcacattccatgatagtgctgaccacaagtagtacaaaagaactgatctaagaggtctcccgggctgtcgcacactgcacagtttgcatcttccttcgctataattaacagtgaaacaatgaaattgttgtataagaatttaaattttttctgactatacagtaaaatcatttgaaaggatttgcatcatgaacctttcagacatttgaagttattcacattgaattgtcatctaatcagaaagaggtaccaataaaaacactgtagggtatttaatctaaatgtaaccacattaaatttaatcgtatagttttgcaattatttgtggctatatctacttgagaccataagcaggtcttctttaattttctattcctaatgccaatgataatgctggatacctaattaatgctcaatatatgcttactggaaagaaccaaacaaggaaaatacaaattaagaaatgctttgcagtgtaacataaacattttctttgaatgttaaatatattttgaaattacaaaatcagataagagacaaaattaagaaacattaatatcaattagactaagatgcttcttaagcataaacagactattcaaatcatataagggcttttttttaattactggaaaatgccttatgtggaagaacattaaagacagaagctacatattcatacacaaacacattacttaatatactaattatatattcatctatattaatttctagttgtaaaagcattaaaatccacataattatggacatcatccatccctaaatgtggattaaaagaaaatgtactaacagttcttttaccatataaaacagaaaatataaggataaactgccctgccaaatatacagttaaacttatgcatactgcaaaataaggaaaataatgtattctaaaatcataccaatcttagataatgtataaaaaatatgcctgtatataacaagtatcacaaagtatatgaatcttttcattttttgaaggtttgatcattcctatctactattctgactcatacgttctttcttttccagtcaagcctatcataccaaccttagataatatatataaatatgcctgtatttaacaagtatcacaaagtatatgaaccttttttttttcctttttttttgagacagagtttcactctgtcacctaggctagagtgcaatggcacgatctcggcttactgtaacctccgcctcccaggttcaagggattctcatgcctcagcctccccagtagctgggcttacaggcgtgtgccaccatgcccatctaatttttatattttcagtagagacggtgtttcgccacattgcccaggctggtctcaaactcctgagctcaagcaatcctcctgcctcaacctcccaaagtgctgggattacaggtgtgagctaccacactcagccttttttccattttgaaggtttggtcaatcctatcaatttctctctgactcacacgttctttcttttccagtcaagcatcttgaaacagagtaaaaatatatttcttttatttgtaccggagtctgcaaacttttcctgaaaagggccagatagtaaatattttaggctttgtgagccatagcagtctctgacaaaaagtcagactttttgtttttatttgcactcttttaaaaatgtaaaaataattcctcgcttgagggcagtacaaaaacaggcttcaaaatgtggacgctggctggacctctgacgtacttcatgaaggctggcttagcacctaatactcatctgaagctacattagtgaggttgccaatgcccataggaaacccgattgttactttttagtctttggctttttgcactttgtagcatttgcattgctagccactcccacattaaaacgcccctttccttagtttctatcatggcaactctctcctaatttctccttagttttcccttactttcatctcatcctcctttgttggcttttgtacctatacaatctttctaaatgctggagtttcttaggatttcatccttttccttctttcctaatcccccatagtttccctttgtgatcacatcaactctcatgccataaaatgccaccatgattcctaaatctgtattattggccctagaattctttcataaaccccaaacctttattcttcaagtcttactggatctcaatagccagatgttctaaaaacactcaatctcaactgctctaaagtgaaacttttttaaaaacccgaaacatcatccatttttctcaagaatagataaaggcagaaaccttagtatcactgttcactctgaactcagccctgacccaacacatccagccagatcccaattcttatgtattaaacttcctacacatcattcttccttgtatgtttatagtttagtctatcatattaggttggtgcaaaagtaactgcagtttttgacattacttttaatggcgaagactgcaattacctttgtacctacctaatactctgtctcgctaactgcagtatcttctgcatcaaatcatctctacttatggttctgacatcctgtctaaatcattttctgcacatccagaacaatctttcaaaaatgtaaatctaattgttaacctctgtataaattaaaactccaccaatacctcatttttcacctaaaagaaaatcagaattttcaagtatgaggcaaaaaggcccttatctccctttccaactgaatctcagaaccactcactatctcgtggtcatggtgggttgtctgccatgcacctcacataacatgctattcatgtctgtgtgcttttacacattctgttccctctgcttgaaattttgtttttctgctgtgctcccagccttcaaaactctgctcatggctgggcacagacactcacgcctgtaatcccagcactctgggaggccaaagcagatggatcacttgaggtcaggagctcgagaccagccgggccaacatggtgaaaccccatctctactaaaaatacaaaattagcagggtgtggtggcacatgcctgtagtcccagctactcaggaggctgaggcaggagaatcgcttgaactcgggaggtggaggctgctgtgactggagtttgcgccactgcactccagcctgggggacagagtgagaccctgtctcaaaaaaaaactctgcacattatttcctgaatacctattaccacacccaaatacctttagttgttgaatattacttttacccatatgcttacaagaaacttctgttacataatcaattaattacagcacaactctgtgaatccttgaaggacaggggccttaacttttttaactttgtatccccaactgcctaacatgaatcaagtcttattgaacatattttaagtgaaggacttactgctaaaatcacttttaaatggctctttaagtgataggcatttaaaataaatcattaatctaacaatggaagcatcataaattagttcatttttgatagaaaggacataactgggatgttatgtttcttaagacagtaccagtatttatctttcaaaatatgtacatttaaaaattgatctttttgctcaccgtaaaacttttaaaaattgggggaaataataaactaattatcagataaacaattcatttttctattatactttcctaggaacactaaaatgcttctgtgaaactttctagagtttgctcccctgacacttcaagttgccatggtagctactagcgacatgtggtttccaaacaagtgaaatgtaattagttcaaatcgaggtgtgcagtaagcataaaatgcacactggattccaaaatcttaacaggagaaaaagtatctcaaaatttgagatattactattttggattactgaattaaataaaatttactacaattattcccaatgtttccttttactcaaatttttaacatacccactagaaaaattacttatgttgctcacattgtatttatactgcacagcactgttatacacaacaaagttcgctctgcaacaagacaactgtcattgtcacaaaaatcactttttagactatgatgatttccaccaattccttactgataaccttgctgtgttctttgattactatggatcattggtaataaattagtcaaagaaaaacatccatgtaatacatacatctggtgcaaaaacacttaatatgccttatgtgaaacacaataatttttaaaagcactacacaaagaaatgaggttggttccaaccctcccagtcagggagaagatgtgtgggaatactgaaacaaccttttggaggtcatgtacaagattatcgatactactggatagctttggtgtcatgacagaaattaaatatgaatatttagacacacatgtctgtaagccagagacactaagtttaaagcaataatcaactaagaaatttttctttaaacagttgaaaaagcaaagacaggctataactaaagataatttaaaagggcagaggagtaaattccaggtctatttggattctaagatcaggctcttgactactaatcaaattgactcctcagcaaactttactactgatcaatgaaagtgatgagtatttgagtatacacaaaagtagacatgaaatgccaacagtggcataagatgaagctaaatgaagtaaagggagcaaggttcttatggcaggagaaaagtgagaggaaacaaaatgatcatctttagagaaggtcatttcctaaaagacagccgtaaaaagagaagagataaataaaaaagacaaaaacattgagcttaaattagaacagagcttatcacagatccttaaacctgatgaaactattacttaagaaaatccagacaacacataagaataaaagcattggtgaacagcaacaaaagtcaaaatagctgtcatacagtgtgaatttaagaaggaccaaatcagcattgctttctaatttccatcacaccctatcatctgccaattttcatcactggcaggacactgtgctgagtgatttgtctataaaagagaatctctgggaagaaaaaataaatcatggatgtcatccaaagaggctagaccgtatcattggcaggtagataagaaaggtcagaggactgacagaatttagggtaaaagaaaagcaacaggacttaatgtcaagaaatacaaagataaccaaagaaaagaggctggagttaaagcttaagtgaagtaaaaggaattaaagctaaatgatgagtaaatacattgaggaacagggggtgaattaggatatgtagcatttccatgtttaaaccttgcaaagacttctcattgcagaccgaatagaacccaaactccttcccttgcttacaaggcctacatgatctagcctttgttcgccttgatgatgtctctactacccacctagtaggctactatgctccaagtaaaatgacatgctgcctgttcatgaatcatgccaaatccattcctcaaggtctgtgtagtggtctgttccctctccctggaatgttctttcctcttatcttgcatgattggctttgtgccattcagttttcctattcaggaagtatatctggttgtatctactagatggatttttagggtaaaatttccagacaaggttaatgtatccttgtatcatcatgaaaataatgttgcaacaatgaccagccatttacctatgacagagcaccctaaaagtgtttcctgaagaaaatcttggccttcttcacagatactctctttagtgaatttctttataatgagatgcatgcttttgttaaatttctcaacttttataaaaagatgtcaaccttactcctaactcagtcaactatcacagctactgctctgccccttaggaagcaacagaaaatacatatactcaatatgtattatcattctcataacttaatccttagataggaggtaaaataactaccctttttaaagcaattaatacatacaaggcacaatgttatgtgaattccattcattgttttcatttaaccctcataataacactatgatttaagacagtatcattttaaaagcataaaaattaacttctgccatgacacacaattaggataggaaaaaatatttataaaacatgttaaaaaggtgacaaaacatcctatctgcaatattctttaaattatatccttggtacttaatccaagattatgatcgtcttaacagatgggtcagaacgctgtgtagttagaatgcactgcttaagatccccaaggaggccgggcacgatggctcacacctctgtatcccagcactttgggaggctgagacgggcagatcacgaggtcaggagttcgagacgaatctagccaacacagtgaaaccctgtctctactaaaaatacaaaaaattagccgggtgtgatggtatgcgcctgtaatcccagctacttgggaggctgaggcaggagaaatcgcatgaacctggaaggcggagtttgcagtgagccaaggccatgccactgcattccagccagagtgacagtgcgagactccatctcaaaaaaaaaaaaaaaaaaaaaaccccaaagaaatctaatttagtcatttaggccttgattttacaccaccgacttagtttgaaggctgctataagaaacagccctatgaaactgatatttttctactgcaaggtggctactttaagataatttttcattgcattgtatcaagtgatgtcttgttattattatatcattatatcaagtgacgtcttgttataaatagtaagaatcagattaagggctcatatttccttctttgtattgactgctgaaaaggtatggggccaaatttgtggttacgtctggagttatatatttttggggggggtctctctattaccttcatatttatcctatctaaattttccattgccaaatttccttactttagttttatcctattgctcatgtatttttatgagtctccataagtctattttggaaaaaggcagagtactcataattttagtgtatcttttagctttatgttgccataaacctttcattatatacatgatcaacaacagcatattatctcacctcagtatttattattttacaaactgatttatgattgctaacatgtaactgaaggtatacactgttagaacacagttttcagtagaaagtagcactgccattaagtaataaaatattctaacactacaacaacattcttgtaaaagtttgcatgttgtttgctgaggtctaaagcatgattaactacaaaaggctgaataaaattcagattcctatatacacacaaaattgttttattgagatgacaaagtatatttattatgccacccagaatataatccactctgataactgccagtttatgcacttgctgaagtaactcagtacataaatagtagccgtaacagttgcagtgcatgaagttcttctcttccagattgaagagtgtacaatctaacgcattttaaaactttaaatcccttattagcctaaatataatttaaaattctagtttgccttacctataatttgtacactaggttactaatggtgatatgattacatatgtggacacaaaataattttaatggaaaatgaaattatggtactcaacaaagaaaagggtaatgatcatgtagactaactgtatttgagattagtttaagcctggggtagctatacttacgtttcacagacctggagaagataggaaaaaagcttttattaacattgctaaggaacagataaaagctaacattaggtaactaagaggtgacataaaaaagattgaataaaatatcatggaggtttcataatgagattggaaattcaatagactaggagaaaaaagatcccaaaacatatatgctcatagggaaaacacatagtaagaaaaaggagagatctctatttaatgatacaatagtaaagagttataatttcctgtataatgtaaatttcacgcatttaaacattttcattgaattataaaatactatttggaaaagaaaaacagcacaactgcagattacagaagactaagatagatgaatcatgaaaaggtactagcagagatttctattatacctatcagggaaacacaatttctaagaatttcagaagtctttggtgttcttattaacgtaaatcctgaaataacacctgagtgaactgtcttctaattcttcaactggatggctttttagtgttgattgactttttaataaattattttatagtataaatcagaaatactgcatagtccctatttacatctttctacagtggtttttaaaatgttttaagaataaaaaccatgcaaactttatttgatttttctgaggaaataactttttggatttaatttcaatgaaaccactgataacatttccctccccagcgatccctggcaacgatccctcagattttaaagattatgtattattaccttttaatacaagtagaataacactcagggaatttacaacatttgttattttcagtaaatacattggttgaagtttaaaagtctatccgtagtaaacttacatctttcaggagcttggtcaatgtgttctggacaaagcaggaagatgtgactgaaatcctgaaaggtgccggctcctgcagcacaaggataatgatacatctgggtacatttctcttcacagcatttgatagtggctccaaggtgcttacaaaatgcacatcgctgaaaggggtaaaggagagaaatctctttataaaaccttgaaaaggaatattcaaatataagctgggaaggtataaaaaactctctgtatatcacaagtaaaacaaattgaacctgcaaaatattaaacaaaggattcgttaaaaataataaaatctacattactcaatttagcgcttcgtgtgctaccaactcatccttccattcaaattagaaagttagaatttcattccttatattttcaaaaataaattttgaagcatttttgaaacaaaacctaaagatttttttttaaagcaaatagtaatatggttaaaagggcaggtttctatattgaggattattataaagtttttaaatcccaccaaaactagtaataggaacatatattttatttatgagacatattactattttttaccctgcctaaaaataaatacaaaataaactcatcaattgtaagttaacagggacacaaatggttaaagactcacagaaaaaaacacaaaactacatacttcaatgtagcaatcaacttcaaatttcttaacaaaagatggaaatgtgggcgaaaaaaaattagtcatctggtatctttcccatttcaacctgcctccattatcttgcaagtggtaaaacgcacagaaataagccccaaacaagaggggcagtctagggcaagtgaacacataagaagtcagaagaaattatgtaaaatgttgcatttacttattcagttttcccttagaatgattcacaaactcttcctcattctcccaagtccactttgagcatcattttctttgaagagagtttgatgggccctgtactatacagtatgacatctctctgtgggaaatgactatctaacataaatttttgtttacaccattacatggtacttacttgcttatgccattacatgatcagtttatcttttcctcatcctagtccaagatccttcaattgaggcaccatactatctttgtatccaaagcaccaaaaatgctgcttgaaacaggccctaatagaaaggtgttcctatacatataccaaaaagacttaacttttggtgatcttttttgtgagtgtggctcataaacagcttagctgagataactggagcctcatgtaacacagacagttggaccctgctaacattactgtggatatcttcacatgttactacactgactttatattctgctaattaaccagggactacagtagttaaaattataattgttttcaatgttttatgtgtaaatctgtatatcacatactatcaaactcttcctcactgtcatcagtctactgcactgaatcaacataacaaagctaagtgactcctgagggctgaatcagaaagaagaaaagaaagagatacaaaaatttggctgggccgggtggctcacacctgtaatcccggcactttggaaggccaaggcgggtggatcacgaggtcaggagatcgagaccatcctggctaacacagtgaaactccatctctactaaaaatacaaaaaattagccagacgtggtggcgggcgcctgtagtcccagctacttgggaggctgaagcaggagaagcttctaaataactcataaacagtaattactgttgtgacactttaattttatataatattataagtatacagaataacatttcagtgctattttggcactcaagggtattaatgcattagaaacacagaaaataaatatttttcttcattgataaagtgtaataaccagcttttacaaaacaggtaattttttataactcccaaggtatctaaatatgtttagtgcattaacagaacccagaattaactacaaatacaacacctcggtagtctaaatgtctgaatagaaagaccacgtaaatgtcgaaaggaaaagtacaatcaatctgttgaaaaatgtttataacaactcattaacataactaatttctgctaaattgttaaaatctaaaatcgcttattttgataccatatggcaagttttgcagaagccttttacactaaaaataatcttggcagataaaatataatgagaggtaagtatataataacagaaagtaatttaaattgaccagcttctcaatgtctttctcattttagaaacaccaatatgttctcttaatcatatctgcaatgaaaaatattatattagctaaactactatgagaagtactggaatatatctaacatactaatttacaatatcatataaagatatcagtgaataaaagaaggaaaataaaacactacatttaggagaacgcttcaaacccatctgttacaattaaatagctaatgaagagcactcggcattaaaagaaaatgtttactatatatacacagtctggaatgtatcttcctaaaccaagtaaaaagtacttgtaaaatcgtagacaatatcaaagaatggatttccacagggaacttctcaaatgtcaacactcttatacactacacataaaagaaatcaagcaagttaaaatattaataatacaataagtaatatataatacataagtaacaattacgaagctaattaacatttggggaggagggataaagtaaacagctcttggccgggcatggtggctcatgcttttaatcccagcactttgggaggctgaggcaggtggatcatttgagctcaggagttagaaaccagcctgggcaacatggtgaaactccatctctacaaaaaatacaataattaggtgggcatggtggcatgcacctatagtcccagctactcacgagcctggggtgggaaaactgcttgagcccaggaggttgaggctgcagtgagctgtgatcacgctactgcactctagcctgggaaacaaaagtgagaaccagtctataaaattcaaaaaaaaaaaggcccttaaatggtgtatcaactaaatggtttatttgaatcaataatgaaaattcctagacagcattttttctttttacttttattcatcattaaaaagacagggagtaagaaaaggaaaaaagtaacatgttataataatattttcccatattaatccaagaacacaataacaacaacaacaaaaactcagtgagaactcgtattaccaattttaagaatgagtctgaggaattttcaagacttttatttaatagtttgaaataatctgtcaaaatgtatccataaaacaaaacagaatgaacaaaatttgagattaaagttgtatcataaaaaaataccaagaagttaaatattccacagttcatttaattaattatccagtatttattctgtaccaactatagcaatggttttaggctacgtgctctaataaataagtattataaggctccccatgctccaaatttgtttttaatcttcaccagtctttttttagtattaggcaactaggattctcccaggatgcagtaataaagaacaaagatggaaagtaagagaaagaggtagaatgacatgaaaatctgatccagaaggtgcaatgtctgttttatatgagtaccagaatgggagaaaatgggagggattataatcaccaaaattctaaaggaaaagttatgtaaatatctaataataaaagctaacatttaattaagcataatcctcattcaacagatgaggaacctaaaaccgaaagagtcattatcactgttccacttatttctatatccttacaaaaatacccactcttgatctgtaacaatgtctccttaaactccctgaatggcagcttcaggtaaaaacttcccagaaactttgaaataacaaggataaaaggaaaattcttggagccacataaaaaagaaaacagatcattacaaaaaaagaagaatcgggcatcagttctcattatcaatactgaattaaaaagaaacccaaaaaaaatcattatttttctaggcctataaaaaattatttaaaaccaaaattttaatgtctgttaagctaacattcaagtccatggataacaaatgtaaataggttaaattctctagtaaaagatagcaactttcaaaacatgcaaaatatactacataacacatatacatattttacatattactacagacttcatttatgtatgtgtgtgtgtgtacacatatataatatgaaataaatgaaatactttggatatttgtccccgccaaaatttcatgttgaaatgtaatccccaatgttggaggtggggccttatgggaggtgtttgggtcatgggggcaaatccctcatggcttggtgctgtccttgcgataacgagtgagttctcacaagatctggctgttcaaaagtgtatggcatctccacccctctcctttgctcctgttctggctatgtgagatgcctgctcccccttctccttcaaccatgatttcaaactttttttttttaatttatatttatttttttgagacagagtttcactctgttgcccaggctggagtgcagtggcctgatctcggctcactgcaacctctgccccgcaggttcaagcgattctcctgcctcagtctcccaagtagctgggattacaggcacctgccaccgcgcctggctaaatgatttcaaacttcttgaagccctcaccagaagcagatgccagcaccacacttcctgtactgtctgcagaatcgtgagccaattaaacctctttttgttatcaattacccagcaacaggtatttctttacagcaacacaggagcagctatatatatgcacaatgcacagtgacatacacaattcaaaaacagacttgaggggaaaaaacacaaacgctaaccaaaaaatgcaggtatagcaataattgcaaagaaatagaatttaaactaaaaagcagtgaacaagtcaaagataatatttcataataacctaagttttatgttacagtgtaaattccaaaagaagccatagtcattaaagtttatacacctaataaatatatgtcacatataaaaagtaaagctgagtagaaataacatgcatagattagactttaacatagctctcaaatcaggatattaagtagatatgaaataaataataacaatgatcgggtttgattcaaacagacacataaaatacacacagatctctgtattccaaaaatagagaaaacattctattcaaatatacatagaattttcaaaaaaaaatccacatgtatggtcgtaaagaaatgtccacatattttaaaaagcaggtatttcctaggttatattcagtaaaagcagatgtgtccctagacctaatacaataaaaattagaaattcacaatataaggataaagtcccaaatctatccactggcaaaatttaaaagtcctttctatataacggcagagtttcaatcaagaagaaaaatcatgtattatttttaaatgattaagaaacatcaaaaaaatctctgagacgtggcaaatgtggtcttcagaggaaaacatatagcttcaaacatgcaaaactataagactaaagaattaaaataaataatgcccaattcaaaaattaagccaataagaatcaacatataatccatgagattcacaatctagggaagtaaacccaccctaatactgtgtttattaaaatgctgttaatgagatccgaggtttaaacaactgttcactttagaaaatgaaataaagctgactgaaataaaacctaatctatgaaattattctgtatatgaattgacctgaagtaatgaacagttcattgactgactcataactcttgttctggtccaggctaatcattctagttggcatactattaaacacacatttctgattgaaacatctgctaaaaaaaataacatcaaacgacattacaaaatcaaaatggagactgctaagagtgggatttttctcctgccagtacctttcctttctgccacattctcctccctgctgccacagtaatctttctgaaggaatacaaatatattctgaatcacacgcaaacccctcaatacagaatgtgtggtaggcagtattctaaaatgcccgcataccaccgaccccaccaaatttcctaccctaatacagaggctgtaaatatgatgaaatatcatggcaaggataatgccattaatatattatatggcaaaggaattctgcagatgtgattaaagccaccaatcaactgcctttgaattaatcaaaagggagatttgcctaatctaatcaaataacctctttgaaagcggagttttctccagctagtagcaaaagggaaattcatagcaagggaacatttcaatacactgttgctatctttgaagataaaaagagccacgaggaaaaaccaaagagtggcctctaggaactgagagtgacccaagccaataggcagtaagaaaatggtgagctcagcagggtgcggtggctcatgcctgtaatcccagcactttggaaggccaaggcaggcggatcacgaggtcatgagatcaagaccatcctggctaacacggtaaaaccccgtctctactaaaaataaaaataaaaaaaaaaaattagccggcgtggtggcgcacgcctgtaatcccggccacctgggaggctgaggcacgagaatcacttgaacccgggaggcagaggttgcagtgagccgagactgcaccactgcactccagcctgggcggcagatcaagaaagaaagaaagaaaatggcgagctcagccctacaactgcatagaactgaattcctcccacacctgaatgcacctagaagaggattcacccccagagcttccacccaggtaacaccttgatttgaatcttgtgagaccttaaacagagagcacaggtgagcctaccctgagttctgacctaagtaaatggatgctgttttaagatattaagtttatggtaattgctttattgtaacagataacaaacagagcagcatttcaaggccctccatgctttggtctctgccaaatcactattacatttttaagatttttttttaaacattatacttacattacacaatgtcttaacactatgaagtaaaaatgtaaatattttaaactctggcttggaaatgaggaggcagaatctcagatattttcctaaaaaaataggagaggcaagctttctgagtccacaaaagtgccctctacctattgggtcaaagaaaaagtaatctctctatttgtaacaacatacataaattataaaccctgaagaaataggtccctaatagctataatctttaacataaccataaataaaaacatgaataaatctgactacatagaaatgtaaaaacttctatgtggtgagaacacacattacagaaaaaaaatcaagtgacaaaaaataacctccaatttgaattacaaatatctagtatcctggatatatacaaataaagcatgtaagttataaaaatgagtataattttaaaatagacaaggatagtttatagaatttcataatttaaggaagacataagttagccaataaactatgggtaatatgcaagaatcagtaagcattattatttgccagcagctaagccaagtactttataagaattactttattcccatctacgccaggcacagtggctcacgcatgtaatcccaacactttggaaggcagaggtaggtggatcacctgaggtcaggagtttgagaccatcctggccaacatggtgagaccccgtttctattaaaaatacaaaaattagctgggcctggtggcaggcgcctgtaatcccagctacttggaaggctgaggcaggagaatcagttgaacccaggaggtagaggttgcagtgagccaagatcgcgccactgcactccagcctgggcaacagagtgagactccatctcaaaaacaaaaacaaaaaaaaaaagaaattactttattcccatctaaccaccaccatttcaggtagatattactatttttcattttacaaatgaagcagagaggttaaatatccttgttcaagcccaatgagtcaggaaatgaaaggaactgaactcaaggagttcataattagttatatacaagtaataaagacaaattcatcgactatggaaatgtactaagtactttgtcttgtttacgtaatggtttttatttaggttgtaagaaaataacatatggacaggcacggtggctcgtgcatgtaatcccagcactttgggaggccaaggcaggcggatcacttgagaccaggagttcgagaccaacctggccaacatggtgaaaccccatttctaccaaaaaaaaaatacaaaaattagccaggcgtggtggtgcacgcctgtaatcctagctactcgagagactgaggcaggagaatcgcttgaacccaagaggtggaggctgcagtgagccaagattgcgccactgcactccagcctgggtgacagagctggaccttgtctcaaaaaaaaaaaaaagaaagaaagaaaagaaagtagccactttggggttagaatccataaaatactctcagtgtcaaccaaaagaaatgtactgcaatgttcatagaacacaattcataatgacctcaaattgaaagtcctcaaaatgcccaacggtaaaataaataaattatagtactcttaacaacagaatactatacatcaatgagaaaaataaacgactggaaggaacaatttggatttatctcacaaatatatacatgaaagatgacagaaaacagtacttagtagccaattatacaaagtacaaagccaattacacaaagtacaaacataggcaagactcacctatgttgttactagatgatagtgcatgtctttggggagttaggaatagtaaccaacaggaggctgaatggaatttctggggcgctattatttgtttcctgatgtgattttagtatatacgttctaatatttggggtattcctagaaatgtgtacctattattcacttgctatatatatagcaaagtgaattttatatataattcttcaacatatttttagaaaaattaagttttttctagaaaattaagagaattttagataaaaactcaacttttaatggaaaatattttcctttttctttctcacatgaaattctatatcaaggttagtatcctacctggtatctctccaatagtgggttaagagtttgttttcttctcaagtaacctgtattatattaagatgatattaactgaaataatcagatagatgaatgcgccataaagctaattctaagatatctgtccttagccaaaagcagaaaagggatacacataacttccacataaaacatccacccccatttttttggttattcttaaaagctcataatgtatacaatgataaaatttattgtttcaaattagggtttttgaaattgaaatattaatttaaacacgtttgcttaacacaactttaaagttaataagaaaacactgcctattacagaagagttaaatacttcaaaaagtgggaaaaaatttaaaagctttcattttagtaggagtaaacacagacacagtaagaatcaagttagttggatacacttaaatcatgtcttttaagaacatgagaacagattatttgctttctctttagtccaaaacctgggtgtaattttagtccaaatttgaaactaacagaagaatactcagcttcttaaaagttttatttcaagaacagtaaaagaacttctggtcttacaaacattacacagataaaacgagtttctccaaacagatgtatgtaaaaatctagtacatatacccccaaggtgagtcaataaggtgaaccagattctggttgaatggaatccttgaaacataactttggtgaacaaactgtttgtgttttccacttttcttaaaaaagaagtgataaagcagatttccagtacctgccaactgataaaatgctacttaccaggtaaaaaccactaccaaaaatcagaatcacagaagggctatcagtaaaattactaatgccacaaattaacatgatgttaactgctgaattatgcatcaaaagagtatttatataatcacagcaaataactcaaatcttttacatcactagtaaactcaaaaaaagatagaaaaaagcaataacattaaatttccttattgatctactagctttaactatttaatactagtacacttagttttgattactttgaaattgaaacaaaaacaataatcttttcttcttttaatgactttttcagttataggaaagatgatattaaaagaaaatatacaactatagcttagctacaggtataaaactgttttaaagatatgtaattgtgctattgaattaaactgaaaacataaatatcaactcatgattttgaaaaaaaatctttatgtttggttttggtaaaaggagagacaaataagtcagaaaaacagaaaatacagaaatagactcacttttccatattcaattaatttttgaccaaggggccaagataatccaagagagcaataaatagtcttttagaatgatgctggaactgctaaataatccgtatggaaaacaaagaaacatgaatcttatctcaaattcttttatcatatgtgtaatttaaccataaatggattttttaaacctacaactaacactggggcaagcaaagattttttaataaagcataaacagcataattttttcaacttccaaaaaattaacaaatgaccaatgtcatcaaaattaaaccctctgctgttcaataaacattgctaaataaatgaaaacaagtcacacattaggcaaaaatatttataaaatgcatctccaaaactgacttctgtgaataatatataaaaaaactcttacaactcaagaagatgacaagtaaatcaattggaaaaaaatggtagagacaaaataacagacatgtcaccaaagatacacaaatggcaaaaaaagacataaaaagaggctcaatctaattaatcatcagggaatgcaaaatcaaacccacaataaattatcactaaatgccaaccagatggctaaaatttagaaacagtggcaatatccagtgctggcaacaatgtacagcaaatggaactctcagatctctagaaacggagaagtatacagacacttaagaaactgtgaaactgttttccaaagttaagaatatatttccaacaagtcagaaattccagtcctaggtatttacccaagaaacatgaaaagatacatccacaacgaagcatgttacataaatgctcacagcagctttatatactggccaaaaattgaacgaaacttaactgtaagctagtgaatggaccaatctcaaaaccattatgctaagtaaaaaaaggcagacagaaaagattctatactgtatggttccattcatatattagtctagaaaaggcaaaactataggaaagcaacagatcggtgattggcaggagctggagtgggaggtaggcagtaacttcaaaaggtcatgagtgaatttatgggtaaagggtctattctgtatcttgactatgatggtaattacatgactgttcatatttaccaaatcacattcaatacacaccttagaaagggtgaattatagcgtatgcaaaatataccttaacaaaacaatggctctcacacataaatttatttatttattgggtaacagcatagggactaatatcagagtaactttcctaaaatgtctcaaatctgaagaaaacgtaaaagctaactaattgaagttacctgtaaataaccaaaaactggctggaatgggaggacattatacccttggaaaaaaagcagaatatcattggctaaaatctatatttaaatagagtttcagtctgggcgcgatggctcctgcctgtaatcccagcactctggaaggccaaggaaggtggaccacctaaggccaggattttgagagcagcctagccaacatggcgaaaccccatctctactaaaaatacaaaaattagctgggtgtggtggtgggcacctataatcccagctacttgagaggctgaggcacaagaatcgcttgaacctgggaggtggaggtggctgtaagccgagatcgcgccattgcactccagcctgggagacaaagaccctgtctcaaaagaaaagaaaagaaaattctacaactaataagtatggtaatttcaatgaaaattttagtggatgggcttaacaagagattggtagaaaattggtccatctccttgaaaatacatgaatagtgtatctattctgaggaactaaaagtaaaaacactgggaagaaaacgaacagaccctcagtaatctacaaaatatcaaatatactaacattcatgtaattagagttacagaggaagaggagagagaaatgagacagaaaaagaataagaaataaaagtcaagcttttcacaaatttggtgaaaaatatcaacttacagtttcaagaagctcagcaacccccaagcaggatgaatacaaagaaaaccacacctaggcacatcatagtcagactgctgaaaaccaaagataaagagaaaatcctgaaagcagccagagaatatcaaaacattattatatacatgggaataatgatactactgacaccacacctgacttctcattagaaaccatggaagacaggaaacaatgcaacatcttttaaatgcttgaagaagaaaaacataatcatcccagaactctgtattcagggaaaaacagcaaaaatgaatgcagacttccacttccagacaaaatgcagaaaatgtacttttccctgttctttccactaaatacagctttaaaaacccttagccgtgatacataagacaaacaaaagaagacaacaaaatgtagagagagggcagaccaattagggcttcaggagccaagaaacaaaagaggatgaattccctaggtttcctttctgactcatatatacaagaaaagttgctagagaagcagacaactcagaaacaccaacaggcacacacatacgtaaaactccaagaaaattctgctgtcttttgtcaaaaaagcagggaagcggcaggctaccaagacaaaaaactcatagacaacaacaaaccagtttaagccaaatggtacaaataaaagcccaagccatataccttttgcaaagacttaaaaggaggacatagtcagccattccccactcctgcccacggacaacatgataccacagcaggccaactgggacacaggacattcatacccactgagcagtaacgcggcttcctccctctagagtgtgggtggaaaaaaagtggggagcctgagttcaacacccacccagtgataaggacatatccctatccctccctctacagagatatgacaggagaggcctattggagaatccaaactcaaagcactgcccagtgataacttaaccacccctccatcccattcagtggaggccaagtgaaaagcaggaaccttttgagccagggtggtattcacaaaggtgtaatgcaagtccagagttttcactcctactcagcatttactaggtgtacgtctccatcaatgagtcaacaaaggcctactaaggaactggaatcttcacatacacctgggagtagtaacaaggctgtgccccacctccaccccaaaagcaaagtttcagataaatcctactaaaagggggtatttaaataaaatgcagagcttcataacacaacacttaaaatgcaaaggattcaaccaaatataacatgttataccatactaagaaccaggaaaatctgaacaggaatttgaaaatatagtcaaaaggtgcaaacaatgagaattcatagatgtcataattatctatcaaagattttaaactatataacactgcttcaacaagcaattacagccggacacagtggctcacgcctgcaatcccagcactttgggaggcagaggtggttggatcacttgaggtcaggagttcgagaccagcctggccaacatcatgaaaccccatctctactaaaaatacaaaaattagccaggcatggtggtgcacgcctgtgattccagctactcaggaggctgaggcatgagaatcacttaaacccaggaagcagaggttgcagtgagctgagatcatttactgcattccaacctgggcaacagagcaagagtctgcctcaaaaaaaaaaaaaaaaaaaaaaagcaattacaaacatacttttgaaacaaaggaaacaatacaaagttttgcaaagaaatcaagaaagaaacaaataccaagttgaaaactaaaaaatatgctaacaaaaataaaatacaaactaagctgaacaacaaaatgggagagattacccaacctaaacaagagaagaaaatgaactgatttaaaaaaaaaaaaaaaaaaaagtggccaggtgcggtcgctcaggcctgtaatcctagcattttgggaggccgagatgggtggatcacctgaggtgaggagttcaagaccagcctggccaacatggcaaaaccctgtctctactaaaaatacaaaaattagctgggcatggtggcacacacctataattccagcgactcaggaggctgaggcaggagaatcacttagacccaggggcggagtttgcagtgagctgagatcgtaccacttcactccagcctgggcaaaagagcaaaactctgacaataaataaataaataaataaatattttttttttaaaaaagacattaaagacacttgtgggactataataagtgatgcaacattcctgtcactggaatctcagaaaaggaacatgacgcagctgaacaattattcgaagacccacagattcaagaaattgaataaatcctaagaggatacacacaaataaatcaatgctaatatatatcataaacttctgaaaactaatgactaaactaaaaaaccctgagataaataagagaaatgacaccttatccacagatgaaaaacaactcaaatgacagcagatttctcacctgaaaccatggaggccagaacaaagcagcataacatttttgcaagtcctaaaagaactgacaacaaagaattctatatccagcaaaaacatccattagtaatgaaagggaaatcaagaaattgtgagatgaatgagaactaaaaattagtcatgagacaaaactacaccaaaagaatagtgagaaaagttattgaaccagaaaggagaatgataaaaagaaggattctcagaacatcctgaaggaagaaagaacaaacaaatagtaaaaatatgggcaataaaacagactttactgttccttgagttttcaaaataatgtttaacaattgaagcaaaaattgttacacgatgcaaaagctatggtgggtaaaactgttgatgcatttccaaaactgaaagcagttggcaccaagctgtattagaagttgtcacattctcaattggcactacaactacagtaaaaataatgtagagtatcattgagaatatcactgatgaagcagcaaaaatcattaatgttttaagtcttgatccatgaatacacatcttttaattatctatgtgacaaaacgagaaataaagagtaaaataattgttacaccatagtttttcttgaggaaagaatttgtgatcatgtgatttataaactgaaataaatgcttttttcatggaacaccggttttacatgtaagaacaaataacaaaccacaattattaaaacttgattatctaacatatttcttgaaaaaaggaataaagtgagcctgtcacttcaaggaaaacaacttagaacatgagtggacaataagaagatttgaaaaacttatatccaacaatgtaagcttaactaattccaatacttaaagacttttctgatgagatcagtggattataacaaatgtgaattttgttatttattaaaaatgtgtaggactaggcaaggtggctcacacttgtaatcccagcactttgggatcactggaggccaggagttcaagaccagcctagccaacatagtgaaaccccatctctactaaaaatatgaaaattagctgggcctggcggtgcatgcctatagtcccagctactcaggaggctgaggcatgagcatcacttgaacccaggagacagaagtgagctgagatcgcaccactgcattccagcctgggcaacagagtgagattctgtctcaaaacaaacaaaacaaaacaaacaaacaaacaaacaaaaacaaccgtatcaatagttggaatatctggatcactcagtgaaccaatattttccaaagaccacttagtaatcttataaaatcatatatgggtaaaagatcccctgaaattgcaaggtagtctaataaattttatatatatatgtgtgtgtgtgtgtgtgtgtgtgtgtgtgtgtatgtgtatatatatatatatatatatatatatatatatatattttttttttttttttttttttttttttttgtctgagatggagtctcactctgtcacccacgctggagtgcagtggcacaatctcggctcactgcaacctccaccacctgggtttaagcgattctctgtctcggcctcccccgtagatgggactgcaggtgcctgctaccatgcccggctgatttttgtatttttagtagagacggggtttcacaatcttggccatgctggtcttgagctcctgacctcgtgatccacccgcttcagcctcccgaagtgctgggattacaggcgtaaaccactgcgcccggcccataaattataattttaaagggtaaagatataaagttcattgatgggattgcagtcttcagattgcaccaaaccacttgaaaaacttgcgaaactaccacttctcaagctttggtttagtatcaaacaagaatattcattagggcttgtgctttcattcttatagtatcttttaataaacagaagttatttctcaaatgtagttgaatgctccaatattttcctttacattcagtgctgtatctcaagaactcttttacaaaaatattatcctatattatctttttaaatataaataaaaataattatctttttaaaagcttatgagttcaggtagaaatatgaagggctaaaaggaattggaagacattttcctactatttgttctttctcttgattttcatgattcattattcttgtagaagtgaccttaccacagtataaggttcacttataatcactgttctgccttgtaattttaggtgaatttgttacaaaatattatgaaatctacaggaaaagccaactttcaaagctattaagtatttgacttaatagttgagggcattattattcagaaaaatttcaatctcattccgcagcgcaaaaaactgcaataaaactttaccactgccaagtcactaaattgctatgtagaatggcaattcagtatattctgcctctatatctaacaaaaattcataggatttgatgatgaagtccacaaatgcaagtcaaaatcactgctgacactattatataatagttcactaaaacatgacagatttaaatattttctgcaaagtacctgctaataaataatacagtaaataatcaggctttaaacacctgacatttaacaagctttgtaaatttgtccaactcaagtctttctgctccacagttatttttgccactatcaactgtaacgcatcttagcggattccacttcaggttgtactaagttagtgtttgctcaacttttctgaaaatattttctcttgtagttgtttcacatagactatgcataaacactaattcttccatcacttcaaactcagcactaacttctggagtatgtaacaactgaacagtactggtaacacctattcatccatcaaaagcctaagaaaaccatgaaaaatcattcacccttctttccaaaatgacttgatattactcccaacgtccttaacttttagagcaattactctcgctgaaaggctaatagtcttttttaaagtttattttctatggacacatctttgtttaccttaataaaacataatttaattaactactgttggtaatggttttccttgcttggctaacaaataagccattgaaaaacttactttaattatagcctaatttccattttttgtttttgagaagaaattctgctgtgataaaattttgttttaatttactatttttttttctgaccttttagttttattcctgttggctgggaatattgtgagaagtgccaagtctggtaatgctgacatatattatattcttttagcacagccatagtcttctagcataataaatataatgctttgctatctaatttgttaataataatatacattccactatacctctaaagtgttacatataaagtccacttttctccttttcttgttttaacatgataggtgggtatgcactggtaatgagagaaataaataagatgccagggcaatatgtgtggcgcgcacacacacacacacatactgacaaactgtaactatgtcattgtgattcgtagcatgcagagcagcaatttgaaatatatgtgctctctgcagcaaccaactctgacactgtagtgcaacagaagtcatatataatgcccaaataaatgggtgtggttttgttcccataaaacattagttttaaacactcatacctgaatgtcgttatgatttcctgtgtcataaaatattattcccttttaaatttttttcagacattttaaaaggtaaaaaacatttttagctcatgtcccacataaacacagctggaggaccgaatgtgaccccacaggctgtcatttgctgacacctccatccacccctctgtagccttcagggtcctaaataaacttctatagcatttaatgacccctaaattccctttttgtcttcccagctctgcagactgccagaagcttctcagcttttcaacctctcagctggatttttttgaactgagtaattaactcaaggggaaaagaaaatttaaggtcaggccaaactctgcacaaccttaccctctgaattctcactccctcaggtcctcaccactcttctagttttctgatcccttaaatatttatttgaaacaacattttatacagcttttctaattgttctcagtggaaaggctagtctaaaccaagtatctctgccataggaagaggtggaaataacacttatactaccgaatagaaagacttagtataaagctacagtaacaatgacatcatgatatatcactgggattctcaaatacacaaagaataaaacagagaacctaccaacaatctaaaatacattgaacgtttgctatataataggttatatttcaaatgtggaggaaaaagatgtttcaataaatggtgtagtaacaattggctgtccatgtgtgaaaaaatgatactggaccccttatatcacatgatacacaaatcaatttcaaatagataaaacacacaatagtgcacaactagagaaataagtttttgaagtatattttcaaaacaagttagaaactgttaaaaggtttttaatttttgaaataaaaacattaccatggttcaaaagttcctaaagggtatgcagtataaaatcactttgtatacaactatataaaataagtttcctacaggcaaagaattttaccagtttcctatgcatccttcacaagatattttatgcagatgtaagttcatattattctccacccctcccctaaactttacattcaaggggtcctttacaataccaaagaataccacccacctcatcacaaaggtaagttcatttctttaaacttatttaatactaaaaagaaagattaaaattaaattgagacatcttcattgaatgggcctaccaaaatttaactgtttttaaataggcatacaaaactcttaattttctaaaacaaatttttcagcttcctcttagctccagagtcaaggtgtcaaggtgacgggaaataaacatattcattcattccctcattcattcatttttgagacaaagtctggctctgttgcccaggctggagtgcagtggtgcaatctcagctgactgcaacctctgcatcctgggctcaagccatccctcccacctcaacctcttgagtagctgagactacaggtgtgcaccaccacacctgcctttttttttttttttttggtacttttagtgaaaagacagggtcttgtcacattgcccaggctggtctcgaacttgtagctcaagttatgtgcctgcctcagcctcccaaagtgctgggattacaggtgtgagccactatgcccagccacatcaatttttaagtagatatatgcctaacggcattccaaggtcaaataaatatctaggattatcttgctgtaccgacaccttgcacttaacattgtgatgaaataatccattgttaattttttgatgccttccttctatccctgcatttcagagtgaaaagataaaacaatttcttactgtgtacatgatgattgagtactgacaggtaacatgacctggggaagaagtcacttgacattagctaacaatgtcagagacagattaagaagtgaagactcccgattgcttcccattaaaaataataattatgaccaggtatggtgacatgtacctgtagtcccagctatgtgggaggctgagctggaaacattgctagagttcatagttgcagtatactatcattacatgtgtgaatagccactgcactccagcatgagcaacacagcaagatccctctctgccggacccgccactcccaaaatagaagactctatctcttaaaaaataaatattattaggttttatttagaaacttttatttagaaaatcttataatacaaaaacacacttgagaggcatttgagattattgaccatacctccttaaatctattaatccaaactactataatttctactatacttcctgtaacttattctgtgttaacatccaccttttcactggttcttcctcagagcattgaccaaaggatcaatcttccatcttcttttctcttcttgttctccaaagtcagtttgatttgccaccactgctagttaggaaaactgtctatgattcctaccctgacatttagtgtcaaagccatttcacacggtttcaggctcagcacaaccaaacaaaacttgtgatcttccaacatacttagacttgaaaaaaaagacatctgcagttcctccatctaatttataaagaatcaaatactatgcattctattacaatatttcatctttatgttttacacataatacctaaactcaagattttacactcattggcctttaatttatagcagtaatcctaaatatgtttgtcttcaagtaaaccttttccaattcaattacaaagggctgggggaatttagatcatttaatactgctcttcttatttaaaaggtacattactgaaattcctcatcttggtatgcaaagccaaggaaattttccattcctgtcccctagtattctctaccctacttattctccagtcattcttacgtatgtgccatttttccaaaatccatataccctcatagtttcaaaccctgtaaagggtgaccctctgtctagaatccctatgttaatctactgaaacttacccatcctccaagcaccaccttaaatctttccttctttaaaaatattttcagattccctcagttaaaacatatttccaataatagacactgtttattgcctataaaatatccattccccctttttccttcctacagatttccactttttcagatacgcaccctgctctaagcagaaacatgcttcagaggggctaaatactctccccagcctcagaggaaagccatcatggctgtctcaacttctttatcagttattggtttaagatatgaacgctcggctgggcgcagtggctcacgcctgtaatcccagcactttgggaggccgaggcgggcagatcacgaggtcaggagatcgagaccatcctagctaacacggtgaaaccccgtctctactaaaaatacaaaaaaaattagccgggcatggtggcgggtgcctatagtcccagctactcgggaggctgaggcaggagaatggcgtgaacccaggagacagagctggcagtgagccgagatcacgccactgcactccagcttgggcaacagaacgagactccgtctcaaaaaaaaaaaaaaaaaaaaaaagatatgaacactcaaggtaattctagctaataaaatgttaagaggaatatgccaggggcagggcgtggtggctcacgcttataatcctagcactttgggaggctgaggcgggcgggtcacctgaggtcaggagttcaagactagcctgggcaacatggcgaaaccccatcccatccctactaaaaatacaaaaattaaccgggcgtggtggtgggtgcctataatcccagctactccagaggctgaggcaagagaatcacttgaacctgggagacagaggttgcagtgagccgagatcgcgccacttcaatccagcctgggcgaaaggcgaaactccatctcaaaaaaaaaaaaaagagagagagagagagagagaaatatgctaggatgggacaagcatctggcaaggatttttccttaattaacataataataaaaaggttcctttttcctttctgcctctgaatgctatcctgagagtacaatgcttagaggtcctgcccactatcttttgctcatgagaggaactggatcaagaaagagaccaatatgttctggatgcaccaagaaaagatgttaagaccctgacaacttgttatcatgaagctactgaactacccatcaccctaactcctaattttctattgtgaaataataaacttcttagttacttgcataatacttctaattctgaccaagatggagtcacagagaccggattatcggatttacgctcctcctgaaacaaccataaaaaatgaagacatggcagggcatggtggctcacacctgtaatcccagcactttcagaggctaagacaggtgcgtcacttgaggtcaggagtttgagaccagcctgacaaacatggtgaaatcccatcaccactaaaaagaaagaaagaaagaaaaagaaagaaagaaagaaagaaagaaagaaagaaagaaagaaagaaagaaagaaagacagagagagagagagagagagagagagagagagagagagaaagaaagaaagacgtgaatatatgtgaacatatatatgctatgtgaacatcaggcaacaaaggactgtagagctttgagaaatgagaaacaaaagaggtgagccctacatatgccccagcacacaacgataagagtttccaggccatggcatagagagtggcaactgaggcaaatctcagctgactcctgagttggaaagagaaagttaagagccaggagagaaaaaagcagcaaggaataactgcacagaatgctgagaggagacagttgcatagaaaagaaccccagaggtctatagagatcttctctcaagcattcaccagataactgatcagcatatgcatatgaggaaactatgagaatccagaaaaagaaccatcagaaacaatgggagggaacagggcctgatactcatacaaagccaggaatagtatctgttcccactagccaaactgggaaaactattaattcatggaacattcaacagagtccacagaaagtcttgcctcagtggtgaggaataattagtcctggactaagcactccttcatatctgtctaataaatcataaaaacaaaacccaaaagaatgaaacggtttataagtaactcaactacatctcaaaacaaagctcaagaagatttatagaataaagaaaatagccagaacccaaggtaaattttacaactaaataaagattaccaggcataaaaagcagcagacaatcatgatgcaaactgaaaataatcaatcaaaactgacccagaacttaaatagatgttaaaattagcagaggaggacattcaactgtttttatacatgtatcccatataatcaaaaagttaaatagagacatgggagataaacaagaaaagccaaaatcaaactttcaaagacaaaaacatttgagatgaaaattacattggatgaactaaagcagattagaaactgcagaagaaaagattagcaaacttgaagatacaagaacagacactagctaaagtacaaaaagaaaaaaaaaatcttaaaaagtgatttttaaaaagcatcagtgagcagtcaggcaacttcaaatagcctaataatatgcaggtaactggagtccccaaaggagaaaaaagaggaagagaaaaaaaatacttgaagaaacaactgctgaaaatgttctagccataaaaagacctattaactcacggatccaagaaactcagcaaaccccaagcacaagaaacatgaagaaaattacattaagggataacataatcaaattgttcaaaatcagggatatattattaatagcagctgtataaaaagacatgttacctatagaagaacaaagataagaacaacatcagatttcttttgagaaacaatgcaagtgagaagacagcagtacatctctaaagttctagaagaaaaaaggccaactagaattccatgcctggcaaaaatatctttcaaaaatgaaggtgaaataaaggcacaccagaaacataaataatgaaataattcatcaccaggagactttcactgcaagaaatgttaaaggatattctccagaaacaaaatgatgtcagatgaaaatctggatcaatacgaaggaataaagagcaccacagtggtaactatatgagcaaacatcttttaaattttttattatttaaatctctaagagatatatgtttaataaaagacagcaaaatattacagagtttataacatatataaaagtcaaatgcatggcagcaatagcacaaagtgcacgagggaggaaaagaaagcaaatgaaggaatgcttttattatagatgaagtgtacaatattacttgaaggtagacctctctaaatgtacactataatcttaaagcaactacaaaaataatttttaaaaacaggtaaaagtaataaaaagaggcaaactggaatcataataaataatgtaggctgggcacggtggctcacgcctgtaatcccagcactttgggaggccaaggtaagcggatcacaaggtcaggagatcgagaccatcctggccaacatggtgaaaccccgtctctactaaaaatacaaaaattagctgggtgtggtggtgcacgtctgtaatcccagctactcaggagactgaggcaggagaatcgcttgaacccaggaggcggagactacagtgagccgagatagcgccactgcactccagcctggcaacagagcgagactctatctcaaaaaataaataaataaataaataaataaataaataaagtaaaagaatccaagaagaccaggtgcaatggctcacacctgtaatcccagcactctgggtggccaaggcaggagactcacttgagctcaggagtatgagaccagcctggacaacatagtgagaccccatatataaaaaaataaaacaaagtagccaggtgtggtggtgcacaactgtggtctccactattgggaggctgaggtagatcacttgagcctagcaggtcaaggctgcagtaaggtatgatcacaccactgcactctagcttgggtgacagagtaagaccccatcttggcaggtgggggatgcaagaaaaatgatgcaaggaacagatagagataaatagaaaacatataagaagacaatcacattaaatgtacatggtctaaatacccccaattaaaaagcagaggttttagaccatatacatttaatgtgattgtcttcttatatgtttttatcagagaaataaaactatcgccttcaagaaacacaagttaaatacaaagatgcaaacaggttaaaataaaagaatggaataatatacaccatgcttacgctagtcaagagaaagctagagtagaaatactaatatgaggcaaagcatatttcagagttaaacacaacatttttctactacttgcagtcaaaagtatcattaacagtctctttactctgctcaaagttacaaagttcttttgtataaacattagaacacttatcacagcctgtctataatggagaataattcaatgttatatactatacaacactcttactatagtccattagacagaaatatgtagcatttgagacaccttccaattataaaactctatgcaaacaaaaattaacaaagcagatctgagactattacattatcctgtgaaggagggtctgtctgtttgcacagttggtcctaggctggcttctgagaacttgaatttcaagagggttccctaactggtaatcatggtttactatatctagactatggaaataatgtggcttatcctgctattctttttatgagtctggaaatttcacacatgctaggcagagagtacacctacatgaccagcctagataaaaactgtgtttcttgggcagtcacatatgttgttgtattttcgttaagggggaaagaaggtagtctgtgtgatcctcatggaaggcacagcacataaggaagctggtacatggatttttccagactctgtcagtgtcttttgccattgaggtctttctactatatatccatactatgttacagtaataaatcttagccattacaaccctaagctgatcccatgagtccttctagcaaatctccaaacatggaggcagtcttgtggacccctgacacaaatatatggttgtgatctcttaaggtttatccttcctcttaaactataaagagctggccgggcacagtggctcacgcttgtaatgccagcactttgggaggctgaggcgggtggatcacgaggtcaagagattgagaccatcctagccaacatggcgaaaccccgtctctactaaaactacaaaaagtagctgggcatgctggcacacatctgtagtcccagctactcgggaggctgaggcaggagagtcgcttgaaccagggaggcagaggttgcagtaagccgagatcgcgccactgcactccagcctggtgacagagggaaacttcatctcaaaaaaaagaaaaaaactataaagggctgggcgcagtggctcacgcctataatactagcaccttggcaggcccaggtgggagaactgcttgggcccaggaattgagaccaacctggaaaacagagcaagaccctgtctcctaaaaaaaaaaaaaaaaagaaaagttggccgggtgtgatggatcacacctgtagtcccaacactttgggaggccgaagtgggcaaatcacaaggtcaggagttcgagaccagcctggcccacacggtgaaactccatctctactaaaaaaaaaatacaaaatattcgctgggcatggtggtgggcacctgtaatcccagctacttggaaggctgaggcaggagaatcacttgaacccgggaggcagaggttgcagtgagccgagatcatgccactgcattccagcccgctgacagtgtgagactccatctcaaaaaaataaaaaagaaaagaaaagaaaagttagccaggtgtggtggcatgcatttgtgatcccagctactctaaaggctgagacgggaggactgcttgagcctaagaagtcaaggttgcagtaagccatgatcgtgccactgcattccagcttaaacaactgagatgctatctcttaaaaacagaagtagaagcaaacaactataggggaaaatgagggatacatactttaagaatttctaaaaatttacatggaaaaacactaggattctatagaaaataaaacagtattaaataacattatttataaaatagatactagcaaattaccttacgtaaagattcaagtcagtaacttaaaggatcttacataaaagtactttccattggttggaggagagacttttactatacactgtttttcaacttttttagacaaattacatttagaagtttaaatttgcctatctacattcttaatgtgaattgccaccttactataggaaggctatttttgtttctgcagtctacaaaaagaacaaaaatattaaaaacgtacaactcttctcacagaactaagttggttttacacaaagacatctggcacaaaatacaatgaaatttcaatatagaattacagcaggggatgagggtggagaaggaagagattaccaattctatgaggggagacaacagaagtatttttttaatgtcttattttaagagtaaaacacctggttttttttgagatggagttttaggcaggagtgcaatagaacgatcttggctcactgcaatctctgcctccaggattcaagtgattctcctgcctcagcctctcgagtagctgggattacaggcacacgtcaccatgccaagctaatttttgtatttttagtagagagggggtttcatcacattggccaggctggtttcaaactcctgacctcagcctcagcctcccaaagtgctaggattacaggcgtgagccaccatgcccagccaacactgaacattttattcagaaatagttaagaaaacagaaatatacattgggggtttatggattacttctttttggggggcaatactgggaatagaagagaaaggagcttcctttccctttccttctttcattcattcattcattttgagaagaagtcctgctctgttgcccaggatggagtgcagtggcgaaaactcagctcactacaacctccacctcctgggttcaagaaattctcctgcctcagcctcccaagtagctgagattacaggcacacaccaccacacacggttaatttttatatttttttagtagagacagggttttgccatgttggttaggctggtctcgaactcctgacctcaggtgatccacccgcctcagcctcccaaagtgctgggattacaggcatgagacgccgcgcctggccaagaaaggaactttagataaataaaatgattaaacatttgtagcatgtagaatgaaaatattccctcagtaatactcaaattatccagatttccaagatgttggtagcaccctgagagcttcaaaagggaaattaaaagaaaaacgacgttacccttcctgaaacacagattcactgtttgccatgttcttttctctagtaaaaaatgaataaagtttcccctggaaaaactaaaaacaatctgaggtatgtttcagagaaaacaaaattgcttgacaaaaatgccatgttaacaaccgaggaaattactttaaatatattaattttaacacaggaataatatgtcaaaccaggatttctcaacctcagcactatcggcattttaagctgtatagttttggtgtgggaggctgtcctgcatattgcagaatgtttagcggcagtcctggcctctacccaagaggccagccagtaggacctacctcctcattcaagctaatgcactaaattttgcccttcattgacaaatcccattaatgcatgtatttatcccattagtgactctcttgtgttccagatactttgttaggcaccagagaaaatatgataaagcaaaacagctattttcctcactctcatggtgcttacagccatggtgggaaaaatccatagaaaaagactcacatacacaaatgcagacagaataaaaaactcacacaaacaaacgctgcagatgttaagttacataaaggagatatgcatggctgtgcatggtggctcatgcctgtaatcttagcacttggggaggccaaggcaggcggatcacctgaggccaggagttcaagaccagcctggccaacatggcgaaaccctgtctctactaaaaatacaaaaattagccaggcgtggtggtccacgcctatgatctcagctacctgggagactgaggtgggaggatgacttgggcccaggaagcagaaggtgcagtaaactgagattgcgccactgcaatctcagcctaggagacagagagagactatgtctccaaaaacaaaaaaaaagagagagaagacatacatattccactgagaatgtataataaagctgcatactcaaacatttcttattaaaagatgtgcacaatcaaaaaatttacaaaatactgcaacccctcacctgagctttatagtatctcattcccttccattttcttagattaaaaagcctaattctaactttggtttattttaatacctagtttctatggctctcataggtttaaaaaaacaggttctccccaaaagtaaaatgatctaattagaagtagtacatgatttctgcaaccatttttaaatctcaaccgaaattatcaaaatttaagcaaataaaatttcaccctctctaataaaaatattgaatgtttaataaatgggcttaaaccagagctctttagaatattttaaacatatcagaaaattccatgttcaagtttcttttaaggtgacaaacatgagagttttttgttttgtttttacaaccttcattatttctgacaataaaatatcaatataaatagttcaaaacatctgttttcaaaatgttcaacgccccaggacatgtttctttgaaaagtcactgcattctcaatgttgaaatgtcatctttatcttgaaggggcaggttaagtgtttgttttctttgaaaatagagctaggtatcagaatatactcagctacataataaaggtcagcaaatttcatttttcattttttattttaatagagacgagatctcactatgttgctcaggctggtctcaaactcctgggctcaagaaatcctcccatcttggcctcccaacatgctagaattacaggtgggaggcactgcacctagccaaggtcagcaaaatcgaccttttggcaaaataaaaacgtcttctaagttcaatagctatatcgcccctagggaaacttttgtgatagcagaaattttccttggctcctccttcccaatcatttctgtagaactgtaaagatttgctctatttagagattaagtatataaactttcatgtaattagccatattgataacctccagtaacacttttgggtacttagaacttatttgctgcctatgaatgattccatgaatgatcttcagtgctattaattagtctacaaatattcactgaggaataaccaaaacagaaaaaaaccccatccgaatggcactagtatactagtgagagggagatgaacaataagtaagattattacgtgaatatacactctgtcagaggtgataagtacgaaaaagaaaacaaaaaagcagatattatgggaaggcatttgaaatctttgacagcaagcctagcaaaggcctcactgtaaagtcacgcttgaataaatacataaaggatatgagggggcaacacatgcattatgaaaggccctgaggtggatctgcgtctgcgtacttgagtaagaccaatgaggtcagcatggctgaaggaagtaaatgaacaaacggttatagtgaaagatgtctgagaagtatacgtgaggtgtggtgaagatcatgtagagccttacaggttagcaaggaatcttttttttttttttctcagaataaaatgggaagtcactgaagagtgttaagtagagcagtgacatgactggacaatctatttacatcagtatggactcgtgtacttattctatggatgaaaatgcaatattatcattatttttgtggttgctaaaattggtccagttcttaggagctccttcaggtaggttcccgtgctttgaacaggttttcatctttttaagcacttcattactttctggcaccacaagatgatctaggcttaccttgtattttctctgcaccagtcccgtaaggaactacttctcaaggagccctggttcctttcattgaagagcaatggttggagaccaagatctaagcactaggtattctcaatgctactggggtgtcattgtttctatgccctctcaggggatagaggtaggaaatacacatattcaaattaactcatacatatgcacacatctatatttctgtatgtctgtgtaaatattaaaaaacatgagtttattttcatacttctgatctcaacactacagcatgactgtacagttctttttgcctctagttttatgttatttaatcaagacactattttctacagttacttaggtgagttctttccctccctatcctcttttatgtgaattttactattcctttttgggttctcctgcatctgggtaggtggtaattgcttatttggtctcccacatcctggttggtggcaattgcatagaagcatttaaaacattcctatggttctaagaatcagagttatactgacaaatatactctgagaagtgccactcacatttcatccatgctacacagatctccactcccttcttctccctcccactccctacaggtaaccaatctctagtttctgatttatctgcatggtactccattatatggctatatggatgtaacacagtttattcaaaccttctcctctgtgtgggcatttagtttgtttccaatatttcgcaaattaaataatactataattaataacattaagtaatacataatttgtattgttagaggcatattcagcatagattcctagaataattgagaggtaaatgcatacagtttgttaggtatcaccaaatttccctccaaaagatgtgtaccaatttgcatctgcagcagcaaagaatgagagtacctgtttccccacagccctgtcaacaaatgtgttgttttatgtttgaatttttgccagtgagacaagtcttcctttcttgagacaaagttctagctaactggtccatcttgtgcctatttgataatgaagaataatgaacaaaagccaggcgtggtggcacatgcctataatcccagtacttcgggaggatgaggtgggagtatcgcttaagctcaggagatagagactagcctggacaacacagcagaacctagcctctacaaaaaatttaaaaactagttaggcgaggtggcgcatgcctgtggtcccggatattcgggaggctcgggggagaactgtttgagcctgggaagccaagggtgccaatgagccgtgatcatgccactgctctccagcctggacaacagggtgagaccctggaaataagggaggaaagaagaggaaggaaggaaagaagagggaggaaggaaggaaggaaggaaggaaggaaggaaggaaggaaggaaggaaggaaggacggtaggaaggaaggaaggaagaaagaaaggaaggaaggaaggaaggaaggaaggaagacgaaggacagaagaggaaggaaagagggagggagggagggagggaaggagagagggagagagggagggaaggagggaggaagggaggggagaaggaagaaggacaaaacaaacaaccgtacaaatggcgacacaaaactgacactcctgtgagttttgagtgattcaatctagtggagaggtaaagatttgacagagttaccactagatcccttctaatccccacatggtctaccaactccaagtactcaatctgcatttaacttgcttaggcccaccaaattctaatgcctaaacaaagtcggaagggatgcaatgtctcctaagggcttgtgattcctctgccagtggtaggacacagtcttcatctctaaataccatttaattattaatcagtaagaacaaaaatggtaacttctgtccaaaagggacagagtgaggcaagttttcttttaactaccttcctagcaaacagaggtaggaaatacatggacacatacaaactcatgcaaatacatacacctacatttctgtactaagtatcaaacactacgagtttatattgattcctctggttctaatccaccaccaaaaagctcatttagcctttgttaccttccctgtaatacttttcactgtcacaaaatagcccaaaataaaaattacttttatgaagtaattcataaaacagatggttttcactgaaatatcattgtcttaatccagtctctaagaatgttcaggctggggaaaatactattatgcattaaactgttcaaaatttgatgacatatacactttaatgtaaaatttccaaaacaagcactctgacttcactactcttgaggtgatgcttactcatctatgtaaatcagttcattttgataatccaagtaaagctaatgttctaatgattgaatttttacttgaatctaagtccttgtctcaactatacttttgaaagctttgcctatgttctatctattaaagcccatatagtttctaaggtcaaaatttccagttttaatattccattggaagggctgtctcacttctcccaaatatacttgttaaaaaccaaaggggccaggcacagtggcttacacctgtaatcccagcacgtcaggaggccaaggcaggcagatcacctgaggtcaggagttcaagatcaggctggccaacgtagtgaaaccacatctctactaaatatacaaaaattagccggtgtggtggcacgagcctataatccaatctactcaggaggctgaggcggcagaatcacttgaacccaggaagcagaggttgcagtgagctgagatcatgccaccacactccagcctgcacaacacagcaaaactcctctcaaaaaaaaaaaaaaaaaaaaaaaaaaaggaaggccaggcacagtagctcacaactaaactcccagcactttgagaggccaagaagagaagagaggatcccttgggtccaggagtttgagaccagcctgggcaacatggtgagaccccatctctacattttaagaaaaaagaaaaagaaaagcaatttgtagacagcaaagcagtatcacttcacagagtttgctgtctttatagatgggaggaagccgtttcatttgcatttgtttcaaaattacatgaaaatcacaggaaaagctctgaaaaatggcagactatgcacatattactttgatacaatgcaataaagatgaactgaactgctgaccgaactaaaaaaatttttttaatcactttttaaaatatcaaacagaggtagtccacattatggactaatgaccttcaaatcttttcaaatattttctttcattttaaatcattatcaaatagttttgtcttaaaaagttaccacatgaatgtataagcatagtgcaaaattttcatttctaaaattttaatttctaatttaaatgtaaactacttattttaaaagattcaagttcactgagtaacatactacattccaatggcttacacaaattaatttttttttttttttttttttgaggcagggtctcactccaacgcccaggctggagtatggagtgcagtggtgcaatcatggctcactgcaacctcaatctactggactcaagcaatcttcccacctcagcaccccaagttgctgggtctacacatgtgcaccagcatgcccggctaatttttgcataaaataactttttttttttttttttttttttttttaattaaacggagtctctctctgtcacccaggttggagtgcaatggcgcaatcttggctacgggcaacctccacctcccagattcaagcaaattctcctgcctcagtgtcccaagtagctgggattacaggcgactgccaccatgcccagctaatttttgtatttttggtagagaaggggttttaccatgttggccaggctagtctcaaactcctgacatcaagtgatccacccacctcggcctcccaaagtgctgggattacaggtgtgagccaccatacctggcctagaatttctcttaataaaaattaataatttcctattttgagagcttttacactacagcaatcatttaataatcctttcaagtgaacttctgattaaagtgaatgttataaaactatgatttaaatatttgctttgtctacttacttctgtgctccctgagacaacagctttgtccacgttcactaacaatggttcttccatctggcatactcctagtgaccactccacacaacggtgatgagcccaacaagtgcctaaaatgggaaaaatgaaaaggagcaaatgagcaaacattaaaaaaattaaagctaataaataaagacataaaacttcaaaatcaactctaatatgtaaatatacaatggcatcctgtatttgtgatagcagtaaagtggcccttctaaaaatgtggaccaaccactgagtgccagtatcaatatcaaactgagaaattcttagaaatacagaatctgtctgggtgcagtggctcactcctgtaatctcagcactttgggaggccaacgctggtggatcttttgaggctgggaacttgagaccagcctggctaacatggcaaaaccctgtctctacaaattagctgggcgtggtggtgcacgcctgtaattccagctactcaggaggctgaggcatgagaatcgcttgaacccaggggacagaggttgcagtgagctgagatcgcaccactgcactccagcctatgcaacagagcaagactccgtctcaaaataaaaaccaaaaaaatgcagaagcgcagatcacaagtgagatctactgaatcaaaaactcgtgcagtggggcccagcaatctgtgtttggttctgtttttttttgttgttgttgttttgttttggttttgagacagggtctcactttttttgttgcccaggctgaagttcagtggcatgaacacagctcactgcagcctcaacctccagggttcaagcaatcctcctgtctcagccttgccaaatagctgggactacaggcacatgccaccacactccgggaatttttttcattttttgtagagacagggtttcaccatgttgcccagtctggtcttgaactcctgagttcaagcgatccacctacctcagcctgccaaagtgctgggattacgggctgtgagccaccgtgccctgccagcaatctgtgatttaacaagccgtctggttattatgatgcacacacaagtttaagaataactgaattagtgattatttcttcaacaaacaaaattagtttttagtcattttatttaaatattatatatgtatttgatatgtttctggtatctttatataaagcaaacaaagtattacttagtactttgttgaggtgatatacaaaggaaatgtatagaaaataaactacacatacacctctacttccctcatcccacagtgagagcacgtatcaatgattattaacacttcagcctttaaattatccatcacataacacttgaaccactatcagtcaatctgcagttcaactacagaatgagatgtactttaaattccagtagcaccatatcatgagtgctgagttacaatactgttataataagataatctacccggctaagacctattttcattcatgcccaaataaaatagactcagaatgccacattccccaagttctcactttaaaattttcccctttaaaattttctcttttctcaattgtcagatctccatggcaccgctatctacacaagaaaaaatacaagtattttaaaaagcatccagtccggtggtggtactgtacagattttaaatagataaaccttttcttttacctaaccaggcatatttaataatgatttttttatagtatgattataattatttctagatgaaaggtatttattattgaggacattaataatgtattaaaattaaaatgcttccagaattaagaggcagtcattattgaaaacatgcccatacctgtagaatcaaataaggcttggatatcaatggcatctggaagcccaaccagactgagttcatcccacagtttaccagcttgatcatctgaagctgtctgggtgcttacacttacacaagatactatattctgctgaggagatcgttctctgaaaataaaataaaataactgtgaaagtgaaaacaagcagaaaattgtttcatttttaactgtttaaatgcaatgtactgccaaatcaattttaatttatcagccattaactgtcataaaacaacttttagaattcatctgttagtattatccatggtataatattaaactgggttgccatattatatcgtataagtaacaagtaagaaaaagagtctccaaacccacagggaagtattaaattgtaaatttgtttttccattccataatataatgtttttaaaaccaactctcatatcctagtcaggaattgtatttaacacataaactgagtatttcctttggctttacttaaacgcttacaaaacaaaacttgatcaaatcagaaatgtttagtctgctgtatcttgactgaggactgccacaacagaggtggcagttaactgtgtaaagaaaggatattttccagggaaaatgaaaacccactacagagtgtgaaaacagaggcaggaggaatggaatgtatcagctgtagctttcttatggtcccgtcaacaaatctcaacagctggtctgtggcatgacgttgcaagtactctcaatcaagactgtatgtcacaaattggaagtaaaaagcaaaagcaaaatagctaccaaaggcatgtagaataaggaagatagtataacagcaaaaactatagtctaaaaaaagaacattgaataaagtaaacaacatatgggagatttcaggctttcaaggtctaacactttaggtattatttaagaccattaaataaataaaaatggctattgtacttaattattaaatatgggaaatcagatgactaccactaaaacttaaatcttctcctaatatcatagtatttaacctgatcataattctggattaaatcactattgaatatagatcataactcactgcacttctgtatgctggatatttatcatgattcctattaagagaaaatcagcacaatgaccagggtactaaacatttttatacctggaatcattgaaagaaaaaaagtattaacatatttcaataagtacatttaaatatcaaaccatataaaaataaccagtaatgtttttatgttcagcattagaaatgcatagactttttttaaaaggtatagcatgctatgctaactttaaattctcattttaataaatgcccacagtaaaatgagaacaaattctttcctataagtataatctctattcctacaaatatatgctccattacaaatcattgttattttattgggagaaaaaaaaaagaccaacagttcatctataactactaaatgttgttttagcatactgttttgcactagtatttgatgagggaaaggggtgtaaaaaaaccaagagaatgactaatttattactaatcaggtcctaaccagcagcttaatcaaattcaaccttcaagttttgagactggtttgtatgtatataccatatcagtaagatatcaatgtcaacactaaggatgacagcagcccagcttagaaagagatatcaagaggaatcagctgaaatgcatacccacaaaattcttagttataaaacaaaaaaaggaaaaaaattcttgatttttttatttagtgaaaatgagcaaagacattttcaaaacctttgtaaaattgttttttaaattaactagctatttaaacttcattagcaacatacattttgtaaatatttgaaatcattaccaagctaaattaattgcctacccttcaatgatgccaaatttttaagtgtacttcattaactgccatattatcattacttattaagttggtaagcactaagtatatataaagactttcgtttaacaaaggctatttttatataattatctgagctcataagaattttcactaaaaattaatttcacttttaaaacaaggaaatgaaaccaattccatttctcaggagaggattttatataattgccattatttaaggcagaacatgaggatataagatacagcctgattcactccattaaatttgctaatagacattttaagtttgctggccttttgattattttattaagatgtgtgtactcaactgacaactaaagaaaaagctatagcctccaaaacatcacaactctccaaatatagtacttctaagtttccttaaactgttccaccttaaattcttttaaaagattctccctctttttattgtttcatttcctacttcaggtcttcaaggcattggcagcagttcaaaacaatgagccaatcaaataagtacaacacaacaatgatttagtacttaaatttggatataagccagataagcacttgagtgattacatcataaccctcaagaggcagtgttagctttgcaagctaaattaatttttacacattctcatcaactacagaaacttctactcccttaaccagcacagccaagtctccatattaatatggtctttaaacacaactgtacaaaatattttaaactatatcagacaagacctttaggtaattacaatgtgcccgtgaatacagacatacacacatcattacaaaaaaaaaattccttaaaaaagaaaaaagcatcttctgggagggaaggcaggggagggagggagggaagaatgtataggacagtgcaacattttctgaagcacacaaacttatatataaattaaataaatgactgaatggattgatgaatgaatgacacaaaagacatgagtagtgaaaaccaattctggatttgctattgtattatgttatattcttaaaattaaaagcttatttagagaaacaaaagaaggactttattgatctgttttattattacattatttccatttataaattccatgaactccctccctctcagcttgtgttatgttctttgaagttttcttccaaaagtttagttttgtgatcacaccgctttcatatacaattaatataaactttttaaaaaataacaagaaaaatttgtgaaaaggatagtttgttggattaattgggttaatggtgagtcagagtatcccataaatgtggagaacaggagaaactgttcaacaagaacaatcccatttgaaaatttataaacattataatggaaataaattatatgcagtcttaatctattccaacatttaaagtcgaaactgcttactttctctgtcctctttgttttcgtggtgctgagttttgcattttctcataggttccattgctgttgtcatcaatgtccttcttgttagaaggttggtttctccatggcaagataaatccaggcgttattctgaattgttttaagtctccttgtcctaaggaacttttttccccacagtaacaaaaagcgcagagctgttcactagtaaaaatgaaatgtaagtcagagaaggagaaaagtagctttattcaactgctttaagcgataactatagatacttgtgcttttaaattatgtctaaagcacaagctaagcttttcaatctattttctacagtctattcagtgattacccataagaacaattaagtttaataattatacatttggaattctacttttccatagcattttaaaaagtagtacacatatcaaatccaaaaaattctagttagcagttagaaaagttattttcttttatatttgactagaaaaaaatccaagtaagaaagctaaaggtgggggccaagcacggtggctcatgcctgtaatcccagtactctgggaggtggaagttcgagaccagcctgtccaacgtggtgaaaccccatctctactaaaaatacaaaaattagctgggtgtggtggcacacccctgtaatcccagctactcgggtggctgaggcacctcgcttgtatccgggaggtagaggttgtagtaagctgagattgaaccactgcactccagcctgggtgacagagcaagactctgtctcaggaaacaaaaaaaatgcaagttaaaaatgggaaagaaggtagagtttagtagccacccaactgtatgacagttctgtaaaacatatggtgacagttttatttaaccacttgatagaacgttcattatgcatgatatatatataccacacacatgcatacacacggggagatataaaaatataaacttaaatagttcctgggttgagtggtagtagatttttagggaagcagaagagctgaactggaagaaggaaagggatgattaggagcaaaggggattttttaggccagtgaaaccattttatatgatactataatggtagatactgagccctaatgtaaactatggactgtagttaaaaataatgtatccatattggtttaccaactgtaacacagcacacaatactaatcatgagggaaactgctgggggtagaggtgggagaatgagctcaatttttgtgtaaacctaaaaatgctctaagtctattaataaaaaaggagaaaacattaaaaaattaagagacaacaatcaatatacatatatagaatatacacttactaagagatcttagaaagaatgaaattaaaaggactgcttcctcttgattatatttacacttcacaagatatttactgctgctatacccaaatcctccttcttgggcattaaagttacctctacagtatttaccccatgatcttacatatcttgcattaccaggtgatagaactaacctatagccttttgaggtgactttttaaaacttaggtttaaatcatattggactctcaactaattacttttatcaaaattagctttgtttttgtaataaattacctatttcaagttcatgagaaactatgttgtctgctggtaccgagacatacacaaattaaatgtagtgtaatttcaaaaaaaaaaatcaagtcaagttgaaaaagaaaatttcttctttccaaaaagagaccaccaccttatgctttgccagtatcttactatccccttatttgtaatgttctctgagctattaagcttacatttatttcaccatatcccatttctggtttgtttcttcccctagaaacactacccatgagaagcaacaatcagattgacattagtcttatcaacattgattgtaacagcactgattagaaaatggagcaatattttaaagctattgcagaaaaataccttagcattcaattttatattcaaaactatcgcttaaatgtgaaggtataataaaattactctctggcttagaagacctcagaaattttgccagacaacagatcaaaaatgaaaatacttttagagaagtacttaaattattaaagaattagaaaaggttgtatgaagtaagggaggtcaaacacctcagagtaatttattgttgacttttttttaatacgaggtcaagggaaatttctagcttttggtctggctgtagaaagctgcaaacaacattgtgcccaaccacacaacataacccaaccagagaatctgcaaattcacttttctgaaacccatcagagggcagaaatcacaaggcaaccaactcaccaccaaatgaaagacacttccataaagaaatgtgacaatagcacctctgaggaagaggccactgatatcataccagcagggtgataagaactcagtaaaaatttttaagaaattgctagaagccaagtgtgaaacacagtgagactatgttaacacctgtgaccaaagacaggggaattctaacccacacaaaggctcctcttcatgtacctcattagatgtcacgcactacagcaactcagccaggaacagtggctcacactgcaaccccagtgctttgggaggtcaaggcaggaggattgcttaaccccaggattttgagaccagcctgggcaacatagtgagaccctgcctgtattttaaaaagaaaaagaggatgggcatggtggctcacacctgtaatcccagcactttgggaggccgagacgggcagatcacaggtctggagttcgagaccagcccagccaacatggtgaaaccccgtctctactaaaaatacaaaaattagccaggcatggtggcaggcgcccgtaatccaagctactcgggaggctgaggcaggagaatcacttaaacccaggaggcggaggttgcaatgaactgagatcgtgccactgcactccagcctaggcgacagagcaagactccacctcaaaaacaaataaaagaaagaaaaaacatatatacagtgactaaaaaacattttctaaaatagcatacgaaatcttactagccattacaataatgtaaaccaaaaccaccaattaaaaggcaaaaatcaccaattaaaagaccatttttgagattagattaaaattagatctaacaattgggtgcagctgggtgtggtggcacacacctgtaatcccagcactttgggaggcctagttgggcagatcacctgaggtcagttcgaaatcactctggccaacatggtgaagcacacaccacccacccaccccctccccatctctactaaaaatacaaaaaaattagccaggcattgatggtgtgcgcctgtaatcccagctactcgggaggctgaggcaggggaattgtttgaaccagggaggtagaggttgcagtgagccgagatcgcaccactgccctccaacctgggcaacagagcaagactccatctcaaaaaaaaaaaaaaaaaaaaaataggtgcaaaaaatgttggaagtataaacacaaatgacatataaaacaaggacaaaaatgttgatgggaaaagaggtaaaaagataccaggcaaacataaaccaaaaggaagtttgagtggcaataattttatcagacaaaatgaaagttatgtcaaaaagaaaacatgacattagagatgaaaaagatgttacacactaacaaaatgatgaatagtataatagatatcgatcataaccatatactcagaccaacatgaatctggtctcaaaatgaatctcgaatctgaaagagatggttaagcatctccaatctgaaaatccaaaatctgaaatgctccgaaattcaaaactttttaagcaccaacatgatatcacaagtagaaaatttcacacctaagtacttaatataaactttgtttcaagcataaaattacttaaatattctataaaattaccttcaggctatgtgtataaggtatatacgaaacataaatgaatttctgtgggcagcaagccacccaggtgccgaggcaagagaccaagggcacgagctgttccagtataacaaaatatataaaataagaatagttatatagatcatagatatgattatacatgaatatcattaatcattagtttgtagcaattactctttattccaatattataataatcctcactctacaatcataacctaggaaaaaccaggccatacagcaataggagctgaggggacatagtgagaagtgaccagaagacaagagtgcgagccttctgttatgcccagacagggccaccagaggagtccttggtcccagcgtctgggaagacacctgttgccaagtggaccgtggtctagcggtagcgtcagtgtcaaggaaaaacacccactacttagcagaccgggaaagggagtctctaaactcttttagagtttagagaagactctactcctccacctcttgtggagggcctgacatcagtcaggcccgcccgcagttatccagaggcctaaccgtctgcctgtgatgccgtgctgcagtggtcacgctcctagtccgccttcatgtttcatcctgtacagctggctctgccttttagatagcagtagaaaattagtgaaagtactaaaagtctctgataagcagaaataatggcataagctctccctctccctctccctttccctctctctgcctcagctgccaggcagggaagggctccctgtccactggacatgtgacccacgtgaccttacctatcactggagatggctcacactccttaccctgcccctttgtcttgtatccaatacatatctgcgcagcctggcattcagggccactaccggtctccgcgtcttggtggtagtggtcccccgggcccagctgtcttttcttttatctctgtcttgtgtctttatttctatactctcgtctccgcacacggggagaaaacccaccgaacctgtggggctggaccctacaaatttcatgtttatacatgtctcccatccccaaaatatcttattatgtatgtgcaaatattccaaaatccaaaaaaaatccaaaatccaaaacacatctggtcccaaacattttgtttttgttttttttgagatggagtctcactccgttgtccaggctggagtgcaatggtacggtcttggctcactgtaacctccacctcctgggttcaagcaattctcctgcctcagcctcccgagtagctgggactacaggcacacgccacaacatctagctaatttttgtatttttagtagagacggagttttgccatggtggccaggctggtctcaaactcctggcctcaggtgatccacctgccttggccacctaaagtgatggaattacaggcatgaaccaccacacctggcctgtcccaagcattttggataggagaaactcaacctgagtttctcagaacaaaactggaagactaaaaaaattaaatcaacaacagtggaagattttaattatttttctcagaaaatactatgtcaaaccaataaaaattaagtattgaacatctttattgttcattatttattaattacctgagcataataaattagtttgagatactatattcagctctatctacaactaacggttcacattcttttcaagtatattaaaatatttcaagagtggattacatagtaggccataaaagaatacatgatacatagcaagtgaccaacatcatgcaggcaacattctctgacaataatgcagtaaaactaaaaatgtataataaatggataacttaaaatcttctggccaggtgcagtggctcatgcctataattccaacactttaggaggctgaggcaggtggatcacctgaggtcagcagtttgagaccagcctgaccaacatggcgaaaccccgtctctactaaaaatacaaaagttagctgggtatggtggcacacgcctgtagtcccagctactcaggaggctgaggcaggagaatcgcttgaacctaggaggtggtggttccagtgagccaagatcgcaccattgcatagcctgggcaacagagcaagactccctttcaagaaaataaataaataaataaataaataaatttggaaactagaaaagatattgtttaagaatctttcacttaaaatggaaatcccaatatgtgaaataaaatcataatgaaaatactgaatataaaattgatataaaatataaaatactgaatataaaaatttcaatatattactggaagtcctaggcagagcaatatggtcaagagaaagacataagggatcccagtaggaaaggaagaagtgaaactgtctttatttgctgatggcatgatcttatatatggaaaaccctaaagactccaccaaaaaactgttagaactaataaacaaatttgataaagtagcaggatacaaagtaaatatacaaaaatcagtagcatttctatatactaacagcaaacgatcctaaaagaaaattaatgtaataatcccatttacaatagcaacaaaaaaattaaatacttaggtgtaatttcaaccagggaggtaaaagacctgtatactgaaaaccataaaactcacaaaagaaatttaagaaaacatcaagaaatgggaagatatcctatgttcatggactggaagaattaatactgtgaaactaactgtccatactacccaaagtgatctacagattcaatgcaatatctatcgaaattccaatgtcaattttcacagaaataaattatccttaaatttatatggaagcacagaagacatcaaacagccgaaacaaccttgagcaaaaagaacaatgctggatgcatcaccctgtctgatttcaaaacattacaaaatgattgtaatcaaaatagtatggtactggcaccaaaaaaaaaaaaaccatacatctggacaggcatggtggttcacacttgtaatgccagcacttgggtaggctgaggcaggcagactgcttgagcccagagtctgaaaccagcctgggcaacatggtgaaaccccgtctctactaaaaatacgaaaataagccaggggtggtagtgaacacctgtagtcccaggtactcaagaggctgaggtgggtggacggctccagctcagaagacagaggttgcagaaagccaagatcacaccaccgcactccagcctgggctacaaataccaccctggctcaaaaaacaagaagacacatcgaccaatggaacaggaatgaactcacgcatttacactaagttgatttataacaaagatgccaagaaaacacaatgggtaaagaactgtctcctcaataaatggcactgaaaaaactgtatatccatatgcacaagaataaaatcatacccttgtctcacataacacaaaaaatcaattcaaaatagatgaaagtcttatgtttcggatgtcaaactataaaactactagaataaaacatagggagaaagttccatgtgggcaataactttttggatatgaccctgaaagcataggcaacaaaagcagtaatagacaaatgggatggctaaaccaccaagctccttacggcaaatgaaaatattaacaaagtaaagagacaacccacagaatgggagaaaatatttaatatccaaaatatatatggaacccaaataaacagcaagaaaacaacctgattaaaaaatgggcaaaggacctgaacagacatttctcaaaagaacacatacaaatggccaacaggtacatgagaaaatgttcagcatcactactcattagggaaatgaaaattaaaacaagtatatatcacgtaacacctggctattggctaacacctaacaaatggctactattaaaaagatgaaagataagtattgccaaggatacagaaaaaatgggagtcctgtacattgctgtgggggtgtcaattagtatagccattatggaaaatggtaaagaggttcctcaaaaaactaaaaatagaattaccatataatctagtaatcacacttctgggtatatatccaaaggaactgaaatcaatgtcaaaaggatatctgcatgcccatgcttactacagcattacttacaatagccagatatggaatcaacctaagtatccatcaatagatgaatggataaagaaaacatggtatatataaacaatggaatactattcagccttgaaaagcgggaggatggggagtggtggctcatgcctataatcccagcacttcgggaggccaaggctggaggactgcttgagcccagatattcaaaaccagcctgggcaacacagtaagactccatctctacataaaattttaaaaattagcctggtgtggtgagcacacaactgtagtcccagccacttggaggctgtggtgggaggattgcctgagcccaggaagttgagactgcagtgagttgtgagcatggcactgtactccagcctgggcaacagagtgacaccctttcaaagaaaaaaaaaaagagagagaaagagaaagaaaggaaggaaagaaaaaaaggaaagaaggaaggaaggaagggaaggagggagggacgaagggagagaaggaaggaaaaaagagggagggaaggggaggtagaaaaagagggggaggggaagggaagggaggcagggaggggaggggaaggggattaaggaagagtggggagagagagagagagagaagcgggagggacctgtcatctgcaacaactcagatgaatctagaggatatcatgctaagtgaaataatccaggcacagaaagacaaatacggcatgatctcacttatatgtagaatctaaaaaagttgaactaaaagaaccagtagtagagtgatggtaaccagacactcggagaaggtaaggcaggaagaaggaaatagtaagttgttggtcaaaggatatgaagattgagataggaggaataggttttgagatatactacatagtagggtgacctatattttaaaataacaatttggtgcaaaggatacgaaggttgagacaggaggaataggttttgagatacagtgcatagcagggtgacctatattttaaaataactattagtttggtgcaaaagtgattgtggttctgccattaaaagtaatggcaaaaaccgcaatcacttttgcaccaacttaagagtaaatttcaagtaacaaatgagagttaatcaaggtaatggatgttaatttacttgattcaatcattccactttgcattcatgaattgaaacatcacactgtactcataaatgtacaattaggatttgccaatcaaaaataacattcaaaaataataaatgtatcatgaatcattttagataaaatgtatatgttctgagaaaaatataacatgagaaaattggtacaagatgaaacagacagctgaatagaaaaaaatttggaagtggggagcaaatttatggaatacatattccaagaaaaaaaatctttgaattgaactggtaatgacttcattttctagaagaaaccccacagacccatgtaattttatgacagttacttcagacctacatggagtcaattcctgtcttaaactagctgttccagaaaataagaaaactgaaagatgcctcacacacgaggctagtgtaattttgtctccaaaactaggacattacaatattacaaaaattcatattgcttatgaacataaacaaaatattagctaactaaaacccaacagcatgtttaaaaaatgtcataatcaagtaatgtttattgaaagtaatcgagtaatgtttattgcaagtaatcaagtaatgcttactgccttctacagaagcttcttcttattgcattgttttgcttcatttttaaatacatatgaacataagttctttgttagttatatgctttagaaatatttttcccttttctgtcatttatctttttactcttggtatttttcatgaaaagttgtaaatttaagtatagtggtattaatcaatccttttcttttctttttttgagatgcagtttctctcttgtcgcccaggctggagtgcaatggtgcgatcttggctcactgcaacgtccacctcccaggttcaagcaattttgcctcagcctcccaagtagctgggactacaggtgcccaccaccacgcccagctaatttttgtatttttagtagagatggggtttcaccatgttggccaggctggtcccaaactcctgacctcagggatccacccaccttagcctcccaaagggctgggattacaggcatgagccaccgcacccggccccttttctttttatgtgtgttttttttttttgagacagggtctcactatgtcacccaggctggagtgcagtggcaggatcacagctcactacagcctcgacctcctgggctcaagcgatcctcccacctcagcctcctgagtagcaccaccaagtcctactaatttttgtattttttgtagagacagggctttgtcatgttcaagtcaggctggtctcgaactcctgggctcaagcaatcctcctgcctcaacctcccaaagtgctaggattataggcatgagccactgtgcctggccaatcaacccttttctataattagggctttccatttgttttttaaaagtctttccttaccccaaagcaatgaagaaattcctctacattaacttcttttattaatttgcttctcacgtgttaagtctataaattaactggagtagacatgaataaattaggtctttctttttttttttttttaaagtatgtctaattgttctagcacaattgttgaaagagacttccttcctcactaatttgtgatgcccctttgttataaataacctgtccatattaatcatgtatctgtatctgggttccctattctgatccattggtctatttgtctgtttctgtggtaatacagcactgacttaatttattagtgtgttacaaaaagtcttagtatcaagtaaagcaatccttcctcttcttcatgggtcctttggcttatcctgtcttttgcatattcatataaattaagatcagcttgtaaaatttactgtagaaatttttattagaattttcttgaacctacacatcaattgggaaagaatatctttaaaatactgaatcccctaaaatgtgagtattatactgctattatgtctgtgatccttaatctttccaaaaagttttataattttctctataaaagtcttacatttttgcacataatcctagtcacatattattttatattattggaaaatattctaaaaaataccatttaactctgttcctaatatataaaaatacatgtgatttttgcattttgattttgttatctagtaatcttgctaaaatcctattaattatacatattcatttagaacattttatatactgcaccattaaaattcattaaattcaggccggggacggtggctcacgcctgtaatcccagcactttgggaggccgagatgtgcagatcacgaggtcaggagatcgagaccatcctggctaacatggtgaaaccctgtctctactaaaaatacaaaaaaattagccgggtgtggtggcaggcgcctgtggtcccagctacttgggaggctgaggcaggagaatcgcgcgaacccgggaggcggagcctgcagtgagctgagatcgtgccactgcactccagcctgggcgacagagcaagactctgtctcaaaaaaaataaaataaaataaaattcattaaattcaatctgttcatcctattttaaggaaactgtgggacagagagataaaaatgaataaataaaggtcaaaaagtcggagcttggaataaacaccaagtctgtatttacagtatgctggctttctcagtgtacattcactctgtcctgtctaatgaaaataacagtggtagtggtagtatagcccaggataaataaataacaatggcattgcttattaatctacctcaaggttatttttccatgtggcatgagcatcaatctacctatattttttacatggatagccaattattgagtgacctattcttttccactgataggccatgattattataaatgaaattatcatatattcatgagtagcttttaactttcattctctgtacaagtattagatgaggactaacagtgacagtgtgctactcacaggtgacaaaaagataagtcagtcaggcatactgtgtccttaagatctgcagaagaaccaagcaagaaggttaagaactacaatgggttcccgaagtaggcctagaggatacagaggcacagaatactttcagaaggctctcaggcacctgctctaaactagcaaatattctgcattctgtacctctcaataccacatatgcattacaccatttctaatctctatataacacatagcaaaaagtaaagttcatggtagtatcaaactacaaaaatttaagcagaactttaaatgcttttcaatcaactagaattcattattcattaaaaatatattgggccgggcgcggtgactcacgcctgtactcccaacactttgggaggccaaggcgggtggatcacgaggtcaggagatcaaggccatcctggctaacacattgaaaccccgtctctactaaaaatacaaaaaattagccgggcgtggtggcgggcacctgtagtcccagctactcaggaggctgaggcagaagaatggcgtgaacccaggaggtggagcttgcagtgagccaagatcgcgccactgcattccagcctgggcaacagagcgagactccgcctcaaaaaaaaaaaaaaaaaagaaaaaagaaaaaaaaatttatacagcacctaatctccgtcaggaactattaagtgcaggacacagtgtggtgaacaaagcccaccaacaaagtgcgtgtcttcagagttcacatgacagtcaaatgaactgttggaaaataataagtgccacaaagaaaaataaagcaggttactatgtaaaatatggtgggagctgctgttttcttttccatcctactcctttattttgaaaatgttcaaacctcccaaaaaatattggaggaggaggagaggactacagtataacaaacaccagtgtgttctttcgttgattcacattgtatgttctttttcctaagctgactgagactaagctggatgtggcccttcagaggaggctagtattatcagcaaggtagcctctctgggaggtaagccaggagacaagcagagcaagcaccaaagctctcagacagaaaccccatcagcacatttaaaagagtgaggccaatgtggtgagagcacagtgagtgacaaatgacatgagagaggcagtcaggaacagatcacaccttgtagacatggtaagtacttgaaattatgaatataatttaaatataatagtcatgaaagagagtggagagtggggacctgattatcattattagaataatttttgcaactgtgctataaacaaattggactatggaaaggtaaagagaagcagaaagactggttaaaaggctactacaacttccaaaggataacagtgacttcaactaaaatgttaggcaagttaagacactaacaagttgtttgggttatcgagttgagctacaaggtatgagaaaagatagaaatcaaggattaactttcaaagtttctggactaaacaactgagtgaatactggcattatttattgaaatgaggaaatcgtagggagaagcagatttggggcagaggtggaggcagaatcaagcatggtactggacatgttaagggtgaggtgtctaatacacttccaaatagagacgtcaagcagacagttggacataaaagtctggagttcaggtaaagaagagtaacggaaatgaacacgtgagactcttaagggcacacacagaggttacagccattagaatgaatgagctttctttcccagggagtgaacagagacaaaaagtagacaagatatctgaggacttatccttaagaactccaaaattataaacatgtagagtctccacagcaactagcaaaagataaaatgaggagtgagatgtcccaaaagcaaaagaaagaaaatggttcaagaagatgagagaggtcaggtgcagtggttcatgcttgcacttccaccacttagggaggctgagacaggaggattgctttagcccaggagttccagaccaacctggataacataaagagacccagtctctaccaaaaaaaaagcttaaaaattagccaagtatggtggcacacacctgtagtcccagccacctgggaggctaaggtgggaggatcacctgagcctgggaggttgagcctgcagtgagctgtgatcacactactgcactctaccctgggcaacagagtaagaccttgcctcaaaaaataaaaaaaaaaagaaaggaaaggaagaaaagggaagaggaaaaggaagtagaagggaaacgaagggaggaaggagggagaagggatggaggggaaggagggagaaagggagggaaggagggcgggaaggaaggagggaaagaagggagggagacaggtaaggagggagggaaggaaggagatgggagtaccaaactgatggataatttcattattttattcatgtctttcaaataaggtctaaaaactcttaaaacttcaaagctgaattatacaatgatatattacaggcccagtgtagtggctcatgcctgtaatcccagcactttgggaagccgaggcaggtggatcatgagatcaggagatcgagaccatcctggccaacatggtgaaaccctgtctctactaaaaacacaaaaattagctgggcatggtggtgcatgcctataatcctagctactcaggagcctgaggcagaagactctcttgaaccagggaattggaggttgcagtgagctgagatggcaccactgcactccagcttggtgacagagcaagacgccatctcaaaaaaagggagggggggaggggtggtggggggggggagaaaaagaaagaaaaaaaataggttataatgtcctgtgtttccttttttaatgaatggggagaaggtaaggaacaaaactatcaacttaagtttacaggtaagtatcaaaaattaatcctcatgctaaatgctcacatttatgtcttctgccaggaacagcacattggtaatattctgtactggcctgaggtgactagagtaaaaccgtagtgtgctgccctgctctacaattgcctaagcccacagatgtaactcatcccaactaaacacagaggtatcagcttcaaatttagctactaaatcataaaatcccacccagattttcatcctaaactcatactccttgaattttctctatagtcatttcactgctttattcctgtcactaatatccaatccagctgcattcattctctaacctgattttggcttctacaccaacagagaccagggagtttgccgattcctcagacacagatcgctgaagagttggaattagctgtttgctgttatccacttctgcttcagcatcctcttctgcagattgttctttgatttctgcttaacagtaaacaagagaaaacaaagagtcatttttgtgtttattttaatcactggtgaatgtatctataaagcataggtcataatgtaaaaagaaacaacaaataacaatatttcactaacacaagaaaagttcatgcacgtaattagtggtattgtgcatctttattctctaccgcaaaatgattatcaaaataatgtgaagcatggtatacttttccttgtgcccaaattatagctgactcagagaagtttcatcctagtaataaatgttaagaatcttggccaggcatggtggctcatgcctgtaatccctgcactttgagaggccaaggcaagcaaatcccttgagctcaggagtttcagactggcctgggcaagatggtgaaacctcatctcaacaaaaaatgtaaaaattagccaggcaaggtggtgagtgcttataatgtcagctactcaggaggctgagatggaaggatatgccttgaacctgggagccagaggctgcagtgagctgggatcgtgccactgtactcaggcctaggtgacaaagccagaccctgtctcaaaaaaaaaaaaagaatcttatttttggccaggtgtagtggctcacacatgtaatcccagcaccttgggaggctgaggcaggcatattgcttgagcccagtagttcaagacagcctgggaaacatggtaacaccccatctctacaaaaaattagctaagcatagtggcacacacctgtagtcctagcgactctggtggctgaggtgggagaatcaatcaagccccggcagcggaggctacagtgagctgtgatggcaccactggactccagcctaagcaacacatctagatcctacctcaacaacaacaacaacaacaacaacaacaaaaagatttttttttttttttttttttttttgatggagtctcgctctgtccacccaggctggaatgcaatggcgcgatctcgactcactgccacctctgcctcccgggttcaagcaattctcctgcctcagcctcctgaatagctgggatgacaggcgcccaccaccatgcctggctaatttttgtatttttagtagagactgggtttcaccacgttggccaggccggtcttgaactcctgacctcaggtgatccacctgcctcggcctcccaaaatgctggaattacaggcatgagccactgtgcccggccaaaaaaaaatcttatttcaggattatagcaattggtctacagaacaaatgtatttcaaagtgactcattaaaaattgcttcacactttataaaatcatcattaaaagactcatcatgtatcttaattattacccattctaaaagcttaatatttgaaaaggacaaaccttcactttattgcctttttccattctccttgaatccaaccccaaacaccttaaatgttctttctcaggaggcagcctaacagctgagaggatttccacacaccactacccctaacatcattcttcttgtttaataaaaattatatgtccactctgtctgtcatgctctattactacaatgaagggacattacacctccccaccagtgctcatgatgcagttccatgctcttggctggctccttcttttctaatttgaaatttatttagacctttctgcatcactaaccccaaacaaacaaaaacatcttaaagtcctttcaagcgcctcttctctgtctttccttttaccaccaaattcatgagatggcatgactgaactctactaccttccccttcaactatacctttctaattgtatccagcctcctattataacaattattctcagctgggtatggtgatgcacacctgtaatcccagcactttgggaggccaaggtgggcggataacctgaggtccagagttcgagaccagcctgaccaacaacatggtgaaaccctgtctctactaaaaatataaaattagccgggcttggtggcacatgcctgtaatcccagctactcgggaggctgaggcaggagaattgcttaaacctgggagatggaagttgcagtgagccgagatcatgccattgcactccagcctgggcaacaggaatgaaactgcgtctcaaaacacacacacacacacacacacacacacacacacacacacaaattattctcgtcaacaccaccaatagaccaacggcaaaagaattaacaatccagttagcacccacaagctttcttcaaacatcctaaaagttcacttcacaccaggatcacttcctccttagtgaaatgatcttctatcttttataagcacagagatataatagtctaatatctatctcttcagctgatttcctttagacctctaaatataggtacagccctctatacatcctttatatactcctggggttgggtggttgtttttgtttttgagaaaaggactcactctgtcgcccatgctggagtgcagtagtatgatcattcgcattcttgggctcaagaatcctcccacctcagcctcccaagcagctgggaccacaggcacatgtcaccacattctttttcatttttttgtagagatgggggtctcactatgttgcccaggctagtctcaaactcctggcctcaaatcatcctcctgccttggcctcccaaagtgccaagaatacaggcatgagtcactactcccagcctataagctcctctttgaagaacttattatccacatttcaacaatttcctctggactttatgatttgtaagtcaacatctctagcactaactcctctcctgagttccacaccatattttaactatacactagacatacttagcagcttgaacactaaatttcacacaaaactttatctcttatcgctcagattagcacttcaatctgacttccctctttaaaaaaagaaaactatcttctacattcaaaatgaattttagaaaagtattttgaaaaacaatttgtataactattcttgggtagttagaaaaaactacaaataattgtaaatcctatcaaatcataaaactaatgataacatgaagcatcaaacagatggttttggttttcatacttaaaataacatgtttcttttcttttttaaaaaattgaaatagaaaagctgaccttaaattaagtgtttatacagtctatcaatcaaggtgtcctgtctatcccgagacaaaattgataaagtatctagaatcaaatctacaaatacgtaagcttgtattcaaaaggaataataaaatgaaaatttacatttctatgtgacaaatgacctcatgaacaaaatgaatgtgtcacagatgagagaaaataaatacaatttgaatccccccccaaaaaaaaaggtattcagatcaagaatagctaaataactccaaagatgaacaaggcacataaacctgtagaacgtagacaaaggggccgggtgcggtggctcacgcctgtaatcccagcactttgggaggccaaggcaggcagatcacctgaggtcaggagttcgagaccagcctcaacatggagaaaccccatctctactaaaaatacagaattagccgggcgaggtggtgcgtgcctgtaatcccagctattcagaaggctgaggcaggagaattgcttgaacttgggaggcggaggttgcggtgagccgagatcatgccattgcactcaagcctgggcaacaagagcaaaactccgtctcaaaaaaagaaagaaagaaagtagacaaaggacaaaatccatactcttcatcttctatgctttccaagttttagtaggacacataactgctcagctagagactttattccccaaccctctttgcagcaaaccatggcaagttctcaccgagagaatatgaccagaagcaactgcgcaacctcatcatctaaaaggaagtgagctgctcttcactaaattatagtcccctttcctacagactggaatggacatgacagcaacccagtcgcaatgctgccaatgaggcgcaatgctccaggtgatggcagagagacaagacagaagaaacctgggtcaacaaacaataatatggagcaaaagacaactcatcagcctatacctctccatcctcagaaatattacatgagagaagatcaatttgttttatttaagccactgctatattttggggtctctgttacagcagtttaacccatgccctaattaacacagaaaactggtattaaagagtgaagaattgccgtaacaaaatcttcaagtggcttgatcaggccgtgaaacactgataatggagtctgaaaatcaactgaccctttttaggctatattaaaatatttaatatagctatgacctacaacaatttggaatgtagactgtacctacagagcctgtagctctaggcaaagcatctggaatgacccaaagggtattctgtgttgcctctctctagtatttttacagccaaagatagaaaagaatacagttctgctagagagactctctctgcctgcctattatattcaaagtactataaaattatcacatatataaatacctgtatgaaagcatttcatttctactcagagagtcccagaatacattttgggatatacccattttataccattcttactactgggtaacaagaaaggggaagagaaaaataagtgacaaacttaaggaggaataagaatagtgccttcagaaacttaccaacaatgagccaaatggcccagggtcgcaaatcattacattaccctgaaaacacattttttcctggagccagatccatttgtctccactcccaagctgtgctctctccaatccagtatgacttgtctgcttccttttactatgctgctatctaccatatatgacctccagtcaaaaatttccttctcctagcgaagtatataacagtttcagctttttccttatttttatccccaaaaaagaaaatacatagcacttttattatttttaggggagttttattgcttacagctaagggaaaagaagcaggacaatgtctatctctccctcaaataagagccagaaggaaatagaaaagttaaacgttaatgttactggttggccagtaggtttgcaggtatacaaccttttgaaattatgtttcctgcatttcaaagagaaaaaaacagattcagactatagggtttttttgttttttttttgttttttaagaaataggatcggcaccagatctgatcccataaagcaggtaagaagacaggctttcagagttcatcctgttctcttttctcctctagctattattattactggctctgcccatgattctaacttggatctgctaaagaaacagtagggagcgatagttttggttttacttttggtttagattttgttgtttcagtcttgtgttctttaacaaataaagaggactctatgactgcttcctagatagcagtaattcctgccacaaaataggaacaaacaacaaaaaaggtatcactaaatatttgatacttcaggtaataacagaagctgtctttaactgtcactcttcatttggtagactatgttagatcttagtatctgtcaaagtcaaggcaggacaactgagtgtttatgtctctctctcttctcctaatcctagtcttcaaacaattgtcagagtttggcagcagaatgtgaaacagactgctctggataaaaatgatgtcaaccagggatccaaccagagatgtcatccagagatgctctggatgaaatggctacaaacccagtgatatctgaggaaatatgcctgatgccagtacttaattatctccagtttattattaaaaatgtactcttgaatactatcctatgctttgcctaaagaaagaagctagccattcaaccaataaaacagtccaggtttggcgactccaccactttgcagagtttttgcctttcatgaggtccaattagctcaaactgcctgcaagccaaactgtggaaattggagcagacatttaaaaaattacattgcatttttaaaaattcagtgtggtatttttcttgaatataaaatccctaatatatcttttcccttactttgaacctgacctaaaatacaggcaatgacacttggtcacaaaatgcaccaaagtcagaaaggtggggacaactgcaaccctgggataaggacaggcaaggcgatttcatctgtagccactatctacggataatctccatccactaggtggcacatgtacagtggtaaactatactaaggaacctaatcattgacctggcgtggtggctcaagcctgtaatcccagcactttgggaagcaggaggatcacttaagcccagaagttcaagaccagcctgggcaacatggcaaaagcaaaaaaaattcagccggccttggtggcacacaccagtagacccagctattcaggaggctgaggtggaagaatcacttgagcctgggaggcagaggttgcagctgcaccaagatcacaccactgcactccatcctgggtgacagagcaagtccctgtctcaacaacaacaataaaaaagagaacctaatcacatgtaagtagattcctaagagaacttgaagacaatgtgcacttcattaaatagcatcagctatgtgccaggcattatctctggggatgcaaagataaattagatctaaccctttcccttaaataagttcataacataccctcttttaaacctttacttttccacctccaatgactctaatttatcctacacaaattggttctaagacatgagaaagtttaatagcaaaaggtgtctgctgtgttagttaaaaccaaaggcttggaatccaatggttccgagtctgcattctagctctgccatctgctagcaatgtgacctttggcaagttacttaacttcatctcaattttactttgctcgtcatttaagacagacaataccacctagtataaaactgtctttatgatccaaaaataaaaaaaaaagaacgcatgaaaagcacttagctcaacgtcttaagtgtagtgatgtagctgctattctgatgacctctatctacattcacacactatagtctatggattcacttgtccacctcacttatacaacttgatttttttttttttttttaaagacagagtctcgctctgccgcccaggctggagtgcagtggcgcgatctcagctcactgaaagctctgcctcccaggttcacgccattctcctgcctcagcctcccaagtagctgggactacaggcgcccggcaccacacctggctaattttttgtatttttttagtagagacggggtttcactgtgttagccaggatggtcacgatctcctgacctcgtgatccgcttgcctcagcctcccaaagtgctgggattacaggcatgagccaccgtgcccagccctcacctactcaatttctaactcttgatgtcacatcatgaattattaaattgcattatgagaattaatgagaataaagaagacatttatttagccccctccgatctatgctccagagttaatatatcattaatttagaatggttatttaccaaacaaaattttgagtaacaagtacatactataatttctattcaaatggtagtcattacaaagatagtcaagatccctacgtttaatggatctagatgaaagactgaaaataaaaataggacacaataatgatgatgctggtaagcacatggcatgatgggagttaaggggaagaggtggggaatacagctcagaaaggcttcagaaaggtattagaagcccagctaaaactaaaaggataaatcaaagtgtgcctaatagttctctctcaagttttctcttttaaaaaaagaataacatctaacatattttcttcattcaaaagataaggaaactaaaatctgaaagttaattacaagctcaagatcacaaagctaataggaaacaaagctgggatacaaaatcgggttgtgtaactctaaagcctgatgtgctcttttcactacttccaccgcctggcagagcatcaaagtgtagcatgtaagttttataaatacatcaatattaaagagaaatgttaacagtcttactaggaccatgttactgagggatcacttactgaatataaacactatgagataactaaaaatactcttttttaagcactgctgaataaaattatgaagtggacagaacatttatctcacagccaagttcacagaaataaagcattttgattttgaacaattacaaaagtatttccctcaaaggttaaatacttctttgaaaggactgtgtgtagcctacaaatatactgaacaaacttaccaacactgatagcataacaggctatgtcaaaaatattttagaggtcaattttggactcccttatcaatacattagtatattctttcaaagcgtcctactttttcaatggatttttaaagtttactcactcaagggttataggattttagagggagaaattacttctttatttttactaacctctaatttttattcacttccaaaatttagaattctaagaaaatattaagaatgtaagcaacaagcacagtggtattggtggatacctaagtgtttgtcaccaacagaaatcacggatattttcttatcacatgcagttgttgcagatatcccaaaatatcattcaccctcatcactacttcaaaattacagtagttattaaattcactgctagattttataatttaagtgaattaaaaagatgttataagattacaagtttggcttatttttatttcaatgcaattgtttatctttgtaatcctattttggtgtatttttattttattcatttaaaaacattatttgaaaaagagtccatggattacatcatagtaccaaaggggactatggcactgaaaaagttaagaacccctgttctgtatgtgccattcacaggagaccacagccccaatttgactatatgctctatgaaaacaggcactgtatctgtttttataaaccagagctaccacaaaacctgaatgatgttcgatagttgcttaattaatattatataatataaagcaagcagataaatctcatatatagatacaaagatttataaaaagcacagagaaaaataatatatttaaaatgaactcatatttactaactatgcaagtaaacactgacattcattatcgactagttatccaaaaaatatgccttctccctctatgctttaatcaacttttttttttaagagatgggctcatgctctgtcacccaggctagagtacagtggcacaatcatagctcatcagaacctcaaactcctgggctgaaggtatcctcccacctcagcttccccactagccaggactacaaggcacatgcgatcacgcctggatttttttttttttttttttggtagagacagggattaactatgttgcccaggctggtctcgaactcctgggctccagttatcctcccacctcagcctcccaaagtgctagaattacaggcatgagccaccatcaccatgcccagcctaatcagctattaaatagaataactgacttcccttaactccagagaatggcaatacttttcatgcttgcttcctactaaaactacagaagaaaacatagctaagaaattgtgtaaccatgtccctcccttcttttgaaagaagtctgcctcctgacagttatgttttctggatatatctcattgaatctagtgtatccaatgtcatcaaaattgtactgtaaagctaaaacattagcactatattagaaaaagcaaattatttattaacactatctttattcactaaactacttaaaatattgacactgattaataatatgaatatagttgctgctttcacagaacaatgtaagcaactaaaagtaaatacacaaaaaaagcactaattttctctgagagttaacacttttacaggtgacttactctctttataattacccacagttccataaatttctacaaatatacattactgttataatatttaatgtgattttttaatgcaaattcaaaaagcttaagagtccaatacttgtcaaaagccaaaaaatatgcgggcattaatttaaatagtaattgtttaagcaggatagactgctaataaatgaaaaaaaatagtaactgttggaagtcaactgttctctaggtgttttatttagttgttatcagtatttcctttagttttcctacataacttttaaatgttaatggaattttttgcaattaataaaagaaactaaaataaaccaacaaattacaacatacatctttataacaattatttctaccaatattgatcttcttctgaaatttaactttatttaggccttaaaaacaaaaatgaaccaatgaaactgtcttggaccctctagaccagcccaggtgtcacctgaatagcaataaatgactctggtggatgccagcagagcagaactgcccagccaagcctgacctaaattcctaacccacaagatcatgaaatatgtttgctttttaagccactgtgttctgaaatgatttgttacgtggcaataagaagctgaatttttcattttaaacttcagtttgaaaattatgtatggcttatcaaagacatataggtgtctttgcttcaccatctcttcaactaaaccatcgaagcagtcagtatttcaaacactgacagtaactacaaaagaaaaaagctcagagggttttgctccagtccagaagtgacccatatgatttccacccacaattcactggacacagtcacatgggcctgtcaagcaggcttggagctgtgtaattccaccacatatccagaagggagagtgccagaactatttgacagacaacaccaatatctaccaccacagtatataattttaaataatatactaaagttagggaaaattttatccaaagaaaaacctgatacttcaaaaagagaagtgtcaattacaaactttcatatcaaaaaaagataagaaaggacaggtaaagttaaattgttaggccaattaatgtaataagaatccaggctttttctttgtgccaaatgtcaccataatctgttgtgaattagcagctagactcaaaatgtacaaacaataatttggggtgtccactttttaaaataataatatcactaaagtttctattcttgtaaataaaggcatatgtagggtttatacaaagctgtatacttaaaccatatgcaaataaccaaaaggcgctgaagtaaagtaacacgtgtatggctttggaactccaattccacctgtctcatcaagtgtactgacaaagcaaaagacccctatcttgtctatgtcaattaaatactaacatctgaaaaccaccactaaataagaaccaatagtcattacataagcaacagctaaaaattaacaaataattagaccagaagataatctaagattttgatacataactcaaggcagtatgatagacatcattagtggaaatccctcaaaggttagtcacaaatggtaatcttgatattaaatccgatagttttactattttaataagaattattatttatgagacatatttataataatggataggtattaacttagttattgttaacaattataatccattccactatagttagaactggcttaccaaattagaaaagggatataactatagttaatacatgtaaaaagctaaactgaaaaatcaacaactcttgctagaaccataaggtcaataaagtcacagggcaaacaggtaccctcagaactggaggaatagacatgaatcacaacttacctgagcagaaacccatgggtaaaaagctccatgggtacaaaaacctgaaccataattgacaaaacgttggaggttcagtgtggacgagtctggaagatacaaactacagagggacccagtcatcgtggggccccacggttttgtgttttacctctaggagctctaccagtttctcacagtgaacttcacagaaaaatatcttcttgctttcaacagcaggaggggaaaaggaaccatttctcttaacaaggcctgccttcaggagaaactatttaactagagcctaacctacgagaagagaaataaactccagccagttctagcctaagagaactatctaactttagcccattctaggccattctgccccacctaaaagcagtgaaagggcagggtggggaggaagagtaaaaaattcagacttccccctcctcctacaaggcccaccacattactacaggcctatttacagctgttgtctttacccagtgtactacacctggctatcgagaaaaaaaattacaaggtatactaaaaagcaaaaaacacagtatagagcaacatcagaactagacttggatgcaggaaggaatttgaaatgatcagatgaggaattgaaagcaactatgattaatatgctaacggttctaatggataaagtagacagcatgcaagaagacgtgggcaatgtaagcagagaactcgaaattctagagattaaaatgatagagatttttttaaaactaacagaaatgatgaatgcttttagtgggtctattagtagacctcacacagctgaggaaacaatctcattgcttgaagatatttcaaaagaaacttccaaacctgaaaagcaaagagaaaaagactgggaaaaaaaaaaaaaaaaagaacagaatgtttaatacagaaaactacaaaaaggtaacatgtaatggaaataccaaaaagagacaaaagagaggaagaagaagaaatattcctcaaattaatctcagaaaccaaatgacaaagaacatcaaaaaggataaatgcccaaacaaactacacctggtcacatcatattaaaaaccacagaatactgaaaaaacctaaaagaggtcagagggaaaaaaatacctaaggtaacaattacatcaactcagaaaccatgcaagcaagaaaagagggaatgaaatatgtaacatgttgagagaaagaaaacatcaacctagaattctgtaccctgcaaaattatccttcaaaagtgaaggctttctcaggcaaacaaaaatttaagaatttgttgtcagatgacctaccttgcaagaaatgttaaaagtccttcagagagaacaagaacggtacaggtcaaaaacttagacctatatcaagaaaggaagagcatctcagaaggggcaagtgaagataaaattttaaaaaaaaacttttttcttattaactgatctaatagataagtttgttcaaaataatatctgcaacaatgtattcaattatgattgcttatgtataaatacatatgcttatgtataactgaaatgactgacagcaacaatacaagggatgcgaggaaggaattaggattattttgttcttataaagtactcacattacaagtgaaaattacagtggtgccatcttatccatggggaatatattccaagaccccagcggatgcctgaaaccaaataacagcaaacccaatatatccagtatgctttttcaatcatactaagatggctactaagtgactaacaggcaggtagcatatacagtatggatgtgctggaccaagagatgattcacatctcaggctgaaaagcacaagatttcattatgctactgaaaacagcgtacaacttaaaatttatgaattgtttatttctggaatttcccatttagtattttcagaccacggttaactggaggtaaccaaaactgtgaaaagcaaaaccacagttaaagtgggacactactgcacagtgttattagaaagtagacttgggtttgttgtaaacatatattacaaactctaaggcaacaactcaaaaaaaaaaagagagaactgtgctaagaaagaagagaaaacagaatcatacaaattgctcaattaaaaccacaaaaggcaggctgggcatggtggctcacgcctgtaatcccagcactttgggaggccgaggcgggcagatcacaaggtcaggagatcgagaccatcctggctaacacagtgaaacaccgtctctactaaaaatattaaaaattagctgggcaggaaagcatgcgcctgtagtcccagctactcgggaggctgaggcaggagaatggcgtgaacccaggaggcggagcttgcaatgagccaagatgatgccactgcactccagcctgggcaacagagtgagactctgtctcaaaaaattataatacaataaaataaaatgaaaccacaaaaagcacaaaaagagtggaagacaaaaatatgaacaaagaacaaggacaataaatagaaaacagttaacagatatggtagatatccattccattatatcaacaatcactctaaagctgggcatggtggctcatcccagtaatcccaccactttaggaggctgaggccagcatttcaagaccagcctgggcaacacagcgagaacccgtccctccaaaaaaactattttttttttaattagccaggagtggtggtgtgcaccagtagtcccagctacttgggaggctgagcacaggtagtcccagctacttgcgaagctgaggtgcgaggatggcttgagcccaagagttcaaggttacagtgaaatatgatggcaccactgcactccaacctgggtgatacagtgagattctgtctctaaaaataaagaagaatcactttgagtaacaatggtctaaatataccaattaaaagacagaaattgttataataggttgtgtttgtttgtttgtttgttttgagacagagtcttgctctgtcgcccaggctggagtgcaatggcacgatctcagctcactgcaacctccacctcctggattcaagtgatttttgtgcctcagcctcctgagtagctgggacagtacccgccaccatgctcggttaatttttgtatttttaatagaggtggggtttcaccacgttggtcaggctggactcaaactcctgacctcaggcgatccacctgcctcagcctcctaaagtgctgtgattccaggtatgagccaccgcacatggcctagaatagattttttaaaaagaaaacccaagtacatattgtctacaaaaaaaccccactttaactataatataaagatacatacggataagaaataaatggatggagaaagatattccaggctaaaaataatcaaaagaaagcaggagtagctatattaatttcagacagctcagatgtcaaagttatcaggaataaagaaaggcattttataatgataaaggggttaattcccaagacatcagtgtgtctaaacagaacatcaaaatatgtgaagcaaaaaaatgatacaatctcaaggagtaagagatgaacccactattatcgttggaaagtttaacacccctctcagaaatagatctggcgtgcagaaaatcaacaaagacatagttgaatctgacaccgttaatcaactggaaataactgacatctaaagactacttcatcaacaatagcagaatacacatgcttctcatccacatgggacacttacaaggtagaccacattctgagccataaaacataccttaacagatttttaaaaatagaaatcatacaatgtctgctctcagatcacgtcagaattcaactagaattcggtaacagaaagatagcttaaaatcccaaaatactgagacattaaacaatacacttctaaataacacataggtcaaagaagaaatctcaagagaaattgaaaaatattttaaactaaatgaaaataaaaagaaaatttgtgagatgcagtgaaagcagtgcttagaggaaaagttatggcatttaacacatatacagttgacccttgaacaatgagagggttaggggctccaacccccccaccacacagtcaaaaatctgtgtaacttttgactccttgaaaacttaactactaatagcctactgttgacaggaagccttaccaataacataaacagtagattaacaaatatttctgtgttgtattatataccgtattcttacaataaagtaagctagagaaaagaaaatgttattaagaaaatcatggccaggcacagtggctcacacctgtaatcccagcactctgggaggccgaggcgggcggatcaggaggtcaggagataagagaccatcctggctaacacggtgaaaccccgtctctactaaagatacaaaaacttagctgggcgtggtggcatgtgcctataatcccagctcaggaggctgaggcaggagaatcgcttgaacccggaaggcagaggctgcagtgagccaagatcgtgccactgcactccagccagggagacaaggaaaaggaaaaggaaagaaaagaaaagaaaatcataaggaagagaaaatacatttacaagaccatactgtatttactgataccataagtttatgtcacctgtttacaagactgtctacctgaaatagtgggcaacctcagctacagacttccatctatggtacacatcaagcagttcaactttttcttgtatgtcatgactttgcttcttgtagggagcactttaagcatcattagtggcacttcatatgggtcccgtggtgttatgcacaatttatagcactgcactgaacatggtgaaagatacatgagaagcgccagatcactttttaccaagatacccaatttactggagagatgaactgctcaaagatgattggtatcccatggtgttttaatcagatatttgcaacacttgagttcactgcaataacaacaggaggtggccacataattattacagttgtacagtatgtactacagtaaattttattcagttattatttaatactacatctttacatttgtttacatttctctcaattgccaatggtaccacatacagtctttaagtgtgtgcttaagttttgataaattttaactttcagtaatagatttgtgtatattttatggtagtaaacaataaaacagacaagtatctacatatactttatgcattcatgcatacctttttcttaattttttaaatatttctaggctacacagtccatctacgcattttttcaaattgtcacgaatctccacgaaaaatttccaatatatttactgaaaaaaatccatttatcagtgcatgcacatggttcaaccccaagctattaaagggccaactgtttcagaaaggagggaaaatctacactcagtaatatcaaaaatgaaaaatgggacatcactacagatcccatggaatcttaaatattcaagaaatactattaacaactgtatgcccacaaatttgataacctagatgaaatggaccaattacttaaaagacacaatatgctcaagcttacacaagaagaaataatctgaatacgtctatacctattaaaacaaattgaatcaaaaattaataaacttcgaatattgaacacacccagtttggttcattgctgaattctaccaaacatttaaggaagaaattataccatttctctatactctctttcaggagataaagcatagggaaggccaggcatggtggctcacatctgtaatcctagcactttgggaggccgaggcaggtggatcacctgaggtcaggagttcgagatcagtctgaccaacatggtgaaaccccgtatcttctaaaaatacaaaaaaagtagccaggcatggtggcaggtgcctgtaatcccagctactgaggaggctgaggtaagagaatcgcctgaacccgggaggtggaggctgcagtgagccgagattgtgccattgtactccagcctgggcaacaaaagcaaaactctgtcttaaaaaaaaaaaaaaaaaaaaaaaaagaaagaaagaaagaaaaaaagcatagggaatacagacacctcaccaataaacataaacagatgggcagataagcatatgaacagatgttccacattatatgttatcagggaaatgaaaattaaaacaacagggcatcactacacacctattagaatggtcaaaatctggaacaccaacaccaccaaatgtcagtaagtacacagagcaacagaaacttttattcatttctagtgagaatgcaaaatggcacagccactttggaagacagcttggtggttccttacaaaactaaacatactcttgccatacaatccagaaatcatgctgcttggtatttatccaaatgagttgaaaacttacatccacaacaaaaattgcacatagatgttgacagaagctttcttaactgccaaaaccagggtgcaaatagaaattccatcagtaggcaaatggataaactctggtccatccaaacaatacaatattattcagcactaagaagaaatgcactatcaagacatgaaaagacacggaggagggctgggcgcggtgactcacgcctgtaatcccagcattttgggaggctgaggcgggtggatcacctgagatcaggagttcgagaccagcctgatcaacatggagaaaccccgtctctactaaaaatacaaaatagccaggtgtggtggtgcatgcctgtaataccagctactcgggaggctgagacgggagaatcacttgaaaccgggaggcggagactgcagtgggccaagatcacaccattgcactccagcctgggaatacagagcaagactccataaagaaagaaaagaaaagagaaaagaaaaaaacagaaaaggatgtggaggaaacataaatgcatattattaagtgaaagaagccagtctgaaaagactacatatcctatatgattcaaactatttgacactctggaaaaggcaaaactatggagacagtaaaaagaatagtggttgccataggttagcaaggagggagggagcaaggagggagggattaataggtggaacacctattaatttttagggcagtgactatgatactataatgacagatacctgtcattatacctttgtccaaacccatagaatgtaaaccaagagtgaacccttatgtgaactataaactgtggataatgtgtcaatgtaggcttaaaaaattgtgacaaatgtaccactctagtataggatgttgatactgaaaaaggctatgcacgtgtcggggaaggggatttatgggagatttcagtaccttcctcacaattttgctacaaacctaaaattgctctgaaaaataaaggctatttttggccaggtgcagtggttcatgcctataatcgcaacactttgggaagctgaggtgggcggatcacctgaggtcaggagttcaagaccagcctgaccaacatggaaaaccctgtctctactaaaaatacaaaatcagctgggcgtggtggcacatgcctgtagtcccagctactcgggaggctgaggcaggagaatcgcttgaacccaggaggcagaagttgcagtgagccgagattgcaccattgcactccagcttgggcaagaagagtgaaactctgtctcaaaaaaaataaataaataaaataaagtctatttttaaaaacttatgctagaagtaactgaatgtatcgatgtgaactcacatttgtaagtgtgtgtatagatctatgtaattacagtcctctcagaacagggatatgttctgaaatattcatcattaggcaattttgtcactgttacacaaacctagatggtatagcctactaaaaacctaggctatttggtacagcctagtactctaggctacaaacctgtacagcatgttactgtacgcaactataacacaacagtcaagtatttgtgtatctaaatatatgtaaacatagaaacaatggtaagaatacagtgtaaaaacacaaaaaatggtacacctacatagagcacttaccatgaatggtgcttgtgggactagaagttgctctgggtgaatcactgagtgaatgtaaaggcctcaaacattactatgcactaaagtaggctttataaacactgtacacttaggctacaccaaatttttaaaatattatttttctttgctcagtaataaattaaccttagcttactgtaacatttttactttataaactttttttaaactttttgacacttttgtaataacacagcttaaaacacacactgtacagctatacaaaaaaaatcttcctttctacccttattctgtaagttttttggttttagggtttttcttttttgtttctctgtttttgttttaaacttagcccaggcctacacgaagtcgggatcgtcactatcactgtctttccacctccacattttgccctgctggaaggtcttcagcgacaataacacacaaggagctgtcatttcgtatgataacaatgccttcttctgatatagctcctgaaggttctgcctgaggctgttttacagcttttttgcttaagaaaaggggtacactccaaaataatgataaaaagtatagtatagtaaatatataaaccagtaacacagtcacttattatcaagagttatgtactgtgcaagagtgtatgtagtgtacttttgtatagtacatgtaattgggagtacactgggtttgtttacaccagcatcaccacaaacatgtgagtaatgcactatgttgcgctgtgctatgacatcacgacagctatgacatcatgacagctatgacatattgaggtgacagaaatttctccgctccattataattttatgggactactgtcatatatgtgatctgctgtcattatgcagtgcatgactgtactagtatatgactaaagtggactcacataactaattctcaacagtaacaattgtaatatgcatccctttgttgtgggaagtcagggaccccaaactgagggaccggctgaagccatggtggaagaaataaattgtgaagatttcacagacatttattagagccccaaaataatacttttataatttcttacgcctgtctttactgtaatctctgaacataaattgtgaagatttcatgggcacttatcacttccccaatcaatacccttgtgatttcctatgcctgtctttactttaatctcttaatcccgtcattttcataagctgaggaggatgtatgtcgcctcaggaccctgtgatgattgcattaactgcacaaattgtttgcagagcatgtgtgtttgaactatatgaaatctgagcaccttgaaaaaagaacaggataacagcaatgttcagggaacaagagagacaaccttgaactctgaccgctggtgagccgggcagaacagagccacatttctcttctttcaaaagcaaatggaagaaatatcgctgaattctttttctcagcaaggaacatccctaagaaagcaaatgcatccctgagggtgggcctctaaaatggcccccttgggtgcggctgtcttttatggtcgagctgtagggatgaaataagtcccagtctcccgtagcgctcccaggcttattaggaagaggatatccccgcctaataaatttttggtcagaccagttgtctgctctcaaactgtctcctgataagatgttatcaattacaatgcgtgcccgaaacttcattaccaattttaatttcgccctggtcctgtggtcctgtgatctcgccctgccttcatttgccttgtgatattctattaccttgtgaagcacgtgatctctgtgacccacaccctattcatatactccctcccctttgaaaatcactaataaaaacttgctggttttgcggcctgtggggcatcacggaacctaccaacatgtgatgtctcccccggatgcccagctttaaaatttctctcctttgtactctgtccctctatttctcaaaccagccgaagcttagggaaaatagaaaagaacctacgtgaattatcgggggtgaattttgcccaatatctggctgaatttcccccgatatcccttgagcctaaatttttgtccctaatactattctccactaaaaaactagaagtccttagagaatagctgatttcataccttgtggcagggagaattttaaatgggcctgaaaaataaaacttttgccaaagagcacagagctctgaaaggttttgagatgttatttaaaaggactcagaagccagctgacaaggggctcccatgagccaaactatgacaacttgaacactaggagaaaaatgtttaattataactaactgaattataattagctaattatagttaatgaaaacaagtttgcaaagacctgattatgtgattctcaagaaaaaaaaagtttctcttctcttcaagtaactagcacttcactcaagttgattttattcatataaaaaaaatgcgcagagactggtaacagccaccaccaacaaaagatcaaattttctcagctgggtgtggtggctcatgcccgtaatcccaccactttgggatgccaaggcaggtggatcacgaggtcaggagttcaagaccagcctggcaaagatggtgaaacccagtctgcactaaaaatacaaaaaaattagccaggcatggtggcaggcacctataatcccagctactcgggaggctgaggcagagaattgcttgaacccgggaggcagaggttgcagtgagctgagataaagatgaaattttcttaacataaaatattaccaaatgaggtttcttattactttcccaatggctactcctagattactcattcccatccacccaccatggtaggagactcattagcattcttttcttttttctgagacaggatctcactctgttacccagactggtgaacagtggtgcgactgattacaggtcactgcaactggtgtctcccgggctcaagcgatcctcccacctcagcctcctgagtagctaggactacaggtgcacaccatcacacccaactaatttttgtatttttttgtagagacgggtttttgccatgttgcccaggctggtctccaactcctgagctcaagcaatccacccacctaggcctcccaaaggtctagggttataggtgtgagccaccacgcccagcgtaatacccttatattactacaaaacattaagtaagcatgtcaaggcacaggatttacaggaacaagagaaccttcaaataaaccctggggtcttgagacatacatatgttaaaaccttgcagcaaacttgaatgtgcttttaaatgaactagaaatttatggaacaaactctgtctggatttgcaggtttagtggttataacagttattctttctttcactgttctccttgccctatgttcactatgttccctaaaagaagtggacaatggactttccaaggacaaagacaaaacaaagactaatatacacttggctttattaactttagtaaagccaggttaaaaaaaatagttttctgctcctattaaaacatttatctaaactgtatttgccttgacctctcataggagacagcatgagaagacagtccattcgtggggcttactactctccagtaaggaaaaaaaaatgccaggaatttagttttgttgtaatgttgtaatgttccaagaatggtaggtagcttagaaaacataaagaaaattcaagaacacaatactgcttcacttagtgaatccaattcctcctatatccctagaagtattcttggcactggggataaataaggtaacaagacaaatcccctgacttcataaagcttacattctagtgtggaaagcatacaataagccaatatgaaattaaatgtcctatctgttacgtactaggagaaaaataaagcaggagaagacaaagtgacaagtgttactttttagacaagtttgtcaggaaaggtctctgggaaaactgtaactgagtagagacttgactgaagtaagggaataagctgtatgaatatctgagaaaaaatttttccaagcaaagaagacaaaaagtgcaaatgcctgagaaaggagtatgtttggtgggctcctggaaaagccaggaggccagtaaggatggagcccagtgaacaagggaacataagatacggttatacaagtagccaaagtcagatcaatggagcctgaaaacaatggtactgcatgaactttgaattttattctaaatatcactggagtctttggatggttgacagagggaagtaaaaggctctcactttgaatttggaaggatcactctggctactatgtgtgggacaagagtagaatggaatgaaaaggaaaaagaccagttaggaagctattgcagcagtccagtggaatggtagtgtgaagttctggaataatagcagtggaggggtcaaagtaattgaatccaggatatactgggtaggtaaagccctccagtgggctggatgtctaaaatgtgaaaatgtgaaatgtgaatgtctaaaatgtgaatgtataaaatgtaaaatgtgaaaatgtgaaatcaagaaagactccatctttttaagcctgaacaatatacagtggcaatataccagaggtggtaacactggaagagagggtttcaggataacaacaaaaatttccagagaggacacactaaatatgagatcctcttcagacatctaagaagagatgttaagaaacaagctgaaagatacaggttgtgttcaaagcaagaaagagctggtgacgtaattttagagtcattagcatttagataacataataatagcacaaaaatagataataagccattaaactgaataagaccacctaatacataagaagatgagcgaagagaatgagaaaaaaccagtgaaggagtaggaaaaaacaaaaaaacaaacaaacaaacaaaaaaaaaccaagacaatgcagtgacctgaaagtcaagttttaaaaaaaagtttcactcctgagagtggttagctgtgtgaaatgatcctgaaaggttaaggaggatgaagactaaaagctggtctgggcaatatgagatcattacattgacaagaataattttagtagaatgggaggaagaaagcttcattagagtgggttcatgagaaaatggtgaaaaataagtagtaatcataggtataaataactcaaggatttttgctatgatggagcaaagaagctgtatagtacctaaaaggggatgttggatcaagagaggctatttgtgttgaaagggggtgattctgcagcaccccccttatgctaatgaaatcaatgagatggaaaagttattgatgcagaaaagcaaggacaactgcagaaccaaagtccgtaatacatgagaggggacacaatggaagacacaagcagaggagctggctttatccgcagtctttatcccattttaccaggacagaaacaacatacgggtagggatgcaagcaagaaaatagatttgatggtagatgaatatggaacttcttttctaattgttctctattttttattttttcactgaaataagcaagatcatcactaaagaatcaaaaatgagaaggggtgttggaagtttcaggagaaaagaaaaggtggtgaaataatcatcttcaataatcaaagggccgggcatagtggctcacgcctgtaatcctagcattttgggaggccaaggtgggcggatcacgtgagatcaggagttcgaggccagcctggcaaacactgggagaaccctgtgtctactaaaaatacaaaaattagccgggcgtggtggcgggtggctgtaatcccagctactcagaaggctgagacaggagaatcacttgaacctgggaggcggaggttgcagtgagccaagatcacgccactgcactccagcctggggaacaaaggacgaaactctgtctcaaaaaaacaaaattaaaaaaaataataatcaggcacggcgcggtgactcacgcctgtaatctcagcactttgggagggcaaggcaggtggatcacgaggtcaggagttcaagaccagcctggccaatatggtgaaaccccatctctactaaaaaatacaaaaattagcgaggcgtggtggcatccacctatagtcccagaccaggagggagactgaggcaggagaatcactggaacccgggagacagagattgcagtgagctgagatcgcaccactgcactccagcctgggagacaagagtgagactccaactcaaaaagaataataataataataataataataataataataatagcaataataataattagagccagacacggtggctcacacctgtaatcccagcactttgggaggtgggtggatcacctgaggtcaggagttcgagaccagcctcgtcaacatggcaaaaccctgtctctactaaaaatacgagttatccaggcatggtggcgcatgtctataatcccagctacttgggaggctgaggcagggagaactgcatgagcccggcgggtggaggttgcagtgagccgagatcacaccactgtagtccagcctgggagagagagcaagactctgtctcaaaaataacaacaataggccaggcacagtggctcacgcctgtaatcccagcactttgggaggctgaggtgagcggattatgaggtcaggagattgagaccatcctggctaacacggtgaaaccccgtctctactaaagatacaaaaaattagctgggtgtggtggcgggcgcctgtagtctcagctattaaggaggctgacgcaggagaatggcatgaacctgtgaatccaggaggcagagcttgcagtgagctgagatcacgccactgcactccagcccaggcaacagagcaagactcttgtcttaaaaacaaacaaacaaacaaacaaaaacactaaagcttcaaaaagacttttcagtagtaaaagtaacaatatatagtacagaaaaaaaaaccatatgaaaaagaattaacagtttaaagtaatacagtaattcatgaatgtgcacaaaagggtgaaatttagtattctgagcttccaagagtaatactctaactagaccttattggaaagaaactatagattatttgaaggctttccaagaattatacctatataatagcaacacatctgacaactgtaaggatttctggaaaaatgtattttaaaatctataacaatttttaatttttctcatctcttaactgcatgatattctgtaagcatcaagatgatattcaacttcagagaaaaagcctatcactgtgtctaaactttatctaacaactattgaaaactttaccaatgagagactatctcctacaggtatcctctcaatacaatatgaatcctagtccctttgataacttaccactgacctgaaaattttggaaactgctttgggcaaccaactctagctaccttttgcagatgcacaacatacagcagcttatttaagggcacctaaaagtccaacagaccagaaactatttggtctagtttggcctagcctttcacaatattaattccataacgaaacatactacttttttcagaacacatattaacaaaataagctttaaacaaacactagatggttcataggccagaatatactatgagcgattatactaacagcctggattactgtttctcccagtctttatttccttgataaaacatttatcttcagatataaaataattatactaaaccagggcttagggaaaaaagagagatagagggctcagttttttcactttgtcattagttatcaaaacaaggcagatgggaaacttagagttcagtataaaaacaaatgcttaacacagaatattgttatacaaatgctacatgcagtgtacaaacatatgcaaagcatcattatacattcttataaattcttgagttctgatacctgtttccacaatcgtttctgtttctgttgtctccagcccatccatgctgtcctcatcttccactgcagttttccccctacttcgaggtctacagaaaaaaaaaaaaataataagtacatagagttaaatgttaaattttaaggcttagacttatattcaacataaggcacaatttgaaggtatacaaaataagtaattagggcatttttccagcattttaccatatcaagtagaaaatatcagagtttacagtcattttctcccttaaatccagcacttccttatactctaaatgtgaggacagacccacatgaatataattgtgtcctcataattcacttaagtattcctcactctggttttgccccttttttaggtaaccttctgaagtctccctctgtctacagtagtggcttttaactacataatgggttcttcacaaagttcacataccaggtttaacttctatatttaataaagttgatgtgaaatgaccagatatatgtatttttaaaagctttgtaaaaggtgcttttggtgactgtgatgcagatgactaaaaaacaaaattttaaaaattaagcacgattataatcatgtccaccttacaagcataataaaatttaatttataaacacttcaggaaagtaaaataaaggtaagagtcacagcaaggtgaaattcctgacagaaagcaattgaaaaaaaaaaaaaaaactaatgcctttaaattctttgaattgtactaaatacggtatagaaatgagtaaaagaaaaattaataacacataagagcaacaagatattacacataaaaacttggaaactgacaaagcagtactcagataatgtcagtgttttaaattatttcgcagtattttaaactctttaaaagaaaaaggctgggtaaggtggctcacacctgtaaccccagcactttggagggtcgagttagatggatcatttgagtgcaagagttcaagaccagcctggccatcatggcgaaaccccatctctaccaaaaaaaaaattcaaaaattaggcaaacatggtggcgtgccagtaattccagctaaagaaaaaaaacaaagaagggagggagggaggaaatagaaagaaaaaatacaaatcaactcagtatttaattgaaaaacataaaacatttaaaaagtgaaaaacagctggctgtggtggctcacatctgtaatcccagcactttgggaggctgaggcagatatatcacctgaggtcaggaggtcacgaacagcctggccaacatggtgaaactccgtctctactaaaaatacaaaaattagccaggtgttgtggcgtgtgcctgtaatcccagctacttgggaggctgaggcacaagaatcgcttgaacctgacagatggaggttgcagtgagctgatatcatgccactgcactccagcctgggcgacagagtgagactgtctcaaacacacaaacaaaaaaaaggggggtggggggggggggacaatatgaaataaaagaataatatgaaaaaagaataaaacaaagaactatgttttaaacaataagaaatccatttaagtcttgttctcataaaaaagttaaccaacctaggccaggcacagtaactcacgcctgtaatcctagtactttgggaggccgaggtgggtggatcacctgaggtcaggagttcaagaccagcctggcctacgtggcgaaacctcgtctctactaaaaatacaaaaattagctggacgtgttgatgcacatctgtaatcccagctactcaggaggctgaggcaggagaatcgcttgaacccagtgggcaggaggtgcagtgagccgagatcacaccattgcactccagcctgggcaacaagagtgaaactctgtctcaaaaaaaaaaagttaaccaacctaaaccatgaaggagctataacataataatatattaaaaattaaggtgaccagccgggcgtagtggctcacacctgtaatcccagcactctgagaggccgaggcaggcagatcacctgaggtagggagttcgagaccagcctgaccaacatggagaaaccccgtcactactaaaaaaaatacaaaaacaaaaagaaaaattagctgggcatggtggcacatgcctgtaatcccagctactcgagaggctaaggcaggagaattgcttgaacctgggaggcagaagttgcggtgagccgagattgcaccactgcactccagcctgggcaacaagggcgaaattctatctcaaaaagaaaaaaaaattgaagtaatcaaagcctaaatggttttataattaaactactaaaaactatcaaaaagtcggtcttaaccaaaaataaaaaaaaggaagtacctgactcagaattccaacaaacattgtcaaaaactatgaatgaaaataaaaactgagaacaatcctattgaatataatcagaatgccaggatgattcaacattagaaatttgttaatgttacataacaagtcaagcagtcaaaatagcatcacttcaaacttcacagggggaaaggggaaagaaggcagaactaaataaaaagactacaaaacctgaaagatgaaaaagggtgaattagggagaaaacactctaaggtggatcttattgttcatggacaaaaagaaagaacatctttagaatttattaagtagttgtttttaggctgggcacggtggctcacgcctgtaatcccagcactttgggaggctgaggtgggtggatcacgaggtcaggagatcgagaccatcctggctaacacggtgaaaccccgtctctactaaaaatatacaaaaaaattagccgggcgtggtagtgggcgcctgtagtcccagctactcgggaggctgaggcaggagaatggcgtgaacccgggaggcagaggttgcggtgagctgagatcacaccattgcactccagcctgggcaacaagagagaaactccgtctcaaaaaaaaagaatttattaagtagttgtttttaaatttgatagaaaacattaaaataaagtggaaagaagggataagaaaatttgatcaatccaacagcaggcagaaaaggaatgaaaacaaatggtacatagaaaataacataaaaagataaatataaatatgaattttcacagtaaacataaatggcttaaactgtcataatgataaaaaaattaatttacttggataacataagagaacttcagattacataaagcaaacatttacagaacaaagagaaattggtaactaatcattagagagatattaacatcccactgtcggaaactgatagatgaaacattatagtttgaagcattttaaacaagtatttggacaacacattgagcaagcattactagattactctatcaatcttcctttgtgtctgactctgttcaaacacagtggatacagaaataaataaaacaaaatccctcctgtcacaaaactacattctagtgagaagagacaacagtaaacaagtattacacatacaacatccaacaaaagaaagcaaagaaaaagggactagctattttaaataacagatttataaaataaatgttttaaaataaaattttgtaaggagccactttagcacagaactgaagatgaagcaaaccatacagatatctgggagaaaagcattgcagtagaagtaacagcaaatgcaaaattcttgagatgagagcaagtgaggggggttagagggacaagaaggatatacggtggctggggcagagtcagcggtagggggtaagaaggcatgaggtctaagaatttttttttaataggatcactttttgtttagaaacctgtagaccaatacaagaactggggactgggagactagaaatcctcgaaacaatcccaacatggctgcttcaaagaaaatagagaatgacaaaataattcacatgccattatggaggtagagtttacttttcatctttcttttgtgatttttcataatcataaacatccacttttaaagaaattggaaaccgtatggtttagctgactttttaacttaatctctcagacccatgttttgctctactttgagttttttctccactatcttgaccatcactgtctatgctgttgtttgttttggcacaactggctttatttcaagctcgttctgtctagtttataatctctatcaacatatcagttatctgcattgccctacttactccttaaaaaataattttgattttaatttttgcttttcaaatttttcttctgatttctattcttggttttggcactaggaagacatgctttttacgttgatcaattcatcagaattcctttccttctgggcaatggaccaacttattgacatcatgtcattttcgaattcttttatttcatcggtgtccttattgctgctcattggcttctgccatgtgacttttctgactaatcaaacactatattctgaatgcaaagataatggtcatactcttcaaaaccctatcagttgccaactttcatatttaaacagcaaaatagatacatgttttatatttccatattgagtcagatatttccagtttcagtttttaaggaaagtttgaagtctaattacaaatgacaacatgaagattatttattttaacccttctttgggttttcttcgttcccctctttttcctgtctcttaaccctttcatttcagtgttcttcacttcactttattaccaagaaatgtgaagtaaaagaatacaactaactttatttgagaaaattttctaccaaaactttatgttccatattaatctcagaatctgaaaccaacttgagttcctaaagtaacataggagacttctacataaagccacatgggagtaagacaggtcaaaattaccctccagcccaaacaactaggaaaccagacaaatataagaaacaaccttattataagacactgggcaacaggtatggcgaagggaacaaagggaaagaaacagggtgacccctaccatggcacaggctttctgcttggcattaatttagaaactaccacacagagataggaacccaaaatgagagctgaaatgagaagacagaaatcataggttcaggtggctcaagaagactagaatttgtgggacagactacccaagagaagagaggtattcagagaaagagctccagaaatctgcagagggatacccttgagtttcaactgaataccaatctgcacatgtgtgatgtgaaatcccagaagactgaacaagaacaacttccagggagagagcaattacagaagaacaattcccagagctcacagaaagctgcgaatcaactgtattgtctctagccaactgtattgtctttagccagagtggcaagacctcaatgactatgtaacacattcagcagagaccagagtgagacacacctttaggagcagggctaaatgagccacagaacaaatgctattctagaccatccctaaaagagctgacaaataagtctcaacttatcctgagagtgactctgtatgaaaaaaataaataagtctcaactgaacaataatgattcccaacttaactactgggcataatccaataatccagctattataagtatgcctcatatgcgcaagaatgtaaagaaaacatgaatatgagagaaacagaagatattaaaaataacatggaactcaaaggtaacatcaaaagataacatcaaatgtaaatttcaggccgggtgtggtggctcacgcctctaatcccagcactttgggaggctgaggcgggcagatcacaaggtcaggagatcgagaccatcctggctaacatggtgaaaccccatctctactaaaaatacaaaaaattagccgggcgcgtggtggcaggtgcctgtagtcctagctatttgggaggctgaggcaggagaatggtgtgaacccaggaggtggagactgcagtgagccgagattacaccactgcactccagcctgggtgacagagcgagactccgtctccaaaaaaaaaaagaaaagaaaaaaagaaaaaaatgcaaatttcacattgaaaagttaacatgtgattagaaatgacaaaagaagatcattatccctaaagacataacaaaaaaaaatctattcaaaataaagaacagtatgaaaaatgacaacacagctacagtgccctgtggaataatagcaacctacctaactaatatgtgtgaggttggggttaaagggatagggacaaaaaaattgtttagtgaaataattagctgtaaattttaaaagctgtattattataagcccacagatccaagcacaacaaaatctgaaacagacagacacacacacacacacacacacacacacacacacacgtaccagtaaggtactttatagtcaaattgctgaaaaagattaataaagagaaaatattaaaagcagcaaaagaaaatacacattgcttaaagggggaataaagtaaaaatgactgcaggcttcttgtctgaaactatgtaagccagaagacagtaaaaaacatatttaaagtactaaggagaaaattaaaggaaaaacccttctaaacactgaacaaaacatgcagcaaaaaaaagtatccttcaaaagcaacagtaggctgggtgcagtggctcacgcctataatcccagcactttgggaagccgaggcaggcggatcacctgaggtcgagttcgagaccagcctggccaagatggtgaaaccctgtctctgctaaaaatacaaaaatcagccaggaatggtagcaggcgcctgtaatcccagctactctggaggctgaggcagaattgctccaactagggaggtggaggttgcagtgagcagaaatcgcaccgctgcactccagcctgggcggcagagtgagaccctgtctcaaacaaacaaacaaacaaacaaacagttaactaaaaacttcctccttttttcttttcttcttttgagatggagtctcgctatattgctcaggcaggtcttgaattcctggtctcaagcgatcctcccaccttggcttcccatagggctgggattacaggcattagcctcccggcccagtgttttgttttgaagtgtgctttgtctgatattaacatagccactccagcttaatttgattagtgttggcatgttttatctttctctttatgtcattttatttcaattgtctttcaggtagacagaatataattaggtctaaaatagattctattagtggggcatagtggcatgtgcctgtagtcctgggtactcaggaggatgaggtgggacgaacacctgacaaaaacaacccaactcaaaaatgagcaaagaacttccacagacattttccaaagaagttatacaaatgaccaaaaaaacatgaaaagatgctcacgatgactattagaaaaatgaaaaatcaaaactaagatataccacctcacacccattaggatggctactgtgaaaaataaaaaaaagaataacaaatgttggcaaggacgtggagaaactgaaacactagtgcacaggtgtagggaacataaaatgatatgggccctggaaaacagtacggcagtttctcaagcagttaaaaatagaattgccatatgatccacaaattccacctctgggtatacaccaaaaagaatcagaagcagagtctccaaagagatatttatacacccatgttcacagcagcattattcacaataaataaaacataattaacagttaagtaaaatgtggtacagacataccacattggcagtatgtctatggtggaatactatgcagccttaaaaaggaaggaatttctgacatatgcgatactacaacataaatgaaccttgacaacaatctcctaagtgaattaaaccagtcacaaagaaaaaaaaatagtggatgattccacttatataaggtactaagagtagctaaaatcagagacggaaagtggaacggtggttgccagaggctgagagaagggagaaactgggagttattgtttaatggctataaagtatgagtttaacaagattttttaaaaagctatgaaaatggatagtgtctacattatgaatgtatctcacatcactaaaatgtacacttaaaaatagttaaggggttgggtggccacagacggccgggcgggatgtaaccagccgctgagctgcagcccttccgtgtccgcaggcttcggcccggccgccgccgcccatcagctatggaggagctttacaacttcccggcctgcagagccgggcgcagcaagggccagacgcggcgcgagctggcgctgcgagccaacgggccggcgcctggcgggcacgatcgcaaggtcgcgcagaagctcctcaatggccagcgccagttgcagccccggccgcacccttgcctcacctgagcctgggctcttgctcttgcggaatccacaggtctttcttgaagaaatctgtagtcagaactctgtgctgcatttttatccagagaaggaacaggaagagaagagtgtggtctcctagaaatctagcactggagaaacgaggaaaattcttccaaggatggtctcccactcagagctgaggaagcttttctactcagcagatgcagtgtgttttgatgttgacagcacggtcatcagagaagaaggaaccaacattcaaagcagctgccaactattccaagtttcccagctggaggagccctgacctgcaccttcgcagaagccctgaagcagacaccccagggagcacctaccaggggcacccccggctggcaccagcatacaaagtgagacagggtctcgccttatttcgcaggctggtctggaactcctgagctcaaacaatctacccacctcggcctcccaaagttctgggattacaggtgtgagccaccttacccagagaggcgaacctggattgggaaagtcgacattaatcaactcattattccttacagatttgtatgctccagagtatccaggtccttctcatagaattaaaaagactatacaggtggacaatccaaagttttaatcaaagaaggtggtgttcagttgctgctcacaatagctgacaccccaggatttggagatgtagtggataatagtaattgctggcagcctcttatcgattacattgatagtaaatctgaggactacctaaatgcagaatcacgagtgaacagacgtcagatgcctaatagcagggtgcagtgttgtttatacttcattgctccttcaggacatgaacttaaaccattggatattgagtttatgaagcgttcgcatgaaaaagtgattatcatccaacttattgccaaagcagacacacttataccagaggaatgccaacagtttaaaaaacagataatgaaagaaatccaagaacataaaattaagatatatgattttccagaaatagatgatgaagaagaaaataaacttgctaaaaaggtaaaggactgtttacctcttgctgtggtaagctagtaatactatcattgaagttaatggcaaaagggtcaaaggaaggcagtatccttggggtgctgctgaagttgaaaatggtgaacattgtgattttacaattctaagaaatatgctgataaaaacacacactcaggacttgaaagatgttactaataatgtccactatgagaactacagaagcagaaaactggcagctgtgacttataatggagttgataacaacaagaataaagggcagctgactaagagccctctggcacaaatggaagaagaaagaagggagtatgcagctaaaatgaagaagatagagatggagatggagcaggtgttagagatgaaggtcaaataaaaagttcaaaaactaaaggactctgaagctgagctccagtggcgccgtgagctaatgaaaaagaatttggaagcacagcacaaagaattagaggaaaaacgtcgtcagtttgaggatgagaaggcaaactgggaagctcaacaacatattttagaacagaactcttcgagaaccttggaaaagaacaagaagaaagggaagatcttttaaactctctattgaccaccagttacgtattagttgccaatatgccagcttggacatcagtgtttgttggatccgtttgaccaatatgcaccagtttcatccataatgatggatttaacagcgtgacaaaaattattttttcttgtttttcttgatggagattaagatgccttgaattgtctagggtgttgtgtacttagaaagtaacagctctaagtacctttcctacattttctttttcttttttttattaaacagatatcttcagtttaatacaggagaacattttactgttgtacaatcatgttctcgtggtttgattgtttacagcctattccaaaataaaaggactgtggaaggttaaaaaaaaaaaatagttaagggccaggagcagtggctcacacctgtaatcccagcactttggaaggccaaggcaggcagatcacttgaggtcaggagttcgagaccagcctggccaacatggcaaaatcctgtctccactaaaaatacaaaagttggccgggcatggtggcacgtgcctgtaatcccagttacttgggaggctgaggcaggagaatcacttgaacctgggaagcagagactgcagtgaaccaagatcacgccaccacactccagcctgggcaacagagtgaggccctgtctcaaaaaaaaacaaaaacaaaaaaaaaaacaagatggcaaattatattttgtgtatattctaccacaactttttaaaaactcaaatcaaaatctgactgtttgtaaagatcaataaaattgacaagattccagcaaaactaacacacacaaaaaaatgactactatggtttgaatatcatttgtcctcaccaaatctcatgttgaagcttggtctgcaatgtagcagtgttgagaggtggtacctttaagaggtgattaggttgttaagagggattaatgtcgttctgaaaggagttctcactcttggagaagtgaacccacaagagtaggttgttataaagtgaggatgcctctcatgtttggcctctctttgcaaacatgtgcttccccttgcacttctctgccatgttatgacacagcacaaagccctcaccacatgcggcaacccatcttagatttctcagcctccagaaccataaaccaaataaatctttttcctttataaactaccaactctcgggtattttgctatagcaatagaaaatgaactaaaacaggaatgaaaggggatttcactatagactccacagacattaaaatgacaataaggttgggtgcggtggctcatgcctgtaatcccagcgggcagatcatgaggtcaggagatcgagaccatcctggctaacacggtgaaaccccgtctctactaaaaatacaaaaaaattagctgggcgtggtagtgggcacctgtagtctcagctactcaggaggctgaggcaggagaatggcgtgaaccctggaggcagagcttgcagtgagccgagatcacacaactgcactccagcctggacaacggagggagactccgtctcaaaaaaaaaaaaagaagacaataaaagagcagtatgaacaactccacacacataagtttgatatctttaaatgaaatggaccaattcataggaaatgacaaactaccaaaactcacccaagatgaaatatgtaacctgaacagctctgtaactattaaagaaattgaatttatagtatgaaattttctgaaataacaatctccaggcccaggtgctttcactaactaatttctaaccaacactttaagatgatgtaacaccaactctacagaatcccttccagaaaaaggagggaacaacatttctccactcatttaatgaggtcagcattatcctaaagccaaaatcaggcaaagacagtacaaagaagcaaaactaaagaccaatttcctaagtgaacataaacacaaaaatcatcaagaatatattagcaaatcaaactcaggaacataagaagagtaatataccacaccatgtagggtttatcccaggaatgctacacttgttcaatattcaaaaaatcaatcaatgtaatctaccatgttagaagtctaaatcactggtcagcaaactacggtccagaggccaaatccagtcctgtacttggtctttgtaataattttatcggaacatagccatgtatatttgtttacatacagtctacatctgctttcatgctacaatagcagatatcagcagttacaacagacagcatattgccagcaaagcctaaaatatttactatgtgaccccttacagaaaaaaatgtgggaggtcaccaccattagacctgccttacaagaaatgctaaagaaagttcttcaaattgaaacaaaagaactctaaaaacataaaaacatattaaagaataaaactcactataaagataacaatatattcaaattcagaatactccaatactgtaatggtggtacctaaatcagatttaagtctagtataaatgtaaagagacaaaagtattaaatattaactatacatacaacaatttggtaatggatacatgatatataaaagatatacattatgaaatcaataatacaaaatgtgaaaggagacgttaaatgtaaagttgtggtatactgttgaggttgtcagcttaaaatagactattaacactataagatgttttatgtaagcttcatggtaaccacaaaaaaaaggctgtagtagatacataaaccagaaaagaaccaacgcatatcactatcaaaaaaatcatcaaatcacaaaggaagacagcaagagaggaagactgaaacaaacaaacttacaagagtcagaaaaattgacaaaatggcgatagcatctccttgcctatcaataattattttaaatggaaataaatttaatactccagaagacacagattggctgagtgattttttttttaattttttcatttcattttattttttttgagatggagtctcgctctgtcacccaggctggagtgcagtggcatgatctcagctcactggaaaccccacctcccaggttcaagcagttctcccacctcagccacctgagtagctaggattacagacacatgccaccacacctggctaatttttgtatttttagtagacatggaatttcaccatattggccatgctggtctcgaattcctgacctcaggtgatccacctgccttggcctccctaagtgctggtattacaggtgtgagccaccgtgcctggccgagtggatttttaaaaacaagatccaatgatatgctgcctacaagatacatgaaacagaaaatcaaaagcatatcactaccaaaaaatcgtcaaatcacaaaggaagacggctagagaggaagactggaacaaagaaactacaagagtcagaaaaactgacaaaatggcagtagtaactccttacctatcaataattattttaaatgaaaagaattaagctctccaataagacacagattgaatggatttttgattgtttaagacggagtctcactctgtcgcccagactggactgcgatggtgtgatctcagctcaccgcaacctccacctcctgggttcaagcgattcacctgcctcagcctcctgagtaactgggattacaggcgcccaccaccacacccagctaatttttgtatttttagtaaagatggggtttcaccatgttggtcaggctggtctcaaactcctgacctcaggtgatctacccacctcagcctcccaaagtgctaggaatacaagcgtgagccactgcacccagccaagcggatttttaaaaacaagatccacctatatgctgcctacaagagactctctttagctttaaaggactgaggctgaaagtgaagagatggaaaaagatattccacacacatgttaaccaaagagagcagaggatccttacataaaataaaatagactttgagtcaaaaagtgttaaaagagatcagaggtcaattcatcaggagaatgtaacatttataaatatatatacatgccccaatttggagcacctaaatatataaagcactatcaatagaactaaagggggaaatagcaataccgtaatagtggggaacttaaataccccactttcgacaacggataaataatccagacaaaaattaataaggaaacacagacttgaacattacagactaaatggacctaacagacacatacagaacattctagccaacagcagctgaatatacattcttcttaagcagacacagaatattctccaggatagatcatatgttaggccacaaaacaagttttaacaaattcaagaagaatgaaatcatttcaagtatctttctaacaacaattgtatgaaactagaaatcaatgacataggaagaaagctagaaaattcataaagaaatcaaaagggaaaatctgttaatatggttgtcatatttacaaatcaaggaaaaatgatcatctcaacaaatgcagaaaaaaaacagatataaatgcagtaagacttctatgtccacgggttccgcatctgtaaatccaaatgactatggatcaaaaaaatattatttgtttattactgtctctttagctgtatactccatgaagactagaaatttgttctattcactgctgcacccccaacacctaacagcaccagatgaaacataagcactcaatatatgttttgttgaaagagtagatggttctataactcaggacaaaaatatggattcaataacaaatattgagataacagcctaacaattctgaaaagcaagttacagttctgtctcccactgaacaaaataataaaatttcacagggaatcaaactttaaaacaaagccacttaatactggatgttgtgtcattaagctaagtgataagaaataagacactttaataccataaaggaacaggctaaagtgtcataattagcagaaaatatcactaatgtctacttagaaaatacaagtttatcaactgaaatgttaaaagagttctttaagattgtcagatcaacacagtaacatataaacatcaataacttttctatacagcatacagtagaaataattattctactgtaatagaaagagatatcaacaacaaagttactaggaataactttaataagtaatataaaactctacttatgaacataaaggaagaataaagtatcctgagacacaaacctaattttttttaaaaagggacaaaggatatgaacaacaaattcatttttgaataagaaattcagacacaattaatcaacctatagaatatgataaagtgctcaactttaccaagtaatcagggaaatcgaacaatgatatgaaaaatgaaaactactggtcaggcctggtagctcaagcctataatcccagcactttgggaggccaaagcgggcagatcacttgaggccaggagttcaagaccagcctgaccaatatggtgaaaccccgagatctctactaaaaatacaaaaattagccaggcatggtggcacatgcctgtagtaccagctactcaggaggctgaggcacaagaatcacttgaacctggcaggtggaggttgcagtgacccgagattgcaccattgcactccagactgggcaagagagcaagactctgtctcaaaaaatagtaataataataataataattaataaaaattgaaaagaaattttaaaaataataatttttaaaatgagtgaatgagaaaaacaaattctcaatagaaaaataacaaatacagtccaacaactgaaagagtgaaagtctctgaacacatgagatattcaactaaacaattttagaaatggaaatgaaagcaaggagtatcatttcagataccaaattagcaaagagtgataacacactctgctagtcaggttatgggaaaatcgacactagtaggagtgtaaactgaacaatcaggccgggtgtgctggctcatgcctgtaatcccagcactttgggaagccaaggtgggtggatcacttaaggtcaggagttccagaccagcctggccaatatggtgaaactctgtccctactaaaaatacaaaaattagccaggcatggtggcacactcctgtaatcccagctacttggggtggcttgaacccgagaggcggagcttgcagtgagccgagatcgcagcattgtactctagccttagtgacacagggagactctgtctctcaaaaaaaaaaaaaaaaattgaagagaaaaacacaaggaaaaaaatccatgcaaaatcaatttttcagaactcctcgattaaaaaataatgtcaaacattaagaggaatatccattttgcttacagacatacctcattttatttcacgtcacagataataagttgtttgtttgtttggggacacagtctcactctgctgcccaaactggactgcagtggcacaatctcggcttactgcaacctccgcctcccaggttcaagtggttctcctgcctcagcctcatgagtagctgagactacaggcacgtgccaccacacccagctgattttttatttttagtagagacagggtttcaccatgctggccaggctggtctcaaactcctgacctcaggtgatctgcccacctcggcctcccaaagtgctgggattacaggcgtaagccaccacacccagcgagttttttttaaaatagcaaaggcttttgtcaaccttgcactgaacaagtctttttttttttgagacggagtcttgctctgtcgcccaggctggggtgcagtgggatgatcttggctcaatgaaacctctatctcccaggttcaagcaattcttctgcctcagtctcccaagtagctgggattacaggcgcccacaaccacgcccagctaatttttgtatttttagtagagacagggtttcaccatgctggccaggctggtctcaaactcctgacctcaggtgatccacccgcctcagcctcccaagtgctgggattacaggtgtgagccatagtacccagcctgaacaaatctactgacaccattttccagcagcatgcactcactttgtgtctctgtgttacgttttagtaatcctcaaagtattttgaactttttcattattattatatctgtgatagtgatctacgatcagtgatatatatatattttttcctttggttgagaaagggtcttgttctgtcacccaggctggagtgcagtggcacaatcacagctcactgcagcctcaaccttccggactcaagtgctcagcctcatcggtaggtgggacaacaggcatgtaccaccacacctggctgatttattttttatagagatggggtgtcaccatgttgctcaggctagtctcaaactcaagcgatcctcctgccttggcctcccaaagtgctgggattccaggagtgagctaccatgctatctttgatgttactattgtaattgttttggaacaccatgaaccacgcccacataagatggctaacatataatgtgtgttctgactgctccaccaattagccattccctatctctctttctccctcttttcagacctcccgtttccccaacacacaaccatattgaaattaggccaattagttaaccctaatcctacaatggcctcaaacaattcagggaaaggaaaagtcatgtgcctctcactttaactgaaaagctacaaatgattaatcttagtggggaaggcatatcaaaaagtgagaaaggcctaaggctagacctcttgtaccactcagccaattgtgaatgtaaatgaaaaattcttgaataaaattaaaagcactatgtcagtgaacatgaaacaatcttgttgctaatatgaagaaagttttagtggtccatatggaagattaaaccagccataacattcccttaagcaaaaagcctaatccacagcaaggctctaaccttcttcaattctatgaaggctgagagaggtgagaaaactgcagaagaaaaactggaagcaagtagagattggttcatgaggaaaaatgctctcgtcataacataaaagtggaaagtgaagcagcaagtgctgacatggaagctgtagcaagttatctagaatatctaactaagatcattgctggaggtggctatactaaacaaggtgttttatgtagacaaaagagccttccattagaagaagatgccatctaggactttcacagctagagagggaaaatcaatgccttgcttcaaaggtcaggctggggccacacctgttatcccagcactttgagaggccaaggtaggagaatcgcttgagcccaggagttcaaggccagcctgggcaacaaggcgagactcttgtctcttttaaaaataataaataaataaataaaaactgactctcttgttaggggctaatgcagctggtaacttgacgttgaagctaatgctcatttgccactcaaaaagtcctagagctcttaagaattatgctatatctaatctgcttgctgtctacatatggaacaacagtctcctggatgacagcacatctgtttagaggttggcttactgaatattttcagtccactgtcaagacctactgctaaggaaaaaacattcctttcaaaatattagcactcactaacaatggaccaggtcattcgagggctttgatggatatgttcagaaagaagaatgttactttcatgcctgccagtacgatacatctatcctgcagcccacgtatcaatgagtaatttcaatttttaagtcttactgtttaagaaatacatttcggccaggtacggtggctcatgcctgtaatcccagcactctgggatgccaaggcaggcggatcacttgaagccaggagttcaagaagaccctggccaacatggcaaaaccctatttctactaaaaatacaaaaataagccgggcgtggtggcacacacctgtagtcccagatactcgggggagctgagtcaggagaatcgcttgaaccaggaggcagaggttgcactaaaccaagatcgcaccactgcactccagccagggcgacaaagcgagactccgtctcaaaaaaaaaaaaaaaaaaaagtgattcctgtagtagatttgggcaaagtaaactgaaaaccttctggaaaggattcaccaccgtagatgtcattaagaacattcataattcatgagaggaagtcaaaatatcaacatgaacaggtgtctggaagaagttgattccaactctcatggataactttgaggggttcaagactcaagtggaggaagtcattgcagatgtagtggaaacagcaagagaattagaagtggagcctgaagatgtgactggattgctgcaatctcatgataaaacttgaacagattaggagttgttccttacagatgagccaagaaagtggtttcttaaagatggaatctactcctggtgaagaggctgtgaaattgttgaataacaacaaaggattcagaatactatataaccttagttgttaaagcagtgtttgagctgactccaattttgaaaaaagttctacttttgggtaaaaaatgctatcaaacagcatcacgtgctacagagaaatctttcatgaaagaaacaggcaatcaatgtagcaaacttcattgttgtcttattgtaagaaactaccagaggcaccccaaccttcagcaatcactgctgggatcagtcagcagccaccaacatcctctatcagcaaaaaatcttacaatttactgaaagctcagatgatcagtagcattttttagcaataaagtatttttaaattaaagtatgcacattggttttttaaatataacgctactgaacatttaatagactgcagtagaatataaacataatatttacatgcactggtaaaccaaaatatttgtgtgccttgctttatggtgatactcactttattgtggtagtctataatggaacctacagtatctccaaggtatgcctgtatttactttggtaccaattctagatatatatctgcatatacccaggtatttaacttcctggtctcatgttccttaaatagttaataagaaagagtaattatgaaccatgcagagcaattaacaagcctaacttccaatattttcttcactctgaagtaagtatttccaacagtgtattatgtcagaagttctcagttttgggggtgctgtatcttaatttttctgtactctattttcaacttcactgaaataatacaagctctatcttccttacaaatttataaggaatcaaatgaaatgaaatatataaaagttgtcctctttctcccatcttcaaaaaacttcccccgcacttcatttcctgttagccctctctccttcaacagcctggtctgtagaaagagtccatacatggcctccctccactccctcatcttccattcattccttgttccaaggccctcccaacaccactgaaacttttttcaatgccctttttttaaattattattatttttttaaaaagcaaattctgcccccatcttttcattctttcagttgaaccactttttccaaaacactgtgcagatataaaaaatacgtagttaaggccagggtgcagtggctcatgcctgtattcccagcacttcgggagtccaaggcaggcagaacacaggtctggagttcaagaccagcctggtcaacatggtgaaaccccatctctactaaatatacaaaaataagccaggcgtggtggtgggcacctgtaatcccagctactcaggaggctgaggcaggagaatcgcctgaacccagaaggtggaggttgcagtgagccgagatcatgccactgcactccagcctaggcgacagagtaagactctgtctccaaaaaacaaacaaacaaaaatggacaaaggagccaggcgtggtggtgcacacatagagccccagctactcagaggctgaagtaggaggatcacttgagctagaggatcacttgaccccaggagttcaaggctgcagtgagctagaactgtgccactgcaatccagcctgtgtgacagagtaagactccatcaaaaaagacaaggacaaagacatgacaagagagaaaaaataagtataaaagacagagagagagagacttcaaaaaggaggacagggcagggcacagtggcccatgcctgtaatcccagcactttaggaggctgtaatgggaggatcacttgagcccatgggttcgagaccagcctaggcaacacagcgagaccccagtatctacaaaaactagccgggaatggctgggcatggtggctcacacctgtaatcctaacactttgggaggccgaggcaggcggattgcctgagctcaggaattcgagaccagctgggtaacatggtgaaaccccatctctactaaaatataaaaacttagccaggggtggcagcatgtgcctgtagtcccagctacttgggaggctgaggcaggagaatcacttgaacccaggaggcagaagttgcagtgagctgagatcacaccactacactacttcactccaggatgggcaacagagcgagactccatctccaaaaaaaaaaacaaaacaaaacaaaaaacaaaacaaaaaaaactaggctgggcacagtggctcacacctataatcccagcactttgggaggccgaggcaggcagatcacctgaggtcaggagttcaaggccaacctgaccactatgatgaaaccccacctctactaaaaacacaaaaattagctgagcatgggggcatgcgactatagtcacagctactcgagaggcggagacaggagagtcgcttgaacccgggaggcagaggttgcagtgagccgagatcgcaccattgcactccagcctgggcaacaagagcgaaactctgtctcaaaagaaaaaaaaaaaaaaactagccgggcacagtattgcgcacctgtattcccagctacttgggaggctgagatgggagggtcatttgggcccagaaattcgaagctgcagtcaactatgattgtgccaccgcactcctgcctaagtaacagaatgagatcttgtaatttaaaaaataaaaggataggtaggatttacagactggaaaatgggaaaaagatgagagtggaaaaaggaaggaggggtagcacgaatggcgggcaggtggacagaaaagtaaaattcagccatgttcaaaagggaacaaataaaagcaccgaaaggtaagacagacctagtatatttatgacttgaatcccaagctacgaaactggaacataatttagcagagagactccaaaagttttacagcaaaaagtattagaatcatttatatactgggaaaaaatagcctcctcattttaataatccagattgggaaatcagatctaaaacagatgttcaatggacatcccatttcttttgtaaaagcaacttgagtggtcagtcatcaagttttgttctgtttttaattcacaatgaaaatctgactactcatttattcaacaaatatttgagtgccagctatgtgctaggcactgttctaaacacgccaataacatttatttagtgggattgattctgtactctagaacaatggttcttaactggggagagggagtaatttttgctccccaagggacatctggcaatgtctaaagacatttttggttgtcacgggggcagggagggggggaggggtgcgggtgtgctactatatctagcgggtggaggccaggaatgctgcttaacatcctacacacaggagatactgcccatgacaaggaattagctagtccaaaatgtcaacagtgccaaagctgaataaatctgttcaagagcaacacatttctattccctcttccatagtaattgttaataaacattagttccattttctactatttctgttctacaatagaggctttaaaatatcttaagaaatataacaccattttaataatttggcaagtagaagtaaagataccatgaatcctgagatttcactttcaaaaatgtataagctacatttattttacaatataacttttaggaacaaagttgtcttctccttctgacactgactgttatcaaaaactgtgctaaaagctttgagtgatgtttgattattccttttattttggggtccttatagcagttaattaccacattctgccagttctttccaagtgaatgcctcacatttcaacggatccttttctattaccaatgtatcatctgaaatattttactaactggtttttctgaagctcaatgtccatgtctccttccctcccaagctatccctacccattaatactgtatttttcacctgctcaaaagtccatatggttgcccgtaacataccaaataagaacctaattcctaaagcttgacattcaaatccttttttcaactagctacaatccacttttccaactcttttttccactgctctccctcaggagtagccttttttagcaaaatgacttattctgagatacataaacaacctttccagatcagagacatcaaaagccattcaggcttcattgagacaaaagatacgcattcaactcagaataacagtaagaaatcaacttatagggaaaccagatctagccatgttctataaacatgagagataaccctgttggctcatgccactgtccttatttataacggcccctatttgcctttctacttctctgaactccttatccttcaaatctaccatcttttcaaaaacccaaacacagagtcacctcagtcaccattacctgcccttcccccaccccacccaatgcctgtggctttcaggtcatttattttgcaataaacttgtcatctcaattttactggttctcttttagattcagacagctgagattatgatagattcattagtaagctgaatggggaagaaaaggatatttacattcccaggccaattttcaatgctttttggaagattctgttaaattcacaatttccagaactggcaaggaataggtaaatatatacactcatatattactggtaagagtataaattggtataattatcctaaagtgatatctgccaacattgaaagtctttaaaatctgtatactctttggcctaggaattcaacttgaaaatttatcatgagtaaattataaaatgtacaaaggtttaactataaagacactcatctctgcattgtttctaactctcaaagattgaggtggaggggaaaattccttgtccaataaaaaaagactattccatgaatcatttatttaagtaatgtaatactctgcaactactaaaatcctatagtatcatggttattgacatgtaactcttttaatggctttctttcctaagctaagaaaaatacaaacatgattccacataatgtatttcaaatatttgtatacatttttctacttttctatattttccacacatctatatataatttgtgtgtgtgtgtgtgtatgcatgcatgtaaataaaatatacctctaagtcttgtaaccttaagatggtggggcaaaatatttttattttctgttgttgattatttaaaatttagctacattaaattttttctgatttagtaaacatacataaggcctatttatagttgaatggcagtcttacaaaacctaagcaaccttagtttacattatctgtgggaaaagcatttttagtagaatgcttgcacatcttcctacattcctgtaatcaaacagtatttatcatcaactatgttggtgactctcactttgacataggctgaaccagaaatcctaggaaaaactgatgatagaaagctaaggggaaggacaggaagccgggaaaccctgggaaaggagggattatattacacatgttatgggaactagtttgtatatgcggggcacagagcatacacttagataagaagggggtcataaaaccagaaaggcaataaatagaatgttatgagcatgaactctagatgcagactgtttaggttcaatcccacctctgcttcttactacatttattaccttaagcaagtcacttaacttctccctgccgtttctgccccatctgtataatggggataacagaccctaccttagagggttgtcacactaatgaattctgagaatagtgcctggtactacagttaagtgctcattagttgtccacactcatcatcgtcattactcctattactatgacgtgaagagttgtgctgctaggacaggagcagcaacttttcaacaccaatcacttttttagatggcctcctttctagccttgttagttgcccaaattctgaaaaaaaaaacaagaactaagactctagaaggagatccgagaggcagacatgtgtgtctgtgtgtgtgtgcgtgtgtgtaggcgcgtgtgcatgtagatgaaggaggaatcaggagtaatgccaagaatgagaaatctgtataagcagttcagaaaaggggcatcatgagtcactctcctcagtgctgccccaagagttccacagtttgttccttacatcattcacttggataaaacctttcaatgtctctccatggccttcagagttaaatcaaaactattccttggaatgacttaaaacccatactacctctaaagcctcatctcttgactctctcgcaccaagctcactgagcttccagccctactgaatttcttcagtaacaaactctcacatctcagagcctttgcacatgctgctccctctgcctgaaaagtaacctctacctcctccaatagcaaactgctactcaaccttcaaaatgcagctcaaggataactccagagctctttcctgatttcaagctaaatgcctctgctatattatcccccatgtgcataacaccaccaccaccaccaccaccaccaccaccaccaccaccaccaccaccaccaccaccaccaccacgctgcactgatccaccactagccgatgactcctttagagatcttgtctttgggtatttccagatactgtcctatacagtaacagatacattaaaaataataattttaaaaatttattaatcacagctggaaaatacagtgaacctactgattacactggaaactggtaaagaaaggtaaacaagcaaacatttattctgcctttcccatatgaacagttacactgggcaaccaagtaagaggtgatggaaacttttctttttataaaacagtattccagataataaaatgaaggagtaacacaactagaacattatcattttacaactcttaatgaatcaacagatctaggcattagtcaccaacagttgctaatgtcacaaaaagagacaaccatattttgtgcctcctgatgaaagaatgcaccacaatataagaagcagtcttataaaataagactgaacctgactctgaccaagcctctggttctaactactcatttggaaatacagaaaatagagaaacatcggggataaacctggtattgaatctcaggaatcagcaaaatcctgactacaggaactctacagggcaaataacccatttctttaacaaataaattgtgagaataaaaaggaaggtggtatcctacagattaagacacttaatcgcaataagtaagccttattcaaatacttttaaaaattgagacgtgttggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctccttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaaaaaaaaaattgagacgtgtttacctgaacatagaatatgatgatattatggatttaactgtcaatttttttttaagtatgatggtggtattaggtttttcttaagccttcactttttagaactacattctctaatatttataaacgatatcacattatgcctgaggccaggtgcagtggctcatgcctgtaatcccagcactttgggaggctgaggcgggtgaatcacctgaggtcaggagttcaagaccagcctggcaaacacagtgaaaccccgactctactaaaaatacaaaaattagcctggcgtggtagcactcacctataataccagctacttgggaggctgaggcaggagaagtgcttgaacctgagaggcgaggttgcagtgagctgagatcataccactgcactccagcccgagtgacagaatgagactccgtcaaaaaaaaaaaattaataaaaataaaaataaataaaagcacagaccctacagaaaagactgcctgggttcaaatcctgtgtccatgactcactctgagccttagcttcctcagctgttaaaaaagaaaaaaaaaaaaaaagggacaatagtagtctttacttcagaggacttttgtaagaattaagtgagttaagatggttataacatatagttctcccaaaacagtgcttcatagaagttttcattatcatcccccttcccactttacagaaagaaacacggacctggagaggtgaaaagtgacttgcttaatgacttgaaaaccatcttccaggaactgtgcttagcactggtggcaaaaactggctatttaccaaagcgtttccttttcctcctggcatatggctaaactacatttcccagcttccctttcacatgactggtctggacaatgaaatgtgggcaaaagtgaaagatgcctctgtactactcccaggccttgtccccaaacctcccatgcaatccctcaccgcttctcaccctcatttgccaggtggacatcaatgcctagggcaacggagaaaagattagcctgagtcccagtatgacttaactgttactgtgttactcttgaaatttcggccaccataaagtcagtaagactgtattttttatggactcatcacaacaaccattattcctattcaacagttgaggaaactgaagtataaagaaagtcatggtcaattactcaatggtagatccagaacttgaaccagcactgtcttaatacagagctcgggatcttaagtgacttccaagatcacaagaccagtaagggcaccaagatttctaacttagagtagatacattttatatagaattttgttaagtattccttaaaatatcactttaatatgccataagaataaccacagaatagtgttactttaaagtaaaaagatataaataggagcccaaaatgttaagtggggttttacaatcaagaagacacaccagaataagatattttttaaataccatgtacattaaagagatcatacttccttaccctaataaacagccatgtagtacaagttttaactttttaattaaatattaaaattattaaaaatattaaatatacaacttctatttggttttatctgagccattcctttatactgacagttacatgatgtgatttcagttatatatgtagttattggtaatttttcaaaaatagaatataatgaaaaaacttcatttcaatcattactgaactgcacctacattaatcacaatatacctatgaaaagatgtataacatatactagtatgccaaaaaaaaaagtgacaaaacagtatttatagtataattccatttttttttttttttttttgagacggagtctcgctctgtggcccaggctggagtgcagtggtgccatctcggctcgctgcaagctctgcctcccgggttcacgccattctcctgcctcagcctcccaagtagctgggactacaggcgcccaccaccatacccggctaattttttgtattttttagtagagaccgggtttcaccgtgttagccaggatggtctcgatctcctgacctcgtgatccgcccgcctcggcctcccaaagtgctgggattacaggcgtgagccaccgcgcccggcctaattccatttgttttcaaagaatatatatgcctatgtctgtatttttttctacatacatacacgtcttatctacaaaccaaaaacatctagaaaaatatacaaaaaaagcttccagtgataacctctggggagtaaaactgaacttgtgatgtataccttttcttagaatttgaatttatgaaaagcacatatacctttagaataaaaaatactttaaagctctatcatttacagtaatgcaaagtgatccaactctgaaattcccacataatcatgttatgcagtgaagctttctaggctggggggaaaaaatgtaacctcttcaaaaaaaaaaaataaataaataaaaataaaataaaaaaattgtaacctcttataatgaatatataaatatatataatttcattaatttcattcattatgggtatacatttatacatctatttacaagtaagtctgtttaaatacacatatccacacctgctaaataaataagtatgctctggccaggcgtggtggatcacgcctgtaatcccaacactttggaatgccgaggtgggtggacctcctgaggtcaggagttcaagaccagacttgtcgacatggtgaaaccccgtctctactaaaaatacaaaaattagccgggcatggtggtgtgtgccagtagtcccagctactcgggaggctgaggcagaagaatcgcttgaacccgggaggcggaggttgcgtaagccgagattgtggcaccgcactccagcctgggcgacagagcgagactgtctcaaaaaaacagaaacaaacgaaaaaagtatctaatcaggagattttggtaagcttttcaagcacacccttttttgtgaaactgagttctaacctgaagaatacctgggattgtatggcgaaaaaacacaatatattaaaattttaaaacagttcttattttaggctcaaattttatgttttggggactacttagacttttttttttttcctgggatggagttttgctcctgttgctcaggctggagtgcaatggcgtgatcttgggttactgcaatctctgcctcccgggttcaagcgattctcctgcctcagcctcccaagtagctgggattacaggcatgcaccaccatgcacagctaattttgtatttttagtagagacagggtttctccgtgttggtcatactggtctcaaactcccaacctcaggttatccgcctacctcggactcccaaagtgctgggattataggcatgagccaccgcgcccgaccaactttttgtatttttagtagagatggggtttcaccgtgttagcaaggatagtctcgacctcctggcctcgtgatctgcccgcctcagcctcccaaagtgctgggattacaggcatgagccactgcgcccagccaactgtcactcttaatttttttaaattaaaagaaattaaatttctcaattctggagactggaagtcccagctactcgggaggctgaggtaggagaatcacttgaacctgggaggccgagactgcagtgagcagagatcgtgcagcctggtgacagagtgagactccgtctcaaaaaaaaaaaaaaaaaaaatactgtcacttacgtcactcagtttgtggtattttgttatggtagctctagcaaactgataggagaggcctctagtttacactatttaaattttctaattatttactttttttttttttaaatacctggtggagtgcagtggcacaatcacagcttactgcagcctcgaactcttggcctcaagcaatcctcccaagtagctgggactacaggcatgcaccaccatacctggctaagttttatttttttgtagacatgaggtttcactatgttactcaggctggtcttaaactcttaagctcaagtgatcctccagccttggactcccaaagtgctgggattacaggtgtgagccaccatgctcggcctacacgaactttttttaaactagcaggggttatgtgaatagtgggattacagacattttcttcattatgctggtccatatttaaatcctctccccctcgcaaaaaaaggtaaaaatatacagccataaaaaagaatggaatcatgtccttcgcagcaacatggatggagctggaggctacactctttttcatcctctatcctaaaagaagtaactcagaaccagaaaatcaaataccacatggtctcatttgtaagtgggagctaaacaatgagtacatgtgaacataaagatggaagtaatagactagagattccaaaagagaaggtagaagaggaggcacacaggttgaaaactacctattgggtactagggtcactttggatgatggctgcgctagcaggccaaacctcggcattacataatctagccatgtaacaaacctgcacgtgtaccccctgaatctaaaataaaataaatttttttttaaattgtaaagaaaaaaagtattaaatgacataactaaatattctagacatcattctaccataagttgtccaagaaaaaccacattttaccttactgtttatcatttgaaataaaatattatgttaagatattttaaatttttaccagttccacaaaggaactaggaagtagaaactgaagaacactttgttaaacaagtccttggggattaaagaagtaatagctacgaagtatacaacagtgtgatgagtgaatccttctcatattggggttaaaatggtcattatagctactgagtaccacaaatccaatcaagttaggtattttgtatacattatcatttaattctcattacaacccatcacaatagatgttaattagtatgtcccctatttttcggataaggacattcaagatcaaacagattaaatggtcaaggtcatacaactaagaaatgaaagtgctgagactcaaacccaagttcatgtcttaaatcccatgccgtttgatattaaggaccatgtgtgtttaacaaatattagacacctgctacacacacacacactgtgccagatgtataagatagagccatgacccaagaaatacagtcactattctcaaaaaacttagaatctctgccaggagcaacggctcacgcctgtaatcccagcactttgggaggccgaggcagatggatcacgaggtcaggagttcaagaccagcctggctaagatggtgaaaccccgtctctactaaaactacaaaaattagccagtcatggtggcaggcgcctgtaatcccagctacttgggaggctgaggcagagaactgcttgaaccagggaggcggaggctgcagtgagccgagattgcaccactgcactccagcctgggcgacagagtgagactgtctccaaaaaaaaaaaaaaaaaaaaaaaaagccttaaaatctcctctttaacattctgttgcatgtatgtttttcctaggttttttgtcgttgtttgttttttgtttgtttttttgtttttgagacagtcttgctctgccacccaggctgaagtgcactgactggttccatctcagctcactgcaacctccgcctcccgggtgcaagccattctcccgcctcagcctcccgagtagctgagattatggtgcctgccaccacgcctagctagtttttgtatttttagtagagacagggttttgccatgttgaacaggctggtcttgaactcctgaccttaggtaatctgcctgccttggcctcccaaagcaatgggattacagacatgagccactgcatgcccggcctttttttttttttttttttttgacacagagtctctggcacacaggctggagtgcagtggcacagctcactgcaacctctgcctcccaggttcaagcaattctcctacctcagcctcctgagtagctgggattacaggcacacaccaccacaccgggctaatttttgtatttttagtagatacggggtttcactatattcaccaggctggtctcggcctcagcctcccaaagtgctgggattacaggcgtgagccactgtggccgttcttgtttttcctgtctttgtaactagactttaaagctcctcaaaagagctggagtataaacgaaaacacaaagagctttgagtctcagatctggaaaaattctagctttatcatatacatacataaatttaaatgctggattcctcaccagtaaaagggtcttggattaagtgatataaagtagtcctgtgcttatccataggaaatacatttcaaccccataccctacccctgcctggctcccataaatgcctgaaaccacggatgctacaaagccctatatacactatgttttatatttttctttgcctgcagtgaattccctctcttggcaatgccttataagttaccatgcaaaaaaatataaatgtatctcatttatctgttctcccctaccccccacaaccctacctacctctcacaggaccaagaattggaaaggccttagtgtagccaccacctaaccacagaaatgatccaaactcacatactactacttctttatttttcagtaaagttctccaaactaaaatgaaatatgcagtttgaaaataggtagtaaaaatacagcttttaaaatatatcctctatgctgtttcatagccacttcacaatgaccctacttccccatttataactcacctagttagttattagtaaacaactcttaatcaaaagtaaaaatgaagggctatggaactgttctcatatccccttcagtgtcttaaaggcactgtgctcagcattccacatgcattatcttattgaaagcgcagtgtttaatgaacttgcctaaagtcacatcagaaccaccaggaagcacaatttcattgtattttgtgtgaatgccctccccagcacaacaagaacggagctgtacaatgaagtggtctgggtcacacagctaattaagtaatggagttaaggctcaaaaactcttcagtatctgatgagaaagctcacactcaaaacctccaaaaaacactgcttcacatcactgaaattaaagaacaataatacaatataagtaaaataaaatgagaattccttgttatataataagccagtttatcagctttttttgaaggaagaaagggcaacatagtgatatcttgtctctactaaaaatttaaacattagccgggtgtggtggtatgcacctgtagtcccagctactctggaggctgagtagagggaggattacttgagccagggaggttgaggctgcaaggagccatgactgcatcactgcactccagcctgggtgacagagtgagatcctacctcaaaagtggtgttttgtttttttccaccaccccaatgctacctctataactcacacatgatagttttataaagataactacctggcattcaggttaaaatgacaactgcacccagaataggaaaaactataaattatgcattggactctgcgatcaccagcccctacttgtaaatttcaatggagattcactttatttcaaaattagaaaactgatctcagagtttaaaacctcatttacagctccaaaatatttagaatctagaattatataacaaatacttactttcttagcatgcaaaaattatttacaaatcatttaaaaaggatgatcgacttaacagaaaaatgggcaatgacaaacagactattagttacctaaccaatagccactccccactcacaacctgttccttacagagtccacttcccattatcatggctgcaaggaacatccttgctctctcaccctcacttgtatctaggacatggatggataccaatcacggctgatgggatttaagaaaaaaatctgttggccgagcgcggtggctcatgcctgtaatcccaacactttgggaggctgaagcaggcagatcacctgcctgaccaatagagagaaaccctgtctctactaaaaacacaaaattagccgggcatggtggtgcatgcctgtaatcccagctactggggaggttgaggcaggagaatcgcttgaacccaggaggcagaggatgcagtgcagtgagccgagatcgtgccattgcactccagcctgggcaacaagaagcaaaactccatctcaaaaaaaaaaaaaaaaaaaaaatctgctaagggcttccaggaaaggtttttaattccaaataaaatagatgtgcatgaacaaatatacttcatctttactggtcattgaacctggtgtgaactacgaatcctctttttctcacatgccacatccctcaacaaatcttttcggctctgcctcaacatatgcagaattacttcaacatttctctgatgcctatcatgcttcaaatcatctgttaccctgctaatattatctaacatgcctgcttcttccttgatctccttcattctagtctcaacacagcagccagcatgagagttttagagtcttggtcagataaagccagtcctccacttaaaagcccccaaaggactctcatctaatccagagtaaaagtcaaaagatctcacaatggtctacaaggccctgcacaatctgactccccacgctacttctcttatgatgttttctccataactcagctcctgccacactggccctttcagttctatgaacatgctaagcacattcctgcctctggggcttttgcactcactgttccccgcatcagcaatgctctttccccaaatatctgcctttgcattcttatttcttttaagattctattcaaacatcagctcactgaggccttctctgatggccccacttaaaacaatccaacccagcccttcccgtcccttccatggctttatttttttccataaaacttaacatcttctgacaatctataaattctacctatttgtttgactgtcttctcccttatccccactaaaatataagcccgtgaaggaaggcaatgaactttgttttgctcactgctgtatttcccgtgcttatggactactgcctaatacattttaggtggtaaatgattatttaagtgaattaatttagcaactatcgacaacaagctgagtataaaacagcaggaaaatgaaaaccatctaggtccgtgataatttaattgagccactgaattacacctggacttccagtcatgtgaggtaaattttatttatggtttaatgcatttttaattaaaatttttcttatttgaagctgcaaagtacccgaaatagggtactggtaggcagtttgcaaaaaaaagtgacaaatataatcaatttaactcaatcgtaaggcatgccaattaaaataaccatgaaataatctcactcaagaaaaaataaaagtttggtacatgtataatcccacttaatatgactcattacaacaatagtagcattaaaaaaattttaagggttttttgtttgttgagacagggtcttgctctgttgcaccggctggagtgcagtggcgcaaccatgactcactgcattctcgaccttttgggctcaagtaatcctcccatctcgactcctgagtagctgggactacaggcacgtggccgcacacctggcttttctttcccccccccagttagagacagtgtctcactatgttgcccagcagactggtctcgaactcctgtgcttaagtgatcctcctgtcttagcctcccaaagtactagaattataggcatgagccacagtgcctaaccatttttaagttttgttttgttttgttttgttttgtttttgagacagtctccctctgtcactcaggctggagtgcagtggcgccatcttggctcactgcaacctccgcctcctgggttcaagtgattctcctgcttcagcctcctgagtagctgggattacaggtgcctaccaccatgccaggctaatttttgtatttttagtagagacagggtttcaccatgttggccaggctggtctcaaactcctgacctcaagtgatctgcctgcctcagcctcaggcgtgaaccaccccactttctaagttttatacctaaatattaatatatataactcagtaagagtgtgatatcctatcaccagtattttccccacactttgagtgctagataggactgcccactcttagccaattatataaaaatattagttgatgctgataaagtgcttcctcttgtgctggccacttttacatgtgtaacttactgcccgcaacaatcctacaacctacaaaaccttgttttcccattttaaagctcagaagactgagctacaaaaatagatcaatgatcagccccaaatcaaacagctactaagtgtgaggctgggatttgaacataggcagttctgaaaaccaaaacccaaagcattacaaacactatcacccataagcagagcattctcctaaactgaatgtgccttttcctgccatttattctgtgtttggattctgacccacaactactgacaaaaggtattcaagtaacagcgccaaacttcccaaaagatattttgacagaaaaaaattaattaaaaaatacataaatgaaaagacaaagattggtggacatcctctgtctcacttcaagaaatcgagataataacagtaattactttttaggttgttgtgaggattaaataaattaatatagtacgtgtaaagcacttaggatagtgcttggcatacattaaaccaattaatagttttcattttcattgtaattctcataattattatgaaaggctccataaataccactaagcctagaaggactgaccaacagctatatgattagtaactggaaaaaactatggccagagacatgttatgactttagggataccaaaaagaaaacgacaattgctgattttcattctaggaacaaagtgccaaagtgatttagtaaagaaaaaatgctattagaactcccactcccattttcagaaatgtaggccctgcctactttctctcccaccaggtatgttgttagtgaggatgccaggaaaaaggcatactctgttgggggaatccaagccaacacctcacttttggagggcaactaatgaatatccatcaaaacttgaaacatatgtactgtcctcttcgatgagagaactttacatctaggaatttatcttccagaatatgtccacacgtacaaatacacaagtacaaggatattccttacaaagataataaaactggaaatcaactaaatgaccatcagtaggggaatggtttaactaatcagagggccttcaatctagtttaaaacctgtttctccactaagatcaatctctaatctaagtaaatgacatttctgtccactcaactactgaagccacaaatctagaagacaattttaattcttctttatctcatatccatctcatcaaatcctttagcagatcttaccgctgtaactttccaagctttttttttttttagatggagtctcactctgttgcccaggttggagtgcaggggcttgatgtcagctcactgcaacctccacctcccaggtacaagcaattctctcctgcctcagcctcctgagctttccaaacacttctgattgcctttctcctctgccatcactctactctaagccatatctgtcaaggttactttcacagccttatgggtgccctggtttataaccttctaagggcttttgctgcactaaggataaaatcccagcttcttaccacggtgtgaagggcactgcttgggctcctgcttgcctctcaaatatggtctcctaagttcccctcattgcacagtaacaccaatcgtttattttgggagatgggaggatcccttgagtataacacacttgatatggtttggcagtgtccccacccaaatctcatcttgaattaaagctcccataattcccacgtgttgtggaatggacacagtgggaaagaattgaatcataggggtggtttccccatactgttctcctggtagtgaataaatctcacgagatatgatagttttgtaagaggaaacacctttcacttggtactcactctctcttgcctgccaccacgtaagacatgccttctgctgtgagtgtgaggcctccccaaacacatggaactatgagtctattaaacttctttttctttaaaaattacccagccttgggtatgtctttatcagcagtaaacgcactaatacaacactcattcttgttttgagtcttcacaataaatcctgctcttcctaaaatgcctccacatcattcacgtgtgtttcaatgccatcacttcatacagaccttcctgaccaccttagccacatgcgttctctctcataccattaacagacacactcagtacagtaccacattttattttcttcatagcacttctcagtatttgagactaattacgagaaatgcatttattttgtgtttctcaccgttgaaatattgttccataagggcaggagcttggtctctctggttcaccactgaatccttacacctaaaacactccttggcaaattaagcacgtgattcatatctttggataaattttgaaaagaatgagatagatgtgtataagctaaaatggaaagatgcctaagatcaaccacaaagtgacaaaatcaaatcacgatataaattaaatgatcccattatcataaaaatggatataagtacatacacatacatagaaatagcaaaggtatacccataacaaaagtcaaggatacagtaattgtctctgaaatgtggggcaaaacagggaaaagagggtctttcacattttttgttttttattttagataagaggctcactctgtcacccagtgaaacacatgttgcccaggctggcctcaaactcctggcctcaagtgatcctcctacctcggccttcccaagtattgagattataagcgtgagccccctgcacccagccccttttactttttaagttatgccctcctgtgctctttatttttaccagaatgtattacattcataactttttatgtgacatcttctaatcttccacatactgtaaaaggcttaacacacataatgagtactcagttttgttttggagacagggtttcagctctgtcacccaggctggagtgcaacagcacaatcttgactcaatgcaacctccacctcctgggctcaagggatcctcccacctcagcctctgagtaggtaggactacaggttcgcaccaccaagcccagctaatttttgtgggatttttttaggggtagggtttcaccatgttgcccaggctggtctccaactcctgagctcaagcgatccacccaccttggcttctcaaagtgctgggatttcaggcgctcaccaccgcacccagccagtactcgcttttataaacacgcaaaacacctcctacaccacttaaagctgctattatatttctacaacctaacacattctgaaacactggataaataaatatctaaataattattagtttttggtctagtccagtttgagaactgaaagagattctctggctcaaatagcagatcaaacatatacatttatctctcttcagcaaaagaccattttaaacagtagtttaaaaaaatttaaagccaaattattattaaaaaacaaagtaaaattaatggaaagagatctcttctaaagtaaagaaactggagtctgggagagaggaaactagtgaacctagcatgggagttggcactttggggtaaaacaatggactcttgaatgtcagaatacaaaagactaattaacagcttaaccctaaagtaaagcctgcctgccaaccattaattcccaccaagagctcattgtgaacccttctactaaatcttaaagctgagtgatatccaaggtcagcagatatttggttaaaagcctacaatataaatgagactaagataacaacaaaaattacaatagagttgacaggtaagagggagggcaacaaaatttaaaaaaaaaataaaccttattaacattttcagagactcaagaagattattaatccataaaatgagaaaagatattggcgggggaggaaatgaaggagaaatctcaaacatttaaaatataacttccaatataaaattaaaaggtccaagaataaataaagtagaagagatggccagaccaaaaaaaaacaaacaaacaaacagacaaaaatattggggaggattaattcagtaagtctaataatccaactaaaagcagctatagagaaaacaaagaaaagatcactagaggccgggcgtgggggttcacgcctgtaatcccagcactttgggaggccgagatgggcggatcacgaggtcaggagatcaaaaccatcctggctaacaaacacggtgaaaccccctctctactaaaaatacaaaaacttagccaggtgtggtagcaggtgcctgtagtcccagttacctgggaggctgaagaagaatagcttgaacccaggaggcagaggttgcaatgtgccaagatggtaccactgcactccagcctgggcaacagagcaagactccgtctcaaaaaaataaaaaaaagaaagatcactaaagccgtaacatgaaaactttcaagaagtgaagcacataaagtattttgcttattgtaatggagaagaaaacacatctggacatctttgagaaatttcagtttaatgaggataaaagaaggctctaaagggatggatgaaaatatgaaacacatcacccacaaaggaagaagaatcacacagtatccgacttttcctcaccaacaacaatggacatagaagacactggagcaatcccttcaaaactctgagggaaaacaattttcagcttaattgcacttgaataaaataataccagtcaactgtaagggctaatgaggacttttacagataagcaaggattcaaaactttatttctcacatattctttcttagctatttatgtgggtgtactgcattaaaacaagttagtaactcaagaaatgataaagctctaataacagtagtagcactgtgcaaaaagagtaaggaaaagttcagcacaaaaacaaggcaacaggtctaaatacttctagcccaaactgaaggaaataggactaagggaaagcaggggagggtgggagggacttgatatgcataaaataagtaataatgacaaaccacagaaaaagattgataaaatgaatcgtgaaaatatgacaagaaaaatgcagttacagattcaaaaaccaagaaacaatacaaagaaatgtaattacatactacttgcctctgctgtgaaaaatattacatgatcataataatgtagaaactattcattaactttttttttttttttttcactctgtcacccaggctggagtgcaatggcaccatctcggctcactgcaacctccgcctccggggttcaagcaattctccctgcctcagcctcccaagtagccgggataacaggcatacgccaccacgaatttttgtatttttagtagagacggggtttcaccatgttggccagactggtctcggcctcccgccctcaggtgatcagcccgcctcagcctcccgaagtgctgggattacaggtgtgagccaccacgtccagcccattaactttcaagtattaaagtcataccggccaggtgcagtggctcacacctgtaatcccagcactttgagaggccgaggcaagtggatcagttgaggtcaggagttaaagaccagcctggccaacatggagaagccccgtctctactaaaaatacaaaaatttgccaagcacggtggtacgcacctgtagtcccagctacttggaaggctgaggtaggagaatagcttgaacctaggaagcggaggttgcagtgaaccaagatcgcaccactgcactcaagcctgggcaacagagcaagactgtctcaaaaaaataaataaataaacaaacaaagtagtaaggagtacaatacagcgcataactgttctcaaccttgacaatgtcaatgtcagaaatgacagatgtaagcacataaagggaaaaggaaaggtaaaaagaagagttgcagccgggcgtggtggctcacacctataatcccagcactctgggaggctgaggcaggtggatcacctgaggttgggagttcaagaccagcctgaccaacacggtgaaacctcatctctactaaaaatacaaaattagccaggcatggtggcgcctgcctgtaatcctagctactcgggaggctgagacaggagaatcgcttgaacccgggcggcagaggttgcagcaagccgagatcgcgccattgcactccagcctgggcaacaagagtgaaactccgtctcaaaaaaacaaacaaacaaacaaaagttactgcttggtacatcaagatcaacagtctatataacatgaaggaaagttctgatataaactgcagagataactagcagagaaattaaaagtgatttttaaaaaatctattggggaagcagatgtaaagaagccaaatcctcctttatcagagcagaaatcaatcataaatcataacatatgtatattatatagtcacgacaataccacaggaagaaataatttgaaagtttcctttggaaattggacccctatctttcaccatatacaaaaatcaactcaagaaggattaaagacttcatccaaagacctgaaactataaaaaccattagaagaaaacctaggaaaaactctcctggacactgatctatacaattcatgactaagaattcatgaatttaaagaattcatgactaagacctcaaaagcacaagcaaaaaaaaaaaaaacaaaaatagacaaatgagacttaagctaaaaagcttctgcatagcaaaagaatcagcagactgaacaaatggcctacagaataggagaaaaaagtttcaaactatgtatctcacagggtactaacatccagaatttacaaggaacacaaataatcccatcaaaaagtaagcaaagggctgttctgaatacctcactactgataactggtagtgagttatcccaattgatggttcactgtcagttaccgatcaaattccttgttctatactctttactcccctttcactactgcacttaactggtcttaagaaaaaattttaataaaaaatttttaagaattttaaagttagcaaaggacattaatagacatttctcaaaagaagacatacaaacagtcaacaggtatgtgaaaaaaatgctcatcactaatcatcgaggaaatgcaaataaaaaccacaatgacatatcatcttacaccaatcagaatggccactattaaagaaacaataataataacagatgttggggaagatgcagacaatggggaacacttaacacactgtgggcgggaatgtaaattagtaccacctgtatggaaaaccatataaagagttctcaaatgactaaaaaataaaactgctggccaggcacggtggctcacgcctgtaagcccagcactttgggaggccaaggcaggtgcatcacctgaggtcaggagttcaagaccagcctggccaacatggtaaaaccctgtctctactaaaaatacaaaaatttgctgggcgtggtggtgtgcacctgtaatcccagctactcgggaggctgaggcaggagaatcacttgaacctggtgggcagaggttgcactgagccgatatcatgtcattgcactccaacctgggcaacaagagcgaaactccatctcaaaaaagtaaaaatgataaaaaataaaactgctattcaatccagcaatcccactattgggtatccacccaaaggaaaataaatcattatatcaaaaagataactgcactcgtacctttatcacagcaacactcacaatagcaaagatagggaatcaatctccatatccatcaacagacgactggataaagaaaaactgggacacatacacacacacacacacacacacacacacacacacacacacacacgaatactattcagccataaaggaagaatgaaatcatgtcttttgtagcaacgtggaaggatggaaggacctggaggccatgttctcacttataagttgaagcaaaataatgtgtacatgtgggcacagtgtggaataacgacactggagactcagaaggttgggaggctgggaggagggtgagtaacaagaaattactgaatgggtacacgtacattatttggatgatggatgcactaaaagcccaaactgcagcactatgcaatgtattcatgtaacaaaactgcacctgtaacccttaaattgatacaaaaaagttgtttggagagtggcaataaggagtgaaacagaattcttgatccttattataagcattctgggctattagacttttttcaaccatgtacatatattactatgcaaagtttttaaatggacttaaaatctgaaagaacattgatcttttaatgaaaaacaaaaccataagatactctgcctaaactttccctcataatgcaatgaataaaactttaatctttctcttcaggataaataatttctgaggctttagaaccaccttaaaaggtatctctaggccgggcgcggtggctgacgcctgtaatcacagcactttgggaggccgaggtgggcagatcttctgaggtcaagagttcaagaccagcctggtcaacatgctgaaaccctgtctctactaaaaatacaaaaattagccaggcgtggtggtgcacatctgtaatccagctactcagaaggcggaggcaggaaaatctgaatccgggaggcagaggttgcagtgagccaggatcgcagcactgcactccagcctgggcaacagagcaagactcaggtctcaaaaaaaaaagatatttgttgacaactaaataagtcaagttacatgatgtatagactatcatcaaaattactgaaccgtcactgcttatcaaagtaaaatgtaaccaaaaatttaatgcacagtacttcgaccagaccaaaacattcaattcatccatagtttcctaattttaatacttattttaccagagcatgaaaatcttttttgtttttttgttttgttttgttttgttttttgagatagggtctccctctgttgcccagtttggagtacagtggcacaatctcagctcactgcaacctctgcctcccacgctcaagcaatcctcccacctcagccttctgaggagctgggaccacaagcgtgtagcactgtgcctggctaatttttgtattttctgtagagatggggtttcttcatattgcccagctggtctcaaactcctgagctcaagcaagccacccgccttggcctcccaaaatggcaggattacaggcatgaggcaccacaccccaccaaaaatgtatctttaacacctgttctctagattgatttaggttttactgatcttagaggtatatacaaccatcatttcaaactcaacagatctaaatttagtttaacttcacttttttttttttttttttttttctgcccaggctggagtagtggctcgatctctgctcactgcaacctccaccttctagggtcaagtgattctcatgcctcagcctcccaagtagctgggattatagacatgcaccaccacacttggctaatttttgtatttttagtagagatggggtttcgccatgttagccagactggtctcaaactcctggtctcatgtgatctgcccaccttggcctcccaaagtgctgggattacaggcaggagccactacacgctgcctagttcactttgcattctattttttcctttgtaccttttagaagaagcttttaaataatataaagattattatttttcaatctgtcagaaattgacagggaaaagaacttaaaagtttaaatacacgatacaaaaagattaaaaagttatcgcaaattggcagggtgcggtggctcacgcctgtaatcccagcactttgggaggccgaagtgggcagatcacccaaggttgggagtttgagaccagcctgaccaacttggaaaaacccagtctctactaaaaataaaaaattagctaggcatggtggtgcatggctgtaattccagctactcgggaggccgagggaggagaatcgcttgaacctgggaggcagaggttgcagtgagtcaagatcatgtgcgccattgcactccaacctgggcaacaaaagcaaaactctgtctcagaaaaaaaaaaaagttatcacaaattattgctcataacagtttagttaaaataaagaatgtatgtaaaactacagagtaatagcttgatagcaagacaaaatagtttttaaaaaaattctaggaaaaatatggctgactaaactatgatgaaagatttgagatatcaaaaatgggctgggtgcagctggcgtatgcctataatcccagcactctggcaggccaaggtgggtggatcacttgagcccaggagttcaagaccactctgggcaacatggcaaaacccagtctctacaaaaaatacaaaaattagctggacatggtggtgtgtgcctgtagtcccagctacttgggaggctgaggtaggagaatcatctgattctgggaagtccagggtgcaatgagccatgatcacaccactgtactcccgcctgagagacagagtgagaacctgtctcaaaaaaaaaaaaggcatcaaaaatggctaaaagaaaatcttaaacaaaccatgagttaacagattaaaaaggtgttcttgtttgttttttgagacacagtcttcctgggctgcccaagctggagtgcagtagtacaatcatggctcactgcagccttgaactcctaggctcaagtgatcctcctgcctcagcctcccaaataactgggactataggtgtatcacgacacacagccatttttttttcttagtagagatgaggtctcctgatgttgcccaggctgggctcgaactcctggtctcaagaggatcccgccttggccttccaaagtgctgggattacaggtgtgagccaaaaaaggtgtggggccaaaaaagggtttttttattttttggttttttttttctgttgttagaggtggaggtggtaatggtttctgttttggagggagaagaggtagtggtggtaatggtttcttcttgggaaggagtattaaggtttacagtgtttaccattttatttaacaatattctactacagaaactgaaacattttagatgttaataaaacatctaaaatcatactatgatttacttctccaaagtacaaattacatcacaagtaagcctccatgcaatgacatttttatctttatggagcatcatcaatatcagttaaataaattagtgcaaattgttcctaaggagaagtttagtttccactttaccattaaaagccaagtgcctatgatgcagatgaatgcattgtacaatatatttcaatcaagtcacagactcacttccccactatccatgaaatataacaaaggactaagaaacattaaaaaataacgtatcaaacttcccacaaaccaaaagacaggaagctactgaataatctgacacttggattacattttcattatcattaaaatgtagcaaaggggccgggcacggaggctcacgcctgtaatcctatcactttgggaggccaagacaggcagatcacttgaggtcaggagttcgaaaccagcctggccaacatgataaaaccggtctctactaaaaatacaaaaacttaaccaggcatggtggcacacgcctgtaatcccagctacttgggaggctgaggccggagactcacttgaacccgaggggcgaaggctgcagtaagccaacatcgcaccactgcactctagcctgggcgacacagcgagactctgtctcaaaaaaaaaaaaaaggtagcaaaggaaaaaaaaaaaataggtcagtgtttagaaaggatacaactatatcacgtcttttacttattttacattttgtattggtctagaagttgaaaatacgtgcccaaaacaactatacaacttgagcaatgattttaaaacaaatatgacactttatattagaagcagcaactatttattcagaaacatatactattagttacatttaaaatttatcttgttagaatacactgtttccaaatcaacagtccttacaaaatatggaacatatacttcagtattatttagctttacttttgtaatagtggccaaggtggccgggtggggtggctcacgcctgtaatcccagcactctgggaggccgaggtgggcagatcacaaggtcaggagttcgagaccagcctggccaatatggcgaaaccccgtttctactaaaaatacaaaaattaggtgggtgtggtgacgtgtgcctgtaatcccagccacctgggaggctgaggcatgagaatcgctgaatccagggaggtagaggttgcagtgagccaaaatcgtgccactgcactccagcctgggtgacagagtgagactccatctcaaaaaaagaaaaaaaaaaatagtggccaaggtggattttgtactctgaatataaactatatagtttatactatacatatgtctacttataaactaggcactactgcttcaatatattaaaaaaattattctagaagatagtttatcgtactcagggttccccccacctatagctgcagaccaataccactcggtagcctgttgggaaccaggccacacagcaggtgagcggcaggcaagccagcattaacctgagctcggcctcctctagatcagcagcggcattagattctcatagaagcacaaaccctattgtgaactgcacaagcaagggacctaggctgcatgcttcttatgagaatctaactaacctaactaatgcctgatgatctaaggtggaagagtttcacccgaaaaccatccactccgtgctccccctggggtctgtggaaaaaactctcttccacaaaactagtccctggtgccaaaaagtttggagaccactaacataaactacaaggttttgttaaaaaaaaaaaaaaaaaaaatgtagccaatgtcccttgagggttaatatcaaatatcttagaataggtaacagtctaatatgaatttaactgtgaacataatgaagttaattctacactatctaaaaaactgtttcacttaacatgcatctaattcatcaaactgggtgggtttctctctcttttttttttgagacagagtttccctctgttacccaggcttagtgttacccaggcttaagtgcagtggcgccatctcaactcactgcagtcttgacctccggagctcaacctgatccttccacctcagcctcccgattagctgggatcacacaagaatgtgccatcacacctggctaatttttgtattttttttagggtcagggtctcactatgttgtccaggctggtcttgaacgccttacctcgagtgatccacctgcctcagcctcccaaagtgctgggattagaggtgtgagccaccaagacccaccttaaaacaagttctttgaaaacatatttgctacgtaatagttatgagctttttaaaaaatttcttctaatgtaattaaattctggtaatcagattttcagaagaaatatgttaaaatgctggttaagtgggccaggtgcagtggctcacgcctgtaatcccagcattttgggaggccgaggcaggtgcatcaggaggtcaggagatcgagaccatcctggctaccacacagtgaaaccccatgtctgctaaaaatacaaaaaaaaaaaaaaaaaattagccaggtgtggtggcgggcgcctgtagtcccagcttcttgggaggctgaggcaggagaatcgcttgaacccaggaggcggagcttgcagtgagctgagatcacgccactgcactccagcctgggtgacagagcaagactccgtctcaaaaaaaataaaataaaataaaaataaataaaataaaatgctggttaagtgaccagaggttttatttcttgggtttttttttaaatcatcatggaattaaacacacatgaagaaatctgttgaaacccctcaaacttgcaatgctatacccgaatcacagtgttctttcagagacttttcaaattatacaaatatttcaaaatgctgagttactctactatagctaataaaactacttaaactaagtggaaaaccttgagaactaaagggggaggggatattatttattctcattactcttaaatcaaccaacttccaaatccagaatataaaacttttatgattatttgttctttccctgtttacaaacctagttctgatttcattattaaaaatataggccgggcacggtggctcatgccggtaatcctagcactttgggaggccaaggtagacagatcacgaggtcagcaattcaagaccagcctgaccaacatggtgaaaccccgtctctactaaaaacacaaaaaaattagctgggcatagtggctggcacctgtaatcccagctactcgggaggctgaggcagaagaatggcgtgaacccaggaggcggagcttgcactgagtcaagatcgcgccctcgcactccagcttgggcgacggaggaagaccctgtctcaaaaaaaaaaaaaaaaattagccaggtgtggaagcacacccctgtaatcccagctactcaggaggctgaggcagcagaatcgcttgaacctgggaggtggaggctgcagtgagccgagacagcgccactgcactccagcctgggcgacagagcaagactccatctcaaataaaataaaattttttttaagttttaatttatatatattatattataaatattatatataatgtataatttttatatatgagattatgtatatatgtatatgtatatgagatgtatatataatatatacatctcagccgggcccagtgactcacgcctataatcccagcattttgggaggttgaggtaggtggatcacttgaacccaggagctcgaggtcagcctgggcaacatcgagagacgccgtctctacaaaaaataaaagataaaaaaattagctggtggtgatggcacatccccacggccccagctacttgggaggctgaggtggaaggatcactggggttggaaggtcgaggctgcagtgagccaagatctcactcctgcacttcagcctggatgacagagcgagaccaagtctcaaaaaaaatatatatatggtgtgtgtatatatgtatatgtgtgtatatgtgtgcatacacacacaattctctataactagtgctgtcatacttaatgctttaataaggttaaatacataataaatacaatagttcattttgtctttaacagtacaatccaagtcaagtcatccttccaaaccagatacaaaaatatcctatgaaaagaaacaaaaactttttatccttaggatattttggggttctggccttttgttgtgccagatataataccacttgataagactttcagcttcatcccatcccatcctgcaacaatgttttcagtagggcgggatccgtggctcccaatcaagtccgacaacctgatctcatggcagggcccacacaagaaaaaaaagagcattttatttcgtgcaacttttatggcccagagaatctctgaccccccaccccctcaacacacaataatcagttgatctccctctccctccctctctcccacctccacaccatctatgagaaagaggagggggaagaaggtggaagaaaaggcacgagtagagaaagtagatccgacgtaaagcaggcacctaaaaaaaggtgggatggatttctccaaagcccagatcagggactctgctacagccagccagtggagaatgcctctaatgttaacgctttagtaaccacttacaagaacttcccctgtctactgcttaatttcaaataacccaacaggtccatttaattactttgtattatttaaagaaatctaggatttctttaaataataaaagggaaacgaacgcgttttaacatcattttgcatcacaatgttaaaatcttgggttaactccctcagtaaatctctaaatcctttccaatctactatctctggccaggaagtcaaaactgaaatattaaccaactaaaatgatcttcattctttggtcaattttgcagagcaaaaaatttaaataaataaataaatagatcttcaatgtgtatcaaggatgtcctacttgggcctcactctcccaaacagagcctattttcttccatttaacaaaggaaaattctcatttaaacaagtctaatgaagatgttgcaacctggccaagagcggtggctcatgcctgtaatcccagcagtttaggaggccaaggcaggctgatcacttgaggcaagagtttgagaccagtctggccaacatggtgaaacccgatctctactaaaaatccaaaaattagccgggcatcgtggcaggaacctgtaatcccagctactcaggaggctgaggcaggagaatggcttgaacccgggaggcggaggttgcagtgagctgagatcctgccactgcactccagcctgggcgacagagcaagactccctctcaaaaaaaaatttttttaatgttgcaaccaatttttcttcctcatatttatagatgtttatcatgttttttcttaaaagttttttaaaccaccttttccaaacctcaaaacaagcatctataattatagacaattattctcctggctccgtaaacaattctatttttccttctccaactttctaatcctctcatgaagctggccaaatgtattctactcctgacaccaaacaacagaaaaagaaacaacgtaactgcagtctacttcttttgttttaataaacaaataaactagcttaaatgcacagtggtcttggatcacataagaatttcaaaataaatgatttaaacactttaaatattgtggtgggggggatggtgctggtaaataagggtcaagttctgactttcttattgaggccaaggtcaagaaattacttttttcagatctataaaatcttaccaactcagaatcctgattatagattatcatctcctactcaatactttccaaatctacaatgatataggaatcccactaaaattcagaataattaaaaggagttaagatttaagacataaccaaaaaccagcccctctacaaggcagttgactgtacagttcatgcttgtatacagatggacagactaagaacaaactctacacttctgagaaaaaaaacaaaactaaactaacaatgtaaatctattcattcattataacaatttcttttttcggagacagggtctcactttgtccaggctggagtgcagtggtgcgattttacctcactgcagcctcgacctcctgggttcacgtcatcttcccacctcagcctcccgagtagctgggactactaacgcgggccaccatagctggataatttacgtattttttgtagagacagggttttgttatgctgcccagactagttgagctcctgagctgaagcaatccgcctgcctcagcctcctaaagtgctaagattacaggtgtaagccactgcgcccagccacaaaatttttaaatatcattccaaagaaccatctataatgaaatgtgaaattatgttaaatacatatgtttagaagatacaatgcaactttctagtttttatttccactgtaactaacttcaactatgaataaaattctacataagtttccatctcaggatttttgttctctttaaaattacaaaaactggccgggcatggtggctcacgcctgtaatcccagcactttgggaggccgaggcaggtggatcacctgaggtcaggagttcgagaccagcctagccaacatagcaaaaccccatctatactaaaaatacaaaaattagccaggtgtggtggcgggcgcctgtaatcccagctacttgggaggctgaggcaggaaaatcgcttgaacccaggaggcggaggttgcagtgagccgagatcgcaccactgcactccagtccgggtgacaagagcaaaactccgtctcaaaaaaaaaaaaaaatttacaaaagtcatttagaaaatgtatgaggccagacgcgatggctcatgcctgtaatcccaactctctgggaggccaaggcgggcggaccactaggtcagaaattcgagaccagcctgaccaacatggtgaaaccctgtctctactaaaaatacaaaatttagctgggcgtggtgtcgcacgcctgtgatcccagctactcaggagactgaggcaggagaattgcttgaacccaggaggcagaggttgcagtgagctaatactgtgccactgcactccagcctgggcgacatagtgagactctgtttcaaaaaaaaaaaaaaatgcatatgaaacacaaaaagctgggtgtggtggctggctcacacctgtaatcccagcattttgggaggccaagggggtgcggatcacctgaggtcaggagttcgagaccagcctgaccaacatggagaaaccccatctctactaaaaatacaaattagccgggcatggtggcgcatgcatgtaatcccagctactcaggaggctgaggcaggagtatcgtttgaacctgggaggcgaaggttgccatgagccgagattgtgccatcacactccagcctgggcaacaagcacgaaactctgtctcaaaaaaagaaagaaacacacagagttgccaatgtgaaaactactcaataagatttaataaaaatactgtatttggaaaaaatctttttttttttttagctgggattacaggcgcccggcatcatgcctggctcatttttgtatttttagtagggaagaggtttcaccatgttggtcaggccgatctcaaattctagacctcaggtgatccacccacctcagcatcccaaagtgctgggattacaggcgtgagccactgcacctggccttaactatttttcattaaggtaatgaaataagttaacttctcaatactttctttctttttttttttctttttgagacagggtcttgctctgctaccaggctagagtgcagtggcatgatcacagctcactacagcctcaatctccaaggctcaagcgatcctccctcctcagtctcccaaacagctgaggcaacaggtgcataccacatgcagctaattttttatttttttgtagagacaggatctcaccattttgcccagactgattttgaaatcctgagctcaagctatcagcctgcctcagcctcaagtgctgggattacaggtgatggcatccggccttcaatattttctggatgaaagagaggacttattactagtcctagattattatgaaaaacagcaatatcatgattaaaattttgttcctcctcccagtactgtgttctattaattagataggaaataggaatgaacaaaaatagacattaaatcaaatgattttactttctaaaagtcaaaaattctaatgctttgtttacctatctacaaatatttatcttactacttctataaataattgaataaaatcttaaatgaactaaaagaaataatgggacttttcactacacaaaagataattacctatacaatgaaatgaggtgaaattcttagagcaaatatgtcatacaacaagcttaaattaatgatacgaaacagttagaatgcccccaccccaataaaccatggacaaaacacgactgggcaattcgcaagaaatacaagtaataaaattcaaaaaaaggctgacgcggtggctcatgcctgtaatcccaacgctttgggaggccgaggcgggtggatcatgagatcaggtgctcgagaccagcctggccaacatagtgaaaacccatttctactaaaaatacaaaaaaatagctgggcgtggtggtggatgcctgtaatcccagctacttgggaggctgaggcaggagaactgcttgaacctgggacgcgaaggttgcagtaagccaagatcgtgccacggcactccagcctgggcaacagtgtaagactcaggtctcaaagaaaaaagaaaaagaaattcaaaatattcattagtcctactaatcaagtaagtaaaagcttagaactactttttttctgttgttaagataaagattttaatatatcatacatgacaaaggtttgataaaactagacctatcacacattgctaatgacattacaaattgatgcaacctttttagggagtggcatttcaaaactttaataaaaataagagatcagggctgggcatggtggcttatgcctgtaatccaagcattctgggaggccaaggcaggggagatcacttgaggtcaggagttcaagaccagcctggccaacatggcgaaaccctgtatttttagtattctactaaaaatacaaaaattagtcaggcgtaggccaggcgcgatggctcacacctgtaatcccagcactttgggaggccgaggcgggcagatcacgaggttaggagatcgagaccatcctagctaacacggtgaaaccccatctctattaaaactacaaaaaattagccgggcatggtggcaggcacctgtagtcccagctactcgggagggaggctgaggcaggagaatggcgtgaacccaggaggcggagtttgcagtgagccgagatcacgccattacactccagcctgggcgacagagcaagactcatctcaaaaaaaaacaaacaacaacaacaaaaaattagccaggcatggtagcgcgcctgtaatcccagctacttgggaggctaagacaggagaaccgcttgatctcaggaggcggaggttgcagtaagcggagatcatgccactgcactccagcctgggtgacagaacaagactctgtatcaaaaaaaaaaaaaaaattcaatgtaatttaaaaaaataagagatcaagccgggcacggtggctcacacctgtaatcccaggactttgggaggctaaagcaggcaggtcacttgagacaggagttcaagactagcctggccaacatggtaaaccttgtctctactaaaatcaaaaaattagccaggcatggtggcacacgcctgtaatcccagctattcagggcgctgacacatgagaatcccttgaacctgggaggcagaggttgtggagagccgagatggcaccactgcactctagcctgggtgacacagtgagacatcatctcaaaaaaaaaaaaaaaaaaaagagtttatatttatctcaaaaaaagagtttatatttattgcttgctaaggcatcaaatataagaaggaaaaaattttaaaaagttcgtatttactaagaacttactaagtaataggcacagctcactgcaaccacttcctcccaggttcaagcgactctcctgccacagcctcccaagtagctgggattacaggtgcccaccaccatgtctggctaatttttgtatttttactagagatgggtttcaccatgttggtcaggctggtctcgaactcctgacctcaggtgatccatccacctcggcctcccaaagtgctagaattacaggcatgagccactgcacctggcctctagcggctttcttaacacatataccctctttaaatcttttaataatcctgtgacaaagatgttattatcatccctattttataggtaacaaacagatacagattgaacagcttatacaaagtccaacaactagaaagtgataagaccagaatttgacaataagcaaatagacattagagcctatatgcttctgaatatctatgaagaatcaaaaaatgcttttttgttgttgttgttgttgagacggagtcttgctctgtcgcccaggctggagtgtagtggcatgatctcggctcactgcaagctccgcctcctgggttcacgccatcctcctgcttcaacctcctgagtagctgggactagaggcgcctgccaccacacccagctaattttttgtatcttttagtagagacggggtttcaccacgttagccaggatggtctcaatctcttcacctcgtcatccacccacctcggcctcccaaagtgctgggattacaggcatgagccaccgcgcccaccctctttcttttaaaaaaaaaaaaaaaaaaaaagatggagtctcactctgtcacctaggctggagtgaagtggcacaatctcggctcactgcaacctttgcctcgatactccttccttagcttcccaagtagctgggactacaggtgtgcgccaccacgcccagctaatttttgtatcttagtagagatggggattcaccatgttggccaggctggtgtcaaactcctgacctcagatgatccacccacctcagcctcccaaagtgctgggattacaggcgtgagccaccatgcccggccaaatgcttattttttaacctaattatcctgcctatggtaatctgtcctataaaaataaccaaaatatgaaaaaggctttatctacaaaaaggtcagccagagcattacacatagtaacaaaaggcagtagggtgagaagaggaaaaggggagacagctgtatggttacataaattatagtgtggttactcagttttttgttgttgttttgagacagagtctcgctctgtcgcccaggctggagtgcaatggtgtggtcttggctcactgcaacctccacctcccggattccagcgattctcctgcctcagcctcctgagcagctgaagactacaggcgcatgccaccacacctggctaatttttgtatttttagtacagagggggtttcactatgttggccaggctggtctcgaactcctgaccttgtgatatgcctgcctcagcctcccaaagggctgggattacagtcgtgagcgacagcactcagccctcagttttactcaatggaaaattaagcacccttcaaaaatgttataaaagattaacaatacggaaattttcttttacatgttacaagggaaagtaggttacaaaactctaaatgtacataagtagtatcacaaaaaaaaaaaaactgtgtatatgaaaaaagtttgaaagagaataggtcaggctgggtgtggtagctgatgtctataatttcggcactttgaaaggccaaggtgggaggatcacttgagcctaggagtttgagaccagcctgggtgacatagtgagacgactgtccctacataaaaagatttgtttttcatttaaaagaaaaaaaatagactgggcatggtggctcatgtctgtaatcccagcattttgggaggccaaggcaggtggatcacaaggtcaggagtttgagaccagcctggccaacatggtggaagcccatctctactaaaaatacaaaaaattagccgggcatggtggcagacgcctgtaatcccagctactcaggaggctgaggcaggagaatcacttgaactcgggaggcggagattgcagtgagccgagatcatgccactgggctccagcctgggcaacagagcgagactctgtctccaaaaaaaaaagtgggggaaagaaaacatttacatttataacaacatcaaaaacaatgaaatacttaggaatcaatttaacaaaaaaagtacaagacctgtgcattgaaaattataaaatactacaaacaaattaaaggagatcagaaattatacttcatttgatacttaatcacatgcaaaaaatcattagttccagttttacagttgttgccggttatttttctaacacagatacaatgtcatacctctgtttaacatcttcaatggctccctattgtttacagttaatattcaaaatgcccaatttactttcccttcctcatttcctcccatattggactgtagtctcttaaaaagcaaaggtcagggtcagacacacctggattcaaatcctgactcaatcacttacaagctatataaaaattcatctttcatttgtaaaacgtactaatgattcaaccccatgtgatcagtaattatcaaaaaggtaacttctggtaagcactagtagtgcctaacacataatagccaggtactagtttctcactcccctttttctcttcggtaaagtctgttttcatttttaaacactcaacaaagatgtcttctttcttcagttcctctgagataagttcttccttctctaagcttcctcagcactttctgaaatctattgtaaaatgtgtcatttgcattatactttgcactgagttaccagaaattgaaggtagggatcttgccttattttggtctctccactgtataatacacagcagattctcagtatttgattttgcctaacatcctccttgggtgattaacagagaacaaataggaaaagcaaatctgactaagaataaaccatgcttcagaaatgtactttgaaaggaagagattttaagtcacctataatctaacacccacaccgatctgtgatgaacacatagcatgagcaagaaatgaacctttgtgactgatgccactaagaattgggatcctttgtcaccgtaacatattctgtatattctgatatacacattaaaggagtttagtatttatctgcatcatccctatctccagtgtttggaatgttctgcacaaagcgggaacttctgcacagcaaaagagattatcaacagagtaaacagacaacctacagaacgggagaaaatatctgcaaactatgcattcaacaaaggcctggcctggctcagtggctcacacctgtaatcccagaactttgggaggccgaggtgggtggatcacaaggtcaggagatcgagaccattctggccaacatggtgaaaccccatctctactaaaaatacaaaaattagctgggtgcggtggtgcacgcctgtagtcccagctactcgggaagctgaggcaggagaattgcttgaacccgggaggcacaggttgcagtgagctgagatcgcaccactgcactccagactgtaacagaaagagactccatctcaaaaaaaaaaaggcctaatatacagaatctgtaaggaacttaaatcaacaagcaaaaaactagcattaggagatatacttaatgtaaatgacaagttaatgggtgcagcacaccaacatggcaccttgtatacatatgtaacaaacctgcaagttgtgcacatgtaccctagaatttaaagtataataaaaaaatagtttataataaaaaaaaaacaagcaaaaaacaaccccatttaaaaatgggcaaagggcatgaacagacacttctcaaaagaagacatatgtggccaacaagcatatgaaaaaatgctcaacatcacttatcattagagaaatgcaaatcaaaaccacaatgagataccatctcacacaagtcagaatggctatgattaaaaagtcacacacaaaaaaaacatgttggcaaggttgtagagaaaagggaaggcttatacactgctagtgggaatgttaattagttcagccactgtcaaaagcactttggggatttctcaaagaactgagaactaccattcaatccaggtatcccattactggatatatacccaaattaatagaaatcgttctaccataaagacacacatacacatatgttcatcacaggactttgcacaacagcaaagacatggaatcaacctaactgcccatcaacagcggactggataaagaaaacatggtacatatacgagacagaatactgtgcagccataaaaaaagaatgaaatgatcctttgcaacagcatggatgcagttggaggccattattcgtaagcgaattaattaacagaaagccaaatactgtgtgttctaacttccaagtgggagctaaacactaagtacatgtggacacagaggggaccaagagacaccaaggcttactcgagggtggaggctgggaggaagttgaggatccaaaaactacctactgggtactatgctcactatctgagtgacaaaatgatttgtgctctaagcctcagcgacacgcaatgtgcccatgttaacaaatctgtgcatgtaacccctgaacctaaaataaaagctggaaggaaaaaaaacaagtgggaactcaggtttattagaaaactttaaaatatggaatgaatgtaggacatttttaaagagaatagtcaaaggttagcagaataaccaaatgttttcaatgaaaagattacaaaagttgaagtaaccacatttttaaaaagcacagcgttagcatataaatgggagcatgcttttactctcctcttcacccaaaatacatacttctactacttcctcaccatgctgaggtcaaaaactggaggcttagggctgggcgcagtggctcacacctgtaatcccagcactttgggaggacaaggcaagtggatcacctgaggtcagtatttcgagaccagcctggccaacacggcaaaacccagtctctactaaaaaaaaaaaaaaaaaaaaattagccaggcgtggtggcagatgcctgtaatcacagctactagggaggctgaggcacgagaatcgcttgaacccaggaggcggaggttgcagtgagccaagatcgcatcactgcactccagccacgcgacagagcaagactctgtctcaaaaagaaaaaaaaagaaaaccctgggggctcaggattcaacaaagcattgttgaaagcagtcactaccaatcaaccgggcctcaacatgaaattatctgccatcgcaagaacttcagtatcataattctcacacatgagaaaattaggcctatggtgataaaccaattgctcaaagtggtaaagactatttactagctatttctgtaatatttattcccaccatcagtaaccagactttgaacctattctaagtagcaaggtactcatctaaaaaaactacattcccaaccaggcgcagtggctcacgcctgtaatctcagcactttggaaggccaaggcaggcagatcacgaggtcaggagatcaagatcaacctggctaacacggtgaaaccccgtctctaataaaaatacaaaaaattagccaggcatggtggcctgtagtcccagctactcaggaggtggaggcaggagaatggcatgaacccgggaggcggagcttacagtgagccaagatcacaccaatgcactccagcctgggcaacagagcgagactctcatctcaaaaaaaaaaaaagaaaaaaagaaaaaaaaactacattcccagccgggtgcggtggctcacgcctgtaattccaaaactttgggaggccaaagcaggtggatcaccagaggtcaggagttcgtaccaacctgaccaacatggtgaaaccctgtctctactaaaaatacaaaaattagccaggcttggtggtgcatgcctgtaatcccagctacttgggaggctaaggcaggagaatcgcttgaactcgggaggcggaggttgcagtgagccaaaatcatgtcattgcactccagcctgcatgacagagcgagactctgtctcagaaaacaaacaaactacattcccagcctcccttgcagctacaggtagccatgtgaactctgtgatagttctagccaattatatgtaagagaaaacatacaatatttcttcaaaggaggaggctgtgtgcccttggactcctttctgtattttgcttcatgggacatgcatgtaatgtaattgggactttagtagccatcaaggaatcttagggcaaaggccacaacctagaaatgtctgagaagttagataaagggagacactcctgatgactttgcagtgtagagggacaataccagcctcagtacctaccctccagattttgaagtgaaacagaaataaacactcctgttcaagtcattattattacggggttttcaatcacataaagacaaacctagtccttactgatatacccggctgttaagaattggcccagaaatagaaatcagttcttctgtcaagagtccaggatgctcaaatatataaagatctctgtacaagtcaacaaaaataaataaataaataaactatatcctttttagggttgatattcataattgttttatctttctattctgtatgacctaactatagcccaatctacactgtgacaattccatttttaaatactatttaaagtcctcaataataaaaatctgtatttcaaaatactttagaaaaataaagggtaaggttaaggagaaacttcatttaactatttcagtaaaagaggatggaaaataatgatttttatcactcgtatcccaaatgcattttttttttctgagaccgggtattgttctgtcacccaggctgggtggggtgcagttgcaggatcatagctcactgcagcctccaactcctctgctcaagtgatcctcccacctcaacctcctaagtagctgggactaaaggcatgtactaccacacccagctccaaatactctttgttcttagcgtcccttaattcagaaaactatctgcttccagcaaaacagattaaaacaaccagcattttacttatttatgatttcgtaacctggactgagcttagctaggtggttcctctgttaatcttttttttgtgtgtgagagagagaaacaaggtttcactctgtcgcccaggcttgagtgcaatggcaagataatggttcactgcagcctcaccctcctgggcttgaccaatcctcccacctcagcctcctaagtagctaggactacagagacatgccaccacactcagctaatttctgtatttttttgtagagacagtgtcttgctatattgcccgggctggtcttgaactcctgggctcaagtgttccacatgccttggcctcccagagtgctgggactgcacagtcataagcccccacgccggccccttcgctaatcttactaatcacttttgtgtctgtattcaacaggcaagtcaactaagggctgaaggcagctaggacactgagatagttaagcctccctctttccatatagtcctggaatctcttcctctccacatcatctctccagcaaggtatgacagcttcttgcacggcagcaactcagagctcccaagagtacaaaagtagaagctgcctgacatgctcaaggcttgtacccaaaaatagcaaagtgtcatttttgctatgttctactggttaaagtgagtcacagggctaggcgagatacaaagagagatgactatacaatagcatgaatacccataggcatgatttactatgggtctacaccaatacagtagactaccatctcctttatttactgtaaaagtaacaccttaatatatgacttctagtattccataatctctctggggctcagttatctataaaatgaggggttagactcaatcttcttgaattctcatctattaatagttctaatattctacaactctataagtatgaaagtctaatataagaaacacttagggccaggcacagtggctcacaccagtaatccctgcactttggaaggccaaggtgggtggatcacctgaggtcagaagttcgagaccagcctggccaacatggtgaaaccccatctccattaaaaatagaaaaattagccaggcgtggtggaggggcgcctgtactctcagctactccggggtctgaggaaggagaatcgctggaaccagggaggcataggttgcagtaagccgagatcgtgccactgcactccagccagggtgacaagagcgaaactccgtctcaaaaacaaacaaacacttggccatactgaccaaacacttcaactatggtagaacaattcaatgagaactttaagaatatggttatgtttcattttgtcattttatattcaactatgtgcttattccaaatgtggtccatatgactagaatcccaaagatcaggaaatcaaggaaattctttttttgctaggctccactaaaagaacaccaccacacagacttcactgagaccatcaagtatgctgcttctaatgtaaatcgattacaataaggtgtaaagatttaaagtgaccaaggataaaagatgtaagaaatcattttaaaaccacctaaaacaagtctcactgagggaggcctactaataaaaccctagccagtagagttataatatgtaaaaatctactctaacaacatttaaaagtttgagcaataaaaaactttggaataatattactacatatacaactcctagggaattgctttgactgtttttcgtgtattgctcataatgaaaaacatttcatagagatttctgctgacctagctttttaaaaatctttcttctatatattggggacatctgcgtacaaagaaaatctttgccaccccactatccccgcctccaataacaactgcattattttatgtcatagtttttttttttttttttttttttgggagatagggtctcgctctgtcacccaggctggagtgcagtggcatgatcacagctcactgtagcctccaactcctgggctcaagcaatcctcccatctcagcctcccaagtaactggagctacaagtgcataccaccgcatccagctatttttaattttttgtagagatggggatctcactatgttgcccaggctggtctctaacgcctagacttaagcaatcctcccacctttgcttcccaaagcactgggattacaggtgtgagccaacatacccagccttatatcatggcatttttggagtgagtttggtttctaatcacttctgtctctaaatagtttataacaggcaactgattgataattgatgattagtggcaatgacagtaacaacagtagttaaatccttacaacagcacctcttaataggacttagtctatgccagaaactgttctaaattctacacatatatataaattcataacaatcctaaattaggtgtattattacgtcctctctacaggtgaggcaaccatagcacaaaaaatttaagtaacttgcccaaggtcaaacagctaatatgtagtacaacctagacttgaatccagaaggtctaggctctataatcagtgatgcccccagaatttggttttctcatttgtcaaatgatttaccatttctgaagtattaagcttttttctttttttaaatgcataaatgtatactgaaagaatatactccccagagtttttttttgttttgttttgttttgtttttgagacagagtctcactctgtcgcccaggctggagtgcaatggcacgatttcagctcactgcaaactctgccacccaggttcaagcaattctcctgcctcagcctcccgagtagctgggattacaggcgcctgccaccatgactggctaatttttgtagttttagtagagacggggtttcaccatcttggccaggctggtcttgaactcctgacctcgtgactcaccctcctggcctcccaaagtgctgggattacaggcgttagccactgcgcccggcccccagagtattaatatttattatgtattcttcccaatctttttatatgcacaaaatatacacacagtttgggtttatgtgcttttcacaaaataaagttactgctaaacttactgctttacaacttttggaaaggtttttctctagttcaacaatgtatcatagacattctcccacttcagggcccacagatctatctctatgtcttgatttaaaactgcatggtagtccattgatgcatattttgttgttgccaacttttctctactactaatactgctgccatgagcatcttgtatgtatatgttgtccatttgtcatgagaatatattctgatttcctttcttgtttttccgggtataactggtcccctatctcctaagggcaacaaagcatcctaatcctttactaattcccatacgccatattctcagtgattacatgttaagtcacatctttaaatacttatcctaatcgattcctcaactccagtcctacttccccgaatgcttagcaggcatccaatctatttggatgcctgctacaacatctatgccagaaactgccgaattcctcctttgcagtgactggaatcttcctccccattcgcactaccaacattctatgctttggcttgatctctcacactacaactattgtaacagcctattatctctgcctccaggtaactcctgtctccatattattaccacagtgtttttttaataataggcatcattaaatcaccaagtatttgagtgcctacattcaaatgcataaatgctaaacagaatacaaagtaatttagtaaggttcctatcctcaagaatactgtaaatacctgctttgaaaactttcatttaaaaaataaaataactgggcataaagcagagattgagacctgtagtcccctggtggtccgcagattaaacctagcctacaaagtataggcgcaaataccgttttagattctaattaatgaaaaacacttaaaatccaagtttaaaaatcataaaaagggctgggtgcggtggctcatgcctgtaatcccatcattttgggaggctgaggcaggtggatcacctgaggtcaggagttcgagaccagcctggccaacatggtgaaaccccgtctctactaaaaatacaaaaaaaaaaaaaaaaaaaaaaactagccgggcatggtggtgggtgcctgtaatcctggctactcaggaggctaaggaaggagaatcacttgtacccgggaggcagaggttgcagtgagccgagatcacaccattgcactctagcctgggcaacaagagtaaaactccatctcaaaaaagaaaaaaaaaaatcataaaaatccaaatttccgccctcttgaaaaatctagaaacagcatctcaaatagcaaccatcagccagaattctgtatcagtttcaccttaagcagggcataaggactcctagacttccccaaggctgttattatttcccattttctccccaacccaaggtctaaagtgtcagttgtcattcagattcttagaagcagcctactgttcatttaaattgcttacctgctccctgtaaacagtttataactcctggactacaggataaagcccaaactcatgagtctggcattcaagaactatcacagcttggcctcaccactacacacagcctctgttctagtcacacagtcagaagccaccccaccttttacacctccttccctcaataatttcattcacattgctccctcacacactcattttcttgtcattctacttggctaaatcccaccaatccttcaaggtctaattcaaatactacttcctccaaatctttgagcacccctctaggccacaataaatcttccagggttgactgttcatcccaggacatatttagcactttgtagctctttaaataacatgtaccaaatgaaagatctaaaaagttacatagaagtatagaaaacttaagacttgttaaacaattttacacttgtagatcatatgtagttactgccatcacaaaattaacagcagaaacaaagtgaaacaattttccttttacctgaggctttttctagaatattacaaagtgcaaaaagagctgtgtcatttgtttctctcaacttgtgctcttaagtccttcaaattctgcaaataaagggatcaacacttccaattataaatccaagattggtctattacttttttttttttctttttgagacagagtctcactctgtcgcccaggctggtgtgcaatagcatgatctcagctcactgcaacctctgcctcctgggttcaagcgattctcctgcctcagcctcccgagtcactgggactataggtgcctgccaccacgcccagctaatttttgtatttttggtagagacggggtttcaccatattggccaggctggtctcccactcctgaccttgtgatccgcccacctcagcctcccaaagtgctgggattacaggtgtgagccaccgtgcccagcctttctattacattttcacagataaccaccagcatatatctacaagcaatagctataataaaaaaagaaataatctcagccgggcgtggtggctcacgtctgtaatcccagcactttgggagtgccgaggcaggcagatcacctgaggtcaggagtctgagaccagcctggccaacatggtgaacacccatctctactaaaaacacaaaaattagctgggtgtggtggcatgcgcctgtaatcccagctttttgggaggctgagtcaggcgaatcgcttgaatccggagggcggcagccacagtgagccaggatcacgccactgcactccagcctaggcaagagagtgagactgtctcaaaaaaaagaaaaaaaaaaaaaaacagaaatcatctctattctacttcgtaacttttgccacttatcctgccaacaagttctcaaaataaccactgtagcacaaacatgataaagaaaatttttaaagagaaaaggaagagattaatcagctttctgaaattaaaagataaaaatggaccaaaacaatatagaaaaaaaaaagtaaaggcaaacacaaactcacacgctgactgtaaagtttattccatggcagctaaaagttgtttggcccaaacatctcacagattaaaaactaaatcacaacctaacgagggtatctaacacgtccccaccaggcaagagtgcagagagaccatctaatgttcctatttatttagagagtcttgctctgtcacctgactagagtgtagtggtgtgatgtccgttcactgcagcctcaacctccaagcctcacacaatcttctctcagctcagtctccagagtagttgggactacaggtgcctaccaccacacccagctaatttttttgtagagacaaggcctcactttgttgcccaggctggtctcaaactccttttaaatgaggattaagtgatcctcctgactcagtctcccaaaagtgctgggattacatatatcagccaccacacccatccttaatgtcctttataactggaaactgaccaattttcaccttggaaggtcaatgaagtttcacgaagcccctccatcataaacttaaagtgacttaagtttacagagttggacaaccactatctacccagagaaacctgactgtggtctgggaaactttgcagttttgcggaacagaggaatgagatgaagcagtgtggcttgtcacttggcagattaacaacaattctggcattatggaattaactgaaatagtacgaaaatgtaataaatcacaagtgtcagaatgggaaaacaaattgttgtgatacttttatatttccatggaaatccatgtttatcaagtttacatattagtaaccaatatgtaaattggtaagtttacatattagtaactaatatgtaaatttatatattagtaaacaatatataaatttgtataatagactaaaaataacatcttctcaaatattagaaattccctgggccaggtgcggtgtttcatgtctgtaatcccagcactttgggaggcccaggcaggcagatcatgaggtcaagagattgagaccatcctggctaacagggtgaaaccccgtctctactaaaaatacaaaaattagtcaggcatggtagtacgtgcctgcagtcccagctactccagctacttgggaggctgagacaggagaatcacttgaacctgggaggcggaagttgcagcgagccaagatcgcaccactgcactccagcctgggcggcagagcaagactctgtcaaaaaaaaaaaaaaagaaaaaaaacaggttcttattcatgggaatttcaggtcaggttaaacaacaacctcctaacaggtaagagagggtagcaatcctgagtcaacttttcaactgaattaaaacatttcagtgcctattgagtcccagagaccaataatatcaaaaattttatcagatctcttggacaataaattattaagaattgctgtcataaaaattacaaatttgcattatctcaaaaagcatgaataatagtgctgtctctcaactataaacttgttttattaaatggtatatattgtaatgcagtacagttttctatcacttatttcaaattcacagctatgaaaaggagaaattttgttgggggaagggcgttacaaatacagagtagcaacctagccatttttgctggtccttgtaatgacaatcactggttgtgcctaatttttctacaacaataatgcttaaggtggctctctaataatagcaattgccctctgaaaagaaagtggttcagggtataaagagtttactcaaaaaaggccaaggatagtgcttcagaaatcctatacctaccacctgctgcttctgtacaaccacccccatcccccacacccacacccatttctaacatcaactttcatgaactggtaagaaacatagtagagtagaatgtttctttggcttcccaacttggtaatgtgaatttacagtgtaaggatggaaaaaataagaaaaaagcttcagaaaaattttttaacattaacacaaaaataatgagatctttaatatgtgcatattctgacagaggcctgccaatggttaagacctgtgcctctgataaagatgatgaactactccaaattatcaaataatttgatactttttacagttaaggaaaactttcaaatgaatgtaaatttcactgtgccacttgacatttgtacaataggaaacctctatgtatttacttttccaactctaagattaatagcttcagttcaagtttcttgattttaggtagtaaaattttaagatatttatagttaatgtaaaagcagtaactatatagctatgctttttattcatgacaaaatacacaaaaacaatctagctaacactataagacaagaaaatgctttatttacctaattattaaaaatttaaacttgaggaaagtgtaattggtggtgcatgtttttttaagccaaagataaatacataaatccacttcattgtcaaaaggcatcttctcagcggggtgcggtggctcacgcctgtaatcctggcactttgggaggctgaggagagtggattacctgaggtcgggggttcaagaccagcctggccaacatggtgaaaccctgtgtctactaaaaatacaaaaaattagctaggtgcgatggcgcacacctgtaatcccagctactctggaggctgaggaaggagaatcgcttgaatacacgaggcagaggttgcggtgagccgagatcataccactgcactacagcctgggctacagagcaagacttcgtccagaaaaaaaaaaaaaaggcatcttctctacttaatgtaactcactaagttaatgaacatctaagtaacattagcaacttaaaatatctctatgagatttagcaaagaagattaattttcatttctcaggtgaattatttgcaatttcacataatttcactggttacaaacctaatttacactggttacacataagtttcactttcagggtctttactgtccaactacagggtcttttctgcatggattcttatacagtatagagatacacaattcaaaaacctctttgctttccaattcatatgttagtttccatttacatgttgctaaaaacaactggagattccattcccttcaaaagacacaatttcaaaaaaaacgctctaaaaagtttagacccgtcaaatttaccagtagactttaatttcctataaagaaagcagtactagttttcaaatctaaaagaaaaagctctctacagacttacatttgttctaaatatttccaaaagttttgatttttcatagttagattatactgttattcagcagaaattttttatcttctccaaaggctgcctatttcttcatgagattcagaattaaaataataaagtggcaataccctaatcgtccagtgcactcaggagctgcactaatacaaatgagctcatttcaaaagtagggtgtgtgcgagtgtgcgcgtgcgtgtgagtgtgcgcgtgtgcgcgtgcacaagcacgcccttacaggagtatggggtgtggggtgtgacaacatagatctaatctttctggagtaagaattcaaatgcaaatttaaaacaatacttgcaaattaatgttcagtaagagatgaagaaatgctttgcaaatagtgaaatgggaggcaatcaaggtaaaaccccaatatggcttgtcctgagttgctttaaaggatgcaaaaaaaagtggcttacatgtctaaaaattacttaaacctccacttccttctacaaatttcagttaatacagaataagggcattttatacttgccactgtattacaacgcaagtggcataataaataagtcctaactttgtatcacgaacaagctaatgtaataatgtacacacatcctgtacttgcttccctcacgattatcatagctaggtaacagctggcaataaaatatggaggcaagttgaaggccctgaatcattttcatagtaaaaggacagcggggcaagaaaagagcacattcaagtcaagagctcaatgggttcccacaacccagctctgctatgcctcagttcacgctactatttttactacaaatcaccaaacaacaatactattactaagtgaatgcacccgaaccaaagaaacagcctatccataaacgtgctggcttccttcacgtcccagcgcacccttccactcccgacagttcaatgagaatatcatctcacgaaatgagtaagcacacacgccattctacaacttcgagagacattcacagttcttccacggcacacgcgagagccacagaagccgagcagttcgctggcactaaaacggtgtcttaatttacaagcaaagccgtcaaataaccgttctgtaagaagacatttctggtcctctaataagctggggtccagccctactgtacgctcaaaggcaggcgaccctattcccaagccccttacagctaagacttacgagggaagcgacatttacatctgcactctctccgaataagtgctcttggtattctgccttacgaggggacgctggctacgtctccaaaacttaggcaggccgttccccgaagctgggggatcccacaggacttgtgctttcggagcccgggagtgcggtgctgggtgttgggggaggggggaggaagaagtcaaatggcttcctaatatatcatcaaaagaagaaaacacaggtttgggaccaggaaaagttccaggagcaagtcgctgacaaacaaaagctgcactcgcccggccgctttcttctcgcccccagcccgcgccccgagaccacctggcccgggcgttttgacagctccgagagtttcccgagcgccgacggctcggcggttcgcccggagtccgtccggggactacctgggcgcgctccgggcttgttttctcaatgatccagctaggccaagacgcggctacgagaaatttctccaaaagaagagtcgcggagaagacccagtgaaaaggcccgactgaaaagtaaagtgtgcggagccgggcgccggcgggagcccgggcgggcggcgcggagcgggggaggccgggcgcgggcggctaccgaggggcgcggggccggggccgggagccgccaccgcccgcgggcccgccccgcccccaccccgccggggggcgccggggcgcggaggccgcggggcgggcgcccggtgacagctccggcccggcgccgccgctggctcccggcctggctccctcgcactcaacttacttctttctggctctctggaaaggggaagcgccatctttgcgaggccggccccgaggtcttttgtctgcggctgcggggctcggggccggggctccaggctcctcggggggtggtggcggcggctgcggctgctccacgctcttgtcctcctccgacgacatcctagtcaccaggaaagacacatggatcccggtcctcctcctggggggctcccgccgccgcggccgccgccgccgccgctgctgctcgggttcctcctccccggctcagcctctcgcatttcccgcagccccgggagcagcagcaggtaccgggagaggcggcaacatggagcgagcaggacacgcactcacacacatcggcgcgggcgcgcgcacctc

SEQ ID NO: 547 - DNA, 6122 bp, Homo sapiens
gcgcgaggagcaaatgtgcgcccgcacggcgagggcagcccgggcttcgctggttctcgccgaggtctttcctcgtagcgcccacactacggggaggaaaaggaatggagtcaacttcgttcgaatccaacgccagttagtttccttattataacgtcattttttttaatccagaaaaggttcataaggatgtaagacgaaaagaacgatgacagctcgagaaataaaacggttagagacaaaataagccaataaaaacccaaccacttgattttaacgttcagtgtgttgtgatgaagaggcaaaaatcgaagtacttctaagccacctctcataatatgtaaaaatggtaaaaagaaaaatggggctagaatccgcctgaaaaatgcactttctcaagaaggacagttacaaatatgggattctggatttctcaggctaatacctaacacttggacgatgatctattctgtgctttccattcactatcgattagtttatgagagtgaaaaaattctagatttgaatggggggaaatagtaagacctatcaaccatttgtgaaggattggggtaaactatcatttaataagcatctactttgggcctagcgttaagaggcacactctcatgttgatttcttttgatcttcgcagtgtagttttagtgtaaggtaaaaaaaaataggctccttttccagcgatgtttgctttcccttctagtagctaggatgttaactttaaactgtgtcttctacttgggcaaaatacacacactttgattcccagagcctattctaaatgaaagcataattttttgaaatggctgaaatgaggaataacgtcagatagtcatttgaataccttcagggtttaatccctgctggctctttcaaatttactaaatttataaccaaaggaaatttgggattgaggaggaggctggcatggtaaatgcaaactagaaattaaaagtgcctgacgattacacatagaaatacaacatatatgtgactagtgataaacatatgatgtgatctagtgaaagtttactcagtacaaatttgaaagcaccctttcttttttcattttcttcagcacattgtactttaaataaagtgtgctttcaaaactggattattgatccaaatatttagctgtgttccgtactgaaattagaataggcacttccacggtgagtttcacatgtacaaaattatacatcaggataatttacttccatacgcttctccagcacttctgagaacttaagtgtcagtggatacaaattgcaagtcactcctgctggagagttcacaagaaacaaagggtactaagagcagaaaagtgagccgagtgaatggaagggtagaaacagaggtttgtgcagggatgcttctggatagatgatgatgcaggtaagtaaactcagcctgaaatctccattcctttggccactatgagcagggagttgggatctgttttaagagagctgatagcagtctccttggcatgaagttatcatgaacagagcaaatcaaatataacccaggatgctgaggaaggattcaaggaatacttattcaacataaataaaggttttccagaggtttttccgtctcagtcatccaaattacacagctctgagaccacagtagcaaaaatctaggaggcagggagctgaggtccttcaaaattatgaaagcaaaaaggcaggagcatctggaaacagtaccaaatacaacagaaaaatattagaatgtgtactttctaataagtatacatgttaaatatgggattttaaatttaggtagatgtgtactaacctgttaaccaatcatctgcaaaggggtgaattacaagggacttttactgtctaaaatatttgaatatttcaaagcacatgtagtaatcatctaatcatatatatatatatatatatgtagtttttaatggggagggaatgagcattgttatctttgacaaagaaaaaccaacatctcagaaaaatataggcaaggaagattctcaaagcatctagcaaacaagtgacagtgaataaaaattcatagtccaatattcattcttactaattgaaggcctataacatgtgattgtctttatttagaatgcacaggttcactactaaatgttgtctctcttgttttcccataaattcctcagggctttttaggaaccaaactttcactgttatagaaggaccactgaaagcttaaattttagatcttagaatttttgtgttcatattgttattattaaagttgcactgtaggctgggcactgtggctcatgcctgtaatcctagcactttggaaggccaaggcgggtggatcacttgagctcaggagttcgagaccagcctgggcaacatagtgagacctccgtctctacaaaaaaataccaaagaaaattaaccaggcctggctgggcgcggtggctcacacctgtaatcccagcactttgggaggccaaggcaggcggatcatgaggtcaggagatcgagaccattctggctaacaaggtgaaaccctgtctctactaaaaaagcaaaaaattagccgggcgtgctggcaggcacctgtagtcccagctactcgggaggctgaggcaggagaatggcgtgtacccgggagacggagcttgcagtgagctgagatcgcgccactgcactccagcctgggtgacggagtgagactccgtctcaaaaaaaaaaaaaagaaaaaaaaattaaccaggcctggtggcacatgcttgtagtcccagctacttgggaggccgaagtgggagacagtcttgctctgtcacctaggctagagtgcagtgatgcgatctcggctcacagcaacctccacctcaaatttgccgggcacggtggctcatgcctgtagtcccagcactttgggaggccaaggcaggcagatcacttgaggtcaggagttcgagaccagcctggccaacatggtgaatccccatctctactaaaaatacaaaaattagcctggcatggtgacgtgcgcctgtaatccccgctattctggaggctgagacaggagaattgtttgaacccaggaggcggaggttgcagtgagccgagatcgcgccattgcactctagcctgggcaacaagagcgaaactctgcctcaaaaaaaaaaaaattcatattgctatataagttatttcagtaaagtatatcatgtgcctgtttggtggaaaagttaaaggaagaaaccaggaaggaaacaagcagaacagtcatcttcaaaagtaatttgtgtttaagaatgtgaggcttaagtagatgttttgcagtacattttatatagatactaatcttgccctctaggggtctatactttaagcctggcagtagtagttaacaaggataaacacaaaaggacaagtaagcaactagaaaataaacatggaggccgggcatggtggctcacgcctgtaatctcagcactttgggaggccgcggtgggaggatcacgaggtcaggagttcgagaccagcctggccaatatggtgaaaccctgtctctgttaaaaatataaaaactagctaggcgtggtggtgcacacctgtagtcccagctactcaggaggctcaggcagcagaatcccttgaacctaggaggcggagggtgcagtgagctgagattgttccagtgcactccagcctgggcaatagaggcagacaccacccccccccaaaaaaaaagagaaagaaaagaaacatggaaaaacatacaaatagaaagattaaatatttacgtccattgtgtacaagatcatagttttaaaagaaatgcatctgtggattcagggggaagggcagcagtgggagaagtcatagcagacaaccatatctattcagaagagggtgacagaacacattctgctggcaagtatcataaactagaaattttcaggccaggcatggtggtttacatctgtaatcccagcactttgggaggccagggtaggcagatcacttgaggtcaggagttcgagaccagcctgaccaacatggtgaaacctcgcctctactaaaaatacaaaattagccaggcgtggtggcaggcacccgtaatcccagctattctggaggctgaagcaggagaattgcttgaatcagggaggcggaggttgcagtgagccaggatcgtgccactgcactccagcctgggcgacagagtgagatgctgtctcaaaaaaagaaagaaaagaaagaaagaaagaaggaagaaatggaatagacagccctattcatcaccctgcaggctgaagcctaaattccttggcttgactcactaggtcctggagagcccctgctaccctctggcgaacgtgctcatctcttccccagctttccttctcacctgaccaccagttttcagaactccttccagtgggctacaaaccaccaggctgtcccatcgcccttcccctttccacgaggccagttcctactttttcttcggctcttgctttagacctctgccctccgtgagaatggctgtgtccccctaaatgcttctgccaaccttgtgctttccccactcacagctctcattgcctgtaatgaaagtgcccagattaatgtctatattgtccctaaacccagcggagatggcagtagttatctgccttatttcccctattcaacagcagctcagtgaacagttgtagggtaactgaaatgaatatgaaaatataggttaggtgttagaaaaagagctaagaggatcctttataggagtgtttattttattttattttattttttgagacagggtctcactctgtcacccaggctggagtgcaatggcacaatctcagctcactgcaacttccaccttcagggctcaagcaatcctcccacctcagccttccaagtagctgactacaggcacacatcaccacggccggctattgttttgtatttttagtagagacaggggtcttgtcatattgcccaagctagtcttgaatgcctgaactccacctggctgaggcctcccaaagtgctgggattataggcttaagccaccgccactggccagtcgtgtttattttatttatttatttatttatttatattatttatttatttttttttttagactgagtctcgctctgttgcccaggctggagtatagtggtgcaatctcggctcactgcaatgtccacctcccaggttcaagagattctcgtgccttagcctcccgagtagctgggataacaggcacccaccatcacacctgcctaatgtgtttatttttttaaaaaaagaaactgtatctttagagaaaatgtatacatgcatactttgctacatttttgttgattgttacattttacatttgtataacaatacaggcaagtcatctttgcactcataaccacatcttttatggaacatcaagcctactctgaggtacaggctttcagaagcctgaatttggaggaccatgcctgaaccaaatggagtctccagaatcaaaactgctcaaaataatcattcatggttctcagaccaaataagatctacttagaaacatttctcgacagcacgctgccatgccgacgcagaccccactctgcacgccagcccccctgcacccaccatggccacagttcagcagctagaaggaagatggcgcctggtggacaacaaaggctttgatgaatacatgaaggagctaggagtgggaatagctttgtgaaaaatgggcgcaatggccaagccagattgtatcatcacttgtgatagcaaaaacctcaccataaaaactgagagcactttgaaaacaacacagttttctggtaccctgggagagaagtttgaagaaaacacagctgatggcagaagaactcagactgtttgcaactttacagatggtgcattggttcagcatcaggagtgggatgggaaggaaagcacaataacaagaaaactgaaagatgggaaattagtggtggagcgtgtcatgaaccatgtcgcctgtactcggatctatgaaaaagcacaataaagattccatcatcactttggacaggagttaaccaagagaatgaccaagctcagttcaatgaacaa

SEQ ID NO: 548 - DNA, 1423 bp, Homo sapiens
tcgggcacccccgcccgccaggcacggccgcggctccttcctcttcctgcccgcggtagtgggggtggggcaggcctcgggacacctgcctccgccgccggccgccggccgccgtcctcgcgcggcttcccgggcggctctgccccgaccgtagactcccggcccgctcgccgcggcaggagccgtggttccgcggacctgggcgcgctctctccctggccactgggagaccccccgcggcctcgcggggaaaacctcgggactgccccgcgcccccggccgtctctgcgtcgctccttctcgcccgcgaccgtggactcgtcctcgcgagcctgggttggcggaagctgcgggggccggggtcgcactacttggcgcggaagggccggcggtgggcggagggatccccgtccgcggggtgagccgctgggcggagccgggaggagccgcgaggatccgcagtggggagccgggaggaacctggcgccggcacccacccgccgcgcccacgcgtgccgcggtcgcttgtttcccgcgggagcccggccgcgctcggggggaggcgcgcgcgcagctggggctgcctgggtctaggagctccggagccaccgttttgtgcccgtggagccgcggggaaggcgcacgcgctcgggtcttcccggcgggtcgtcctgcactttctccctctccggtacggaccgcggcgttctgtttccaggcaaaggaaaataagtcaaagactcagaaggcagcctgaatccagggcctgggatgcagggtttgctggaacgccagccggtgcgatcgcgcccctgggattccgcttagcccgcgcgtccatttccctgcatggtggactcagtaaagccggatctgtccaacgcctgcagcgtggatgtggaggcggactaatcaactagtgctctgttattatttctacccatcccttttctccatgctaatttgcttagaactttaacattgaatggacagcaaatgtcatgttctgtttaattatcactccttgaccattatgttaatttctttccctaacaaggtgacgcattgttttaagtaacaatgaccaactcatctactcttcttccaaattgtgtaaattgaagggtaaaatgtgggaaaacgctaaatttgaatgctaaatttgaacatttcacacaacaataatttgaaatgcttctttgcaatattatggcgtttcggaacagataaaaatacttcattttcagacatttggtcaacaaatacttcttggacgtttatatgcaaagcaatgcatgtaacattttcattactttgcaagtgtgcttatcagtaaaagaattttgttttaaattctagccttcgtttaaatgtattttagttaccacattgggaagaaaataaaatattactatgtacggaa

SEQ ID NO: 549 - DNA, 10642 bp, Homo sapiens
tcattttggagtatttactatccctgaaaattaatataatgggggtgctaatgctaatttttaaaaccaaggttagctcaatgaattctccttttatataaactagtaccattcactcattaggatacctacataactgcaaaataattcaaagtacacagagacaccctttaaagattcatcatatacttagacgatatgattcataccactttcctgtggaaacactcaaattattcacaataaatagaatgcaatcttacaaagttgatggcagcaccaagtgaagatgggtgcttccttcaaaatacttgatttagattctgccatcttattcacatagaacctaagaaactctttccgtaattaagcagtaattcacaatatatacatctctgaggcacttgttgtttcaatagatggtttgttcctctccgtaattacaaagacaatgagccccaaataaaaagtatcctacatttttagtgactcaagatacacacaactcaatataaaattcatattcactagagctacaaatcataatcactatcagaaaattctataataaaatttacattcacttctcctcctactaatcttacatttatcagcatactaactaagcagagtgtggtaattccacatatttggagctcctctaagccagtttctggagatactctaagatatggttggattttctgagaatgaaatgttttatactttatgaggaacccaaccagacaaagaagtttactatgagtctcttcccttattccaaggactttgatttctgatgtttgcctccatattgtgtaactgtagcaccatggaaaacacaatacatgtattattgtagtaacattacagagttttatcaagaatctctggaaaatagataattttgttgtttgtatactgtcagaataattttaataatgtacgattcagtaattttaaacagggaatctggctgaattaaatgcaggtaaaacatagttactcatatcccatagataagccaaataagatatcccataaatgtcttaaaacttataaactataatggttaggttcaacaattgtttataagggactgcagtggaccctttaaattgaacttcagtgatttgtccatatgtacaagagcatcaaaatccagggtctcatttcatgacagcgtgtctagaaactcatcttactaagaatacagaagactctgaaaaggttgtcttgtgatgcttgaaacatattcatagttgatttatgccagaaaaggggacactgaaagtattgtcatcagcagttacgggcttcctcttccagttaagctgtggtacatctctccgacacacactgtacttgacaacacttgtggtacatcagtcttgtttgacaattttgttcatctcccttttttctttatattaagatgatcatccatcttacagaagcacccatagattaatattgttatgaaaacattccttatgtttagctgactccttgtagacaagcagtcattttcatgtttccattgacttatttccaaattacattgcaaaggagattatttttttccaacacgggaaattaacttgatattaatagtatggaggctcttgtgtgctttcataagataaggcctttatttatctgcctcctgaaagtgacctggggcacttcagcctagtcttgaagtacatattcttttgggcctctgcaatcgcatgttcatattttgaatctagtaacagaagacaaaataggaatttatttttatttttatttatttatttatttatttatttatttattttaaagacggagtcttgctctgtctgagcggttcaagcaattttcctgcctcagcctccctagtagctgggattacaggtacacgttgccatgcctggctaattttttgaattttagtagagacggggtttcgccgtgttgtccaggctggtcttgaactcctgagttcaggcaatctgcctgcctcggcctcccaaagtgctaggattacaggcatgagccaaccgcacccagccaggaattctttttgagtgctttaatttttggtctttagaattctagtgctcaagttatgaaatggaggagaatgtctatttttacactgagtaactcacacattccttctcaatgagggaaaaaacatacttgtctaaaaagatatatactaattcattatatgtgttaataatgaaaatagtagaacatgtctgagaatgccttttcaaggcctgcatagggatggaaatctgaattaagctttggaattgcaaacgtcagaattgagactgcattgataagcagaaaagcaaataatgctgacctgagatcttcaaccttctctcctgtggctttcatgagtcttgaaaggagactggtgcttactaagaccactgatttgtactaaggagcgtttgcatctggtgtcttcccttgtgctgaaatagctctgagtaaatgctttgattccctcatgatacttatgggactttttttctaatgtgtcttttcctatgtctaaaaagatttgagctctgactaaaggctttgccacagtcatgacacttgtagggcttctcaccagtatgggttcgtcgatgctgaatcagaattgcgcttcggctgaatgcctttgcacactcgtcacatgcataaggtttctttccactgtggattctctgatgtaaaataagggctgagctctgactaaagattttgccacattcatcacatttctgttgttttttccaagaagggtttccttgtctcttttcaaacctaccatcttgttcataggttcctctatatgtggaactctgggagccattcatatgaaggatattggaaacattgcaatgcagttctatgcctaaagaagtcttttgccttgaagcagatttcacatttgtagttttgatgtcttcatctgaaatggaaaaacaaatgtcaccaggaaagagaaaggatgatccaaatgaaatatacatgattattgctagcatgtttataaaacaacacacaatgtgaaggacggagagtgtaagacaaaatattgagaagtttatataagacatagagaaaggtttacatactgaggaggcagtcaactaaactgtaaagttgcaaagttctatggaaaagacagaatagggaataaggataaaaagatatgtcagagactaaggaaagtctggaaggaaagaaagggcttagaaagaagaaatgattggagacacagagagctagaaggagaggaatccaatgtgccagtgggagtaacaaacaagatttagtactggagtatcaataaataaataaagcttaatattcataaaggaatcagtaactatgcaaagaaatgagctgaagaaagccaaggggccaaaaaggaatgtggaaaataaagtaagaaaatataagttaggccaataaagggaagattatagactaggataactagtacctcaaaagatcaagggtagcagagtacccactgatgaaaaacctctactcctgtatggattttatattactggttgaatcgctgtttgttgtattattttgtattacatttaacatccatgaaaaacgtacatggctgcttatgggctgcggccactcaggcggcacacaaacctggcttgatgcagagggccttatgactcagggtgcctaaagctccagcagaactgctaactcagatgtgaaaatgccagtgtaatgtggttgcattacctgaagaaatcacttcagttatcctcatggtggcattttttttttttttttttttttttttgagacggagtctcgctctgtcgcccaggctggagtgcagtggcgggatctcggctcactgcaagctccgcctcccgggttcacgccattctcctgcctcagtctcccaagtagctgggactacaggcgcccgccactacgcccggctaattttttgtattttttagtagagacggggtttcaccgttttagccgggatggtctcgatctcctgacctcgtgatccgcccgcctcggcctcccaaagtgctgggattacaggcgtgagccaccgcgcccggcccatggtggcattttaactgaagctgctgaaagacaggagcttaaaatgagtttataaaagcaaagtacaacagttttggacatgtctggggagatgacttggctggggctgactgtgactactgggggtgcctttatctgaagtaattatataaataagattaaaagcaacccagagaggtactgatgataagtgattccctgggccctctcaaggcctaatgaaaaggttagggtgagaaaggtagtctggggagaagaattagtgatgcaatgtgatactgaataagaaaactgagttgttgttttactctttagaatttacttaaaatggatctacctgctgtctctacaatctccttagaatcacccaacataagctcaaatcttaacataagcccttcccaattccttcttaatgacacaccccatagtttctgtgccgtgttctctttcttgctgcagcaaactaaataaacctaacttgaaaaaatatataaaaatcaaatcaaatgggtctaaatagttattacaaaaggaatttaaaattatttattgtatttattcacaaatatggtgtctcagtccattttctgttgtttagaatagaatacctgaacttgagtaatttatttataaaaagaatttatttcttatagttatggaggttgagaagtccagggtggaggggtgcatctggtgagagccttcttgctggtggagaccctctgaagagtcctgaggcagtggagggcatttcatggtgagggggctgagcatgctaatatgctaactcagccctttcttcctcttcttataaagttaccagttctcctatgatcaccaattaacccattaatccatgaatgagttaatccatttatgagggcaggggtgataattcaattacctctcaaaggcctcacttctcaatactgccacacttgggattaagtttcaacacaagttttggaggagacaaatattcaaaccatagcatatggcatactcatttattattactagtttaagtggaaatcattttataaatggtaaggattctgtctcaaattcatttttgatagtttatattccaaagtgacctcaatgattagtcattactatcaaaatcctggcatcaattagtactttacagtactgagaccaagatcatctcccagaagctttcataagacatgactcagtaccacagaaatcatgttgtggccttaagaaatggttctattattctatcaagtgattctggttctctctgccttgtactgcaagatcctggacctgttgcattctgtttcaaatttctacgaatcttaaaaaaaaatgtaggaaaggcctccatgaggacattcacaggtaggatgtggttcttgccacacctggctttgaggttgatcacttctgtagtcaccaccacaccaagctgctgaggctgggatggtctccctccctttcctgacggaaaatactttttcgtgaaaagactttcacttttctaagtataccaagacaatttctagactggaggtattacgtgtcccagtataagccttcagagagccagtacttgccaagttagggtgaacaatgttttctaaatctctttctaaattactgtatttcctttgtgtagtttcttataaaaattcccttggaaaaactctaaccttgcttagctatcagccactcctgaactatggaagcagtgctggagagaaggaaggagatgctcccaagtaggatttccctcttaatctctggctcctattttatccaggatgatcatctagaaggagggtctctgctcaaatgtcgcttcatcagagaggcctttctaccactctatataataagatcctatccccaccattctgtttaaagtagcatggcccttttatcaaatgaaattttacattgagttccaatatataaaacagacgaaaacacagctactctgtctgaagcaggagcagtcacagcctacaaggcctctaactcagccttatttctacttctcaccttccctctagcccccttattctgttttgtttttattttttccccatagcacttatttgtttagtatctgcaatggaagaatagattgctacacagctattctggagcacttatagaaagcaatgcaaagagcagttgaggccagttgaagatgtgagggagtagagaagtgtattcaaagcacgtatgagagcaaagtcaccttagcagcaatataggcgattctgctacgagatcccaccagtaactgagcagttatataggaaatgatgatgaggatcagtggtctctgggctgtgtaccttggggtcccacagaaaggcctcaagggctgcctgaagataaaagggctactttaaaaaggcatgaaaaccctgatgcagatgtcagggatttaaagtctgaagattttataagaatctctgaaaaagaagcaagaacaaaatactgaagatcttcatttagtaggacaaataacagaagttcccacagtaaggaggagatgagagggggagatttgaggcctcttgcataaatcagctgagatgtgtgtggtgagcagagggcccccacaccttccaacatgaactgaatcctgccccctcaccatgtggtcttaaggactgaagctcccatgatgctccctggagctgcttcttcacgggcatgagctggctacttggcaattcctcagtgatttctgaaggtgctagcttctctgcaatcatgtccttccttcgtccaaaaaagatctaaaaacaggaataattgaggctgaagaacaccatcaggttgggacttgaggataaaataacagagaagaaactatgcaaaaagtatcatggacacaggaaaagggagggaaaaagtagagccaccttctatttgctgggacacccattagtactttcacccctatacatccagttgtgctgagtgggaatacagtttgagagctctactcccaatgatgtgccagtgctcttgactcagcctgggggttcatctccacaggcatccttcttacctgctttggtccatcaagctctctctccacatcctccagcatagtcacagtttcctctccattctctggatgatgcttctgcacccaggcctgaagctcttttgggaggatggccaggaactgctccagcaccagcagctccaggatctgctccttggtgtgcacttccggcctcagccagagatgacaaagttcccagagccggctcagagcctcatggggcccaggtgaatcctggtagccaaactgcctgaattgctggcggaaggtctctgggctgtagctgctgctccagtggaggctagagtctggatcacaggtctgctcttcctcttccatcttctctgtcagaatcccattacactcctctgaagtttgtgttaggagtgatgatgactttcccaattttgcagacattttgacagacaaatagctcagtactgttaggctttaatcctcaaggaggtgaagctgtcctgatggacactccttaaatatgattaaagaaacaagtggaaagaagacaaaagacaaatgcttcttagaacaaaacaactaagattagaaacataagactgtataggaactactgaccttagtcttaacagaaaccatgcttttatttatttatttatttttgagatggagtcttgctctgttgcccaggctggagtgcaatggtgtgatctcggctcactgcaacctctgcctcctgggttcaagtgattctcatgcttcagcgtcctaagtagctgggactacaggtacccgccaccacgcctggctaatttttgtattttcagtagagacagggtttcaccacgttggccaggctagtctcgaactcctgacctcaggtgatccacccgccttggcctcctgaggtgctgggattacaggcttgagccaccacgccaggcccagaaaccatgcttttgaagaatacttctttaagagaaccaaacagctaagactcattaattcatatgcataagtgattcacaattcattctgaaaaccatgcccacaaggctactgaatattacaataagagatcagccaggattgcatagaagctcccagataatggaaataagggaagcctgagaaatgctctaactctggagccagttcaaagagccaatcggtatttagtgtgctgcaaagagctcaaagaaatagtctcatgagggaagcacttttgtgtgacttttttcagcttttactgttaaaacattacttcgacattaaaggaaccattaaaaaaaaaataaaccaatcagctgggcactgtgcttatgcctgaaatcccagcactttgggaagccgaggtgggagatgggaggatcacctgagcccaggagtttgggaccagcctgtgcaacataatgggaccccatctctaccccaccaaaaaaaaaaaaaaaagaaaaaacaacaaaaaaggcaatcacgttccttcatctgaatgtatttctatttttttccatatccatattacttacttaactattttaaaatacttaggttgtttctaatttcactattataattaatgctgggaggcacatctttatgaatatactgtttttctcctttcaaagtatttctttcaagcatgtcccaaggcctctgcttgttgaggatcaaaggagaagagcaaattctgtcttgctatgtattatcaaaatattgcacaaagactgtatcaattcacaataccatcacaatcatagtgacttgtgagggcaacgatttcttcaagtattattagctcgttagcaacaaagttggggggggacggcactttcctttgtatcattttactgttaagtatcaccagtaactaatctcattttgttgttgttgttgttttgttttgtttgagacagagtctggccctgttgcccaggctggagtacaatggcgggatcttggctcactgcaacctctgccttctgggttcaagcgattctcctgcctcagcctcccaagtagctgggattgcagacgtgtaccaccacgcccggctaatttttataattttagtagagacggggtttcaccatgttggccaggctggtctcgaactcctgacctcaggtgatccctctgcctcggcctcccaaaatgctgggagtacaggcgtgaggctctgcacccggtctaatcatattttttaaattgggcaggaggtatatgatagtgtttgtacaacttcagcaaatgatgactactttaaaaatcttacgtgcgcctccgtcttccatcgttatgtatcctgccatttgacttattttctcacttcaccaagtattgttctaggccctgtataaagcctgtgagttcataaagttgttaccaaataaatgatacaactttacacaatgatgtgctatgaaacaaacaatagcagacacacatattaacagaatttactatgtgccaagcactgttttgaacaccttagtaaaaataaacaaaggttaaatcctcataaaagccctagattatttttacccccatgttgtagacggggaagcagtcacagcaaagccaggtactctggccaagggcaaagctggggtctgaacccaggccgtccacatttatccatggtgctgtgtggttagaggccataggcagcaggggcccttgtggtgacccctgcgcgttgtctcagcgcagaggaggaagtggcggcaggcagccgcgctcccagatgaagcggggccagaagagtctggggaacaagacctgagaggtgggaagggttgaggccaccggtttggagccgtcaggtaccctaagggatatatgagggaccccggggctaaagcagcctctggaagagagtggccgccctgtcacttcagcaccaggcgcagaatctgtgctaaacctgaggtgagggtaaggaacccccgacaccgcacgacaaccagaaagaacgtccctggaggggaggcttcgatcaaagcctgggacgcaggggtctttctgcaggggacgccgctctcggctctaccctgctgtggtgggccggctctgggagggctggcttccgaccatctcccgacctcccgcgcccaccgcgccgcgccgcgcgcctcccaggctgggaaccgccggggcgaagcggcaggtggcgcgggttcacctggcagggcaggcgcccggggtccgccggggaaggacgaggggaaggggtgcgcggactcaggggcaggcagcggaggggaggggcctggggatctgggacggtgtaagggtgctgcacttgcgcgcgaagggaggggtggcgacgagtccgcggccgcctctccgcgtcccccttccaccacccggggaccaccgcctctgaccgcagcctgggggccctaaagaggcctcgggtctcacctcccgacgccgtcggggagaaaccggggaactgccagctgcgcaacaacttccggttct

SEQ ID NO: 550 - DNA, 105296 bp, Homo sapiens
gtaaaggcaaagaaggtttttatttaagtgacaacatttgagagctaaaaaccagctcacatcaaaatcaagacccagttgtaaaaatcttttaactccataatgctgtttttgtcttgttagaaatctgatatcttacattagcgtttctaacggattttgtacaaggcagccataaggaatataataaacctttttcaccacagaaccatctgtcacagataatactgaaagttacacacttaggaacagtcagaccacagacaaggtcagactggctgccaccaccaagtaaacaactagaaaaggacagcggggtccaagggtgggggtccctgtgcacgagtcgccctcctctggcctgccccccctcgggtcacctgtttctcctttgccccaaagagggtggagtcaaatgcagattttcctcccaactgcctgttagtgtctcaacaaggagagcagagcccaggtcaggcctcactgcttggacttaaccctaactatgatttttacgaaggtttcccccaagcccggaaggaaaggaaggagggaatgtttcttttggctgagccaaaagacaataggtttccagggcacttggcacccaaaccccccccccccgcccgccgatgggattcggtgggaaagttggttgtttaaggcggggtcagggcacccctcccggggctgcacctgggctaggggggagagtgaggatgcagaggacccacgtgcctcatgaaagactccagggcacaggtatgggtcccaaaggggtaaaaatacagtttaaaaaccgtgagatccagcctcgcctcttctagacagcccaccgccaggaatctctggaatactgggattcaaacacatttgtttgctgtagcccagcacccagacaagagggccgttcatcccaatgcatgaaaggagtctgcttttttaaaaaagaaatattttatggagcccaagggagccgttgagatctttaggaaaaaacccatgatgctggaagagcaggtcctgggctaaggatgcaccctgaaccccaacagggcaaatgataaaggaaggtggcaggcaggccctcggctacgacagccaccggatcgggaagaacaaacatgccacgcaagaaacaaggagctttggtcaggcaggaagatctgtttccagctgctggagagcaggcataccagaagctagaaggattctctacaaaacagctggattgggggtcacagaactactcaaggagaggcagcagcaccccctccagagaacaacacaacttggttctttctccaacttaaccggacagacaaaactgagcaaaccgctagtgtagaaagagcatatgcattacacagttgccgtgaaagcagtactgaaacataccttgtctcgccactaaacagaaccgcaggtacacactcacacacgccaactacagctccagttgttgcgttcacaatatctcaccgtacaccatcagcatcttgtgtgtgcatcatcagccaaagccccgatcctcctacctgattgctgcttggaaccagagctgtttccaaaaggaaggggtggtggccctcctgctgggtcctgtgtcccagctctgaccccagagccacagaaccctggtcacactgacttcaaattccccagggatcctggctcatgagctctctctctctcttcctctctctctctctcttcctctctctctctctctgtcttcctttctctctctctctctctctctgccttcctgtctttctttctccctctctctctctgccttcctctctctgtcttcctttctttcctctgtcttcctttctttctctctctctttctctctccctctctctctctctctctccctctctctctttctctctccctctccctctctcgcctagcctggggttctcagggaagagggaatgtaactgggagcaaagtaccccatactaattattttatcattttagtgtaaccagtgccttctgcaagaaggagatggtagagttttcaagaatcagactaagtctgcccaagtttaaatcaggatatttgggggaaggattagggttggggtggctatgccatatgagctggtgcctttggaaagccaagaactgtgaaatgttaaaggggggatgggcacctgtgaaccgccaggagacaggaccatagaggaggctgaggctgaggctgaggctgagcctgatccgcactcctccccatagactcgccagcagccctgggcttgagtgcaggatgcagcactggaagtagagcagaagagctggcagactgaagacacatttctagtggggagagcagggatgggggttaggagcccagacccctccagccccaggagggcacccaatttgccaggcaattcacaacggcggtgccagccgcccccaccagcagcgtcactggctgcatgggagccgcgagaggtagacattgagcagaagcgacactgagctgacacaggtgcctgctgtgtatacagacgtctgggccctggggcagcctggctgaaattgctgggaccggccttgatggcagcctatgggggctcagtggccacgtgggcagccccacacagcaggtgtgggcctgggccagggagtcggggttttccaggatgcaggaaagcagtgcccaggccaaggttcagcagcaggagggcctgagcaggctttaggggccccagaagggccaagtcctgccaacctcaggggactacccaggaggaggttatgggcacaaactgagcagcaggggaaagggaagagaatacaacagttggagccaaacttccaggaacccctagaaccctggaatctcagctctatgcctctgggagccaaaaaggataaaagggtcctggcagagctggggttatggggagcccaatcagtaaccttttggcaggagagggaggtgggttgtccctaggacacccagtttgagtgggttgtccctgggacacgcagtgcaaggcaaaccagctgcacctctccgtggagtagggatcccttcccagcccacccagagaggctcctttaagagcccctcctttccagcccacccagaccccctctcccaggctgtgtgaaaggtgtgggtcacaggacactcggagggacccttaggcctgaagagcctcaatgggccaaactgcaggacatcttgggagtcaaagactcacaccaatctcagctagggggacccctccaataacagaaggaagacggagcccagagagggcaagcaaccagctcaggggctcacagccagcccagctgagccagagcccaaggctgcagcctcccaagggagggcatgaggcagggctccgggaagaggaagccctggcctccagggccacagggaaatggtgaggacactgaggacaacgggggttggggacaatggacagctgcaggacagaccgtcagcaccagaccccacccccgagggctgtggacagagacggcgtaacatgagcccggggatgtgctctcactcccagaaagtggccatcttgccataagagcgccaaccccaaaatggtgacccaaaccacaggaagggcgggcacaaatgccactcacacctccacaagacagcccagaggctgtgcctgccagcggcgcttggtgccgaggctggggctgcccccttgagggcctgcctagctcgctgtgaagcctggggacgcaggagggtggtcgactttgcccaaacgcttcagccccgggcaagcctgcccccaggatgacacaaacatgaaccctgacttgggcttgcggtcgcaggcccgtgggaggcagcagtggctgcaccgagatccccggacctcaccccgtcgcagctcagggagccccccgggctcgggcaggatccctccccgctctggtcggacactgctggacagacacgggagggaaaaagcaggaaaacgcctgtgtcggggagagggcagccccctcccgtccccgcaggcagcctgattgggccccccgctccctgctctgagcacagcccacccctcagggcaccgactcgaacttggggggcccacgcgcccagctgagcgccggcagcggccgctcgtggtctttgtccgactcgggctggctctgggcccgctcgggcttggggttggcggcgggcgggtcgggctgctgcactgacatggttctgcgcaggtggttgcgcttccgcaggaactctggctgcgcgtgcagcccgaagctgcccttgcgcaggatcatgcgcgagttgttcttctttgggcgtgagcggtggctggcctccagcgcggccaggtgtgcggcgtagccctcgctcaggaactgcggagggcaggggagggcaggggagggcagggcagggcagcagcgcagggggaagaagggaggggagggggaagaggggaggggaggggaggggagggagaagaagggaagcggaagaagggaagggagaggaggggaggggaagggacaggcatcaggcggaggggtggggcaggccccttatcctgatcctgtccccatcatttcccgggaacactctacggaggcacctccagcttctccaaggaaccctggggaagtcgggagctctttactgttccagggtccccatcctgctttggacaaccatgcatctctacctgtacccatgggtcacaccagagttctctggattttctttcctattttattttaattaattaatttatttatttgagaaagggtctcgctgtgtcgcccaggctggagtgcagtagcccagtctcagctcaccgcagtctcaacttcgccagctcaagcaatactccagcctcagcctcccgagtaactgggaccacgggtacatgccaccatgcccagctcattttttaaattttttgtagaaacagcgtcttgctatgttgccagggctggccttgaaccctgggctcaagcaatcctgcgtatcaaagcaccaggattacaggcatgagccagggtgcttggcctctggattcttgagggtggggaagcgcccatccttgtcacttggctcactagaatcctgcaaagtccctcccgtcacgcagcctcaccatgcctcttgtcatttttctgagccctgcgactgccctccttgccagtccttctggctgtgtccagagccttgctactcaatatgtggtccatggactctggcagcatcaacaccacctggcaccttgtcaggcagaacttccggccctctccccgcccctaggcctatggaatcagaatatgcatgtcaacaagatctccaggtgatgcttgtgcacttcagagtttgagaagcagggcctctgagttcccaactgggagacgccaccatctcctgaccctctacccgcgggtcactctcaggcattgcacacttgacatgccccagagggaggtcaactccttcccttccacctgctgcgcgattccaatagtggcacctcctacgtggtcacccaagccacagaccaagtagctgtcctccaccttccctttctctcatcctgcacatctgatctgggcattaccaaacccaatccatcccctaccaaaaaatgcctctcagaccctccactttctcttcaatgtcctctcggcttttctttccttcctctgaaccacctgccacctgcagcctgagggagcttcctgaatcacacacctgctcatcccacaccctctcagagtccccacacaggccatcttggccgcactgaccgttctagccccgcccccccacctcccagctcacgtcccatgcagccaagctgagtcactggcagttcccagaatatacatgttctgtgtcacctcctgaccttggcttttgctgctgcctctgtcacaaatattcttctcaatctcaggcccttcctggaccattccttcaaattccggaaacccaaccttgccctggagtctgggttagcggtccctctccagggccccacagttccctgtgctcccgtcatacatcatggcacttgttacactccactgtcaccaactgcaaatgtgtccatctcgccactacactgaagttcattgcatctggctccacttgggattctccccctgcacccaacacaggccctggcccaaggcaggcaccccgaagtgtttgttgaataaatgaatgagcaaatgggggaatgaacaaatgaatgaatgaatgaatgaagtgcttactccctctatccctttccctgacctccctcacaactccccgcctccagccccgcctccacccacctggcactgggtttggtacttcttggtgggccggcccacaatgaagatctgggaggcaggcaggcccagcacgctgtagacagagatgtccttcgtggagccataggccgcactgattttgatgaagcactgaaacacagggcaggcatagggggagagtgaggccagcccaccccctggaaagccttcccaggccaaccccagggggcccctgcttggggaccctttatgtgcactctggtagactccaagccatggggccaccctgtgtcaggaatgaaccctcagagtggctgcccctccctgcaccccaggcccaacccaggtctctgcccagtaaacagtcgtgaccacaccatttaccggccccgcctccaacagcagtacactcaggttaagtaataatgaaggcaagcgttcctttgtggataaggaaattgagttccaggtttctggctcacagggccaggactggaggccagttctgcctggctcctgatcctgtgctgtccacaccgctccacactgcagcttgccatgtgcccactgcctctcactggctggtgtgatgaccgcccccctccccaaccccagaatccccaattcaattcagagaactgcacaaggtccgtcttgctccaggggcacttccagaccatcacccttccctcccctccccaggataaacccgatcaaactacctcctcctgtgaggtgctcgccacccagctgcccctcactgtgtgcctcctgtcactgtcatcttctttttctcccactcacactcctctcaagccattggagactttggtcctgggtcacaagctttccttcctgccaagccccaccatcactgggatgacccacggtctgcatgacgtgaaggatctaccacctcccacccggcctggcagcttcgcaccttctttcacgtcagtggccgtcacttccaggaccaaactcagaacctgcccctctaactgtgaacttccacatgtccgctccgctcagggcttctgccccctccccaccacttctccgccagcccccacctggctgctctcagccttactgacacttgtcttttctgcaccagccctgctgcctcgccccttcctcatcctgcctgagtgacccatggcatccctgtgtccttgcctccaccccggattctctcaccccttcatcctcctcccacacctgcccggccaaatctcagccctggaaattttttccactatccaccttgtgtttttgtacatgctgcccaccgagagctgctaaagaaacagagccacgcagctctcaccttccatcttcttcctgtccttccctgagccctaccccatcctgcaggtgactgccttcgatgctggaccaaggagagggcttcctcagcccactgcccctcacctcaatggttggtttattcccaactggcctttggctcagaggatggagcagcccctcttcgtctggcccttccaccttctcattcacctgagctcactcctataacttggatcctccagctctggcgaccctgcctacctgcctcatgaccctcccagctgacacccactttctctgctcctctccctgctacttttgcccccttgtccttccgaactgtcttttcctcacaaggtcatctggtggccagtctttgtctactaggcagttctcagcatcccacaccctcggcaaaaggggcgctatctccttgaagccctctcctcccgatacctggagtctcgtctctctctcctggtcctcctccccctcactctcctcctggttcctcagctgctccttgtgctgctctcagtggcccagcacagcctcttctaacgcctcatctcccgtctcatggctccactgatccgtctcatgcatctgtttcccagtctccacctgcagcccagaactaccctaagccatatcaggtcccgtggctgtatcagccttgacatgtccacagctgagctcatctccctccagcctggtcctcctctcatgtcccctctcattcactcactcattcatttattcattctaccaacatttatggagtccctaccatgtggcatcatcacccccaatgcagaagctatattggtgagcagaacggacaggctctgcctccatggagaccttggtcaggtgtgtagcacctggatccctcctggtcacccagcacgggcatcttagaactcctcgctccctgcatccaaccatccctgagccccgactattccacctcctaatcctgtccatgtttttctctccatcccatacccatcatcgcctggattatggtcttcctgtcttttgcttgggcaacagccccctaactggcctccctgcctccagtttctcctgccaatctgttctccacacagccaccaatgggatctttctataagccaaattagacactgccacttccctgctttaaactcctccatggctccccgtgaccctcagcagagaatttatgatcttggcctggtttccaaggttttcaagatttgccaagtttgggcccctgatgacctctgagggctcagctcccacttgtcctgggtttaaccctgcctgcacttatcccaagcctggaacgtcccaagctctctcctgcctccgtgcctttgcacatgctgtttcactgtctacctgacaaattcatgcttcaagactcagctcaaaagttaccacctcctagcagccttccctgccctccctggacaaactgaagtcctttctcctctgtttgctaaaagggcctttttcaaccacacaccagtagttgtcaattgacatgtccttcctcctctagatcagggatttgcagactttttctttgaaaggccagatagtaaatatatcaggcttcgcactgtgtcaccactactcaattctgctgttgtattgcaaaagcaatcatagacaatacgtagacagatgagcttggctgtgttccaatcaaactttttttatttagagacattgaaattcatgtaatttgcatgtcatgaaatatcattcttttgattattctctccatccatttgaaagtgtaaaaaccattcttagctgaccagtcatatcaaaacaggctgtgggctgggtttggtcattatatgtcaacgcctcttctgctctaggtcagggattcttgattaatctttctgtgcatcagaatcccctggagggcttgtgaaaaggttcctgagcccctccccagagtttctgattgagtaggtctaagagggtggcaggaggaggcagggcagataatttgcacttctcccgagtttccgagtttcctggtgctgctagtgggaaccatagcttcggtcatggaaagcacatctgggtcacagaaagcacatccgggtcacggaaagcacatcctctgcccccctggttctgtttgtctctgtgcagccccaacaagcacagagtaaggaacacaatcggcacttaaatgtctattggatgaatggccagatgtagagacaagagtcaggagataaaggacgaaagtctgactcagatctagggcaagttgccggagcctcacctttctcctctgtcaacgacgagactaataacctacctcacagggctgctagagggcccatccagatccacgggaatgggatttacagactgcacatcacaaggccccacccgggaggagggagatggggagcggtggagaggagggctgcgctctcaagccatggagtccccaccccaggatggccactcacctcctgcatgaggttgcgcaggaagatggccttctgccgcagcgggtcatgcaccagcccatcggagaagaagatcatgccctgtgggaagttgtgctgggacagccacgacaccacccgctgcttctgcatgtccggccgtcccgtgatgtaaaggatcatgtagcccaagtcctgccagtgcctggtgagatggcattagaagggtccagccctgcccagtgcaggccacctgatgcccagaagcctgccctgcccgcagctgccctcctgagacgtcagagggacgagtctgaggcgtgctagggagaacaagggggaccccgaatcccctctctgggctgagccctggacatctcccctggatcaggcctgcagatgccacaggcccatatccaaactcatctcctcacccctgcccctctgctcacagccacttcagagtcagagacaggcgcctttcattcttccctgttccctgtgcctccctccctcctcctcctccaggaagaaagcctttcgctttcaccaggccagactctttaacccctcccccagccctctcacttaagccttgcttctcatccttagctcgggccccatctctctcctgggccactacaaaagcctcctgggcggcctctttccctccacccctactcctacccacatctaacctgagccctgtaaccctgggcagattactcaaccctccccaacctcccacggtttcagtttccccctctgtaaaatgggcataataatatgaactaccccacaaggttgtcctaaagacgaaaggagttaatcccaaacatgcatagcaaggtggtatgcttggtgtggctggctttattattatcctccgcagtgtttccatggtgattcctgtacatcgcaaatctaaccccagcactcctctgtctaacagcatctccagctccccagcgccctgaggtagagcctcaagtcctctctctgcctctgtggccatgtctctgctctgcctttgcatatgggatctctccagcccacccagagctgctttgctgccccctgaacaaacccttggctcttctgctgcacagcactcccctacacagcccctacggcaccatctcctgatattcccatcttccatctttcaagaccccccttcctccaggaagccttccctgcttcccaagcagaatcagcctctttcctctgtgctctcacagtgcagtgggatagctctggttggctgacttcacacagaatcctggctgcaagatgtcaggtaagcccagacctggttgggcacctttatggcacctgccaccagaaccagctaatagagatggggagttctaaaactggatgatgatctgagggatctggggatgctctacacaaactcaggggtgcagggatcacccctagggattctggttagttctgatgtggggcccagtgatgtgtttatgaaaaggggagtttctgatgactgtcgaggtttggggagcaccatgtggagcaccatggggagcaccctggagcccatggaaggcagtgggaggatcatggacccccagagaggaaggaccacagcctccccttccctgcagtgggagggggactgtgacgcaggagggatttgttgtaatggcaacaaatgacctagctctacaagggggaggctggccccctgaaatgggcttcagcctgtctaggcctgttcttacggagctgctgggcatcttgaggccagcagtctcccaggagcccaggagccaggcccgtcttctctccccaaaaccgtcactgttactggggtgaggcagggcagtctccagcccccaggaacttccagtgcctggcatctgtcctactctcgaggttctgatcacttggagtcctgggttacagtttctcatgcctgtgacttattttccccaccagactctgagtgtcctctgacttaagagctcgctctgcatcagtgcccagcacacagcccagccacagggggcctcagaaagcagcggatgcgtgcacgagtgcagggagggaggcagggagggaaggagggaggcagggagggaagaaggaaaaaaggaaggaattgagggagggaggaaggaagtgagggagggagggagagaggaagaaacagacaagctgaggtctagaaagcaggagaaattttcccaaggatactcaataaattactgttggaggtaaagccagggcttctcagctcgcagccccagagaccggtagaattcctacagcaaatcagaaaaacaacatatttcccccagggctgctggctcctgccccccagggagatatagccctcgtggaaggtggcactcaccggacaacatccactgcacccggccggaccttggggtcgcttcccatgatagacacgctggccgcgaaggacccatcaatgctgaacactacacactccatgcccctgggcaacaccgtgaggtagctcatggcacaggtctggtcgcccctgaaagaaacctgcctgtggtcagccgtgaggtcagggtcagacgttagccggaatccagaggtcagcctgtagctgcagtcagagctcagtctgggtcaaggtcagagagcacctgggtggcatctcctgatgccacggctggtgacctctcccatccacctctgtccatgcagacagagatgggggcccacaaagaaccccaaggaccccatcctctagacaggcctggctggaagggccatagaaatgagagaaaccaccctgagaatggcccctgggtcttacctgacgaccatcttcacaggatagacaccaacccccaggcgccggggccgcggcacattgtatgtgatgcgaccactgctgttggtgatctctgtgtccaggtgtacccagcggcctgaggatggctctgccattactaggatgtccacctgcggcagtgaagggggtcagggactccctgaaggctgaggggctacaggcttggcagaggggctgggcgggggaactctgggctgaggtccctgcctgacattccctggctcctgccagcctggctcctcatttgtccttggatactctgagcccatcctttcctccttgctcacccttcccggcccgcccaagcaggtgggtagctcctggccctgtgcttccaccccaggcagctcggccctcttgacaccctcaccccacacgctatgtggctccatgaggcacctggtgcaggtggagtggctgaggaggggaggcccagccccaggtaccttctctccagtcagagccaccatgtcgaggggcccgtacatgaaccgccccaccaggacctgggggccatcttcagcagcaatcacatcattggcccggtgattagccgtgacattctggaaggacagaaagaagctggctcagcccttgcaagggaggctcaaccttgctttatcattgcagtgttcctcagactggctggaggcatatcagcttgctgaatcatgtctctctactaacttctgctagagtttcagagatgtgttcccagggaacgtgtgagaaaaacagaccgtgagtcccccaaacgctgtcttcaaggtgcacagggcttcctgccattgtacgttttctgctttcgtgttttttgtttgattgattgtttgtttgttttgttttttgttttttgtttttgagaaggagttttgctcttgttgcccaggctggagtgcaatggcgcaatctcggctcaccgcaacctcccgggttcaagcaattctcctgcctcagcctcctgcgtagctgggattacaggcatgcgcctccacacctggctaatgtcatatttttagtagagatggggtttctccgtgttgatcaggctggtctcgaactcccgacctcaggtgatctgcctacctcggactcccaaagtgctgggattataggcatgagccaccgtgcctggcccgttctctgttttgactctgctcggccctgaggggacaactggcctcacagcctgtgcttatcttccagatccccgggctggaaactgcctggtcacttttggttctttcttctacatcacagctcacatccaacagtatttactatctgtctttttttttaagataaaatttcaaatgcacaagcatagagagagagaagagtgtaacaaagcctcgtgttcccagcacctgctccaccacttagcaacaaactcgtggccatcctggtttcgttcttcccttgcccaattccccagcctcggccccagccccaccgggattatcctggagcaatcctggacgctgcgtcattttatctgtgactgtctcaacctccctatttttcttcatttatcaatgaactggtttcagttcattctgcagcctgtgttggccctgaccagcccccactcccagcctggcctccaagaccccagtctctccatctagtgaccactcctttaccgcactggccacatcttcatctctcgcacagccacatcgcctggatgctgctaacagctccctaatggagctccttcctcaaaggcagtccctgcaacagatcctctgtctctataaagcacagctctactaacaccctcccgggctccccactgccctctgcgtagagtccggaacctgagcttagctttccaaggcttgcctgaacgacctcttcagtctgtctcctgctgctccccatccacaccttctggtcctttctgccaggctctgcagcagcctccaggcctttgctcacaccgctgtcccgccccccacactggctctaggtgccatccctggccctggccctcttcccccacattccagcccattcgctatgactagactcagcgccatcatcgccaagaaacactcctcggactcctcaaagacaggttctcaacctcctttcaattcccatgcattttaattcaatccaacaaatatctgcagacacctcatctgcatggggtccctgagataaactagtcgtgggccctgccctggagacactcagccaagtagggaacgcaggcccccttacaggtgcactgtcaggggagagggagcagctggttcatgaatataagcacctgaaaagatccggcatcccgagtcattagagaaatgcaatcaaaaccacaatgaaataccccgtcacacccaccgggatgactagaatcaaacagacagataataacaggggttgctgaagatgcggagaaatcagaatcctcatacattgcagtgggaatgtgaaatggtacagtcactgtggaaaacagtctggcagttccctatatgattaaccatagagttaacatttgatacagaaattgcacttctaggcatctacccgagagaaatgaaaacacaggagaaatgaaaaacacaaaaacttatacatggacgttcatagcagcattattcatagtagccgaaaggtgaaaacaccagcctggccaacatggcgaaactccatctctactaaaaatacaaaaaataaaataaaataaaataattagccgggcatggtggtgaacacctgtaatcccagctacttgggaggctgaggtagaagaatcacttgaaccagggaggggaggttacagtgagttgagattgcaccactgcactccagcctgggcgacagaacaagactccgtctcaaaacaaaaaaaaaaaaccaaaaaaaaaaaacaggtgaaaacaacccaaaaaatgtccatcaggtagtgaatggataagcaaaacgtagcatctccatacaacggaatattattcagcctcagaaaggaatttctgacacagcgaccagttggatgaaccttgaagacagtgcgctaagtgcaagaagccagacacaaatggtcacatattacatcatttcatcgaaatgaaatgtccagaataggcaaatctgcaggcacagaaagtcgattactgattgcctggggcaagtgagggagtgtcagctaaagggtacagagcttctttttggaggttatgaaaaagctctaaaactgaccatggtaatggttgcacacatctgtgaatatactaaaatccactgaattgtactatctaaatgggtaaattatagaatatgtggattttatctcaataaatatgtttaccaaaaaagagttggttcatgaaggattgatctccttctaccttttaggactgttcttggggtccatgtctggtcttttcaccagactggagatgcctaccatagcaatggttgtgtctgtacaaccctgtgctccactctctagcagaatgactgagacagagtaggcactgatgatcgtttgttgagtgaataaataaatctatgcacctcaaactcctattcatccttcaataccccacagaggagcctcttcagagaagccctgaatgatttgcccttacaatccttctttccatctttgtcttaatctgtaccttcctctatcaaatatcacaccaggccatactcaatggtaagtgactgagatccaggactctttctgattcaagtccacatctactgtagcctggcatatagcaattgctccataactggtatctcctcaccaaccctagtgtcttggactcctgccctcagggctcctgtggaaccaggccatgggaagcaactcacacacccttgcagctgcagtgcctgggctccatctgagtgtgagccccagcctgtttgggtgctgagctctgaggacaaattgaagcgcttacctcccatgtggatgccccagcccccgggccagccccacctcccggaggacacagtcccagccacatgcgaactgagcatgcacgcaccctcagcttgacctgagtccgcttacgaagccacttctcccgggggttggcaggactcagtgctgcagggtccaggcgggcgctttccttgatgttcacgctctcatagcgcattacctagccaagagccgagcagggccccggtcaggtcttctggcttctctgcttccctcccagggtgtcagtgcccaccagcttgtggccagctgggccctgcccctgcaaccccccaacctcacagcctggaaccgtcaggaggccgcagaccccgggacctgcattcctgtcctgatagctggggccagagcagtctcccagctggctcccttcctgagagaagtctctgccccgctgtgcccaaacctggcagccacctctatctgtccccactctctgccctccctctgttacaacaaggtggccctttcttaaggccggcttgagtcctgatcccagcccctccttgcttcttgaggacgttgctccagccatgctcccctcccaatcccgcagagctgattagactccctccgctagatcactctccttagcattcaaatacgtgtaatactgcccatcttaaaaaatactctctcagattcctcatgcctctccagtgaccgccacatccctgctgtccctcacagcagcactgacagaggacttagcccatatgctgtcaccccttcctcacctgccccctctcctccacccactccagtcagggttcttctccatcactcctctacggaagccattcttgccactgccccggtgactcccaccccgcctatctcaggggtcctctccctacactctctgggtcctccaacctcagggatgtcctcttctctccttcagtggcttctccttctctccctgggggagctccaggactcatccctgaacttccctctctgtaggagcacccttagtctggcactcatcgccagttgtaaatgccgtccaagctctgatgacacccacatttttatctggaatcctgatgtcttctctaagttccagactcctctactccccttccgtcccagcaactaagaggcagctcacacttcacacacccagacagtcgtggatgtgccacgtggggcacaggtttgggctggagcaccctggcctgggtgccaccgggctggggacccacccccagcccagcacactctctcccacccccaagaacctacaaacaaaactcactttcctccgccccctgcccagccctgctcttccgcacgtgcaggacacagaaccaccttagtcactcaagtgggaaacaggacgtactgggctcccgtctttctcctacaacgcagacagccacaagcgctctcaccgtaatgcaaatcttgccactctgtggcacctccaccccctgtcctactccaagcctcctctctaagttgggcccctgcactggcctcacaagaggcctcatggttcctctcctgccgtgaaaacagcagcctcagcctcagggtttccttcaaaaaacacaagccagttgctatttcttccttgctcacagccctgcaatggcttcccgttgaacccaatataaaaccatacccctgaccttggccatcacggctgttcatgaacatcatgacccctaccagctccccagactccctccccaccaggctctccttctggcgccggcctttctgctataccttctgttttgcagacgaggacattgagactcagtggggagtgggaactgactactccagtctccaagttgaaacactgggacactctcctgcgtagtttatatttaattttctagagtgtaccatgccgtcagccacccaggagccaatgtctttatgaagcccattctctggtcatgtcactccccactcacgtaggtgctccaatgccttcctcatgctcttaggatcaaggccaaaagctgaacagtgtctgcaagaatagcctcctctccagctggagaaggggcggtacccccttggggtggctgtgggcaggcccgcgactgcggcagcagtacctgtctcaggatgaaggccaccacgtctgtggactcccagtaactggcgtggaagaggtggggcagggccacggtggggaaggccgtgaggacatcagggcagtacagggcatagtcgatcctcttgcttccccaccacttggctgtgactgtgggtcggagaggaaggtgaggatgcgtggccggcccggggcctcacccgaggggcagcggggtctcccattgcacagactggtggtggatgccccacgtggggcacgggtttgggcgggagcaccctggcctggaggaggcctggggaacgcgctgctcttcctccttccttctcaaaacccaccagccctcccctaagatgtgcgtgccaagcccatgcccaggaaggagggccagacccacagagacgtccacagtctcacccagggccgccgctcagtggcagttcccagtgggctctgcctgaagttggcgctgagtctatgtctggaaggttcagcacttccttaatggtcagaggtcagagccctgtccagggtcaaaggtcagggctctgtttgaggtcaaagctcagaccctgtcagggatcaggggtcactgctctcctcaaggtcagagctctgatttgaggcagggtcagagttcagggctctgtccagggtcagaggtcaaggttcctccaaggtcagagctcagtttggggccagagtgaggatctggaccgatgccaggtctccatcagcagacgcccagctctctaaaggcagaagcaagcccccaggacttccttcaccttctccctatcccagggcctgccctcagcagctctagcagtggcccagcaaacacccagaggaaggttcccctcccccgaatccaggcagggccccaaaaggacctcactcactgcgggaggcacccacgggtgccatgctgtccgaggactccgagctctcgctgtgggagctcccctcgctcatcctccgtcctgggcgctggaacctcgaggcctgagggggcgaggcaggggcatccagaagtggcgggctgtcccgggagctgccctccaggaagagggggctgtgggtgtgtagggcatcagctggagggggaatttcaaggtcaggctgagtcacgtgtctccagcagagctgcccactcagtgccagccccatgctgggagggaggctgggcacttggaggagtcagccccggctctgctcacttgccagcccagcaggcacctgcccctctcactgtgcccaccccaccagtcccctgggcctgaagggaccccgctgccaccgcatattgccgcatttacctccttgcagctgtgagttatgcagacacaagctggagtcccagccatcacccctacctccaataaagctgcagagggagcctctgggacgttgccccaaaagcaccagctgaggtcccaggagtgactcatagccatatcctctcttatccaactcctcccctgcgccacaaagaattgaggctgcctctggaagggaatggggactccagcctgagagctaggatagcctcaggggagggaggggagtcccctgaccaaagagggatccatgggggagggaggtttccagcctagccgacctattgaagctccaggcaggcagggatttggaaataaaggctccattgaattaggggtgaggaagggatggtttttaatcctgaatcggccccatgcacaactcccccatccctgacgcaaacctctgagcaggcttaggctaaatttcctcaagtagggcgtggagccaaggctccgatttccaagctgctgactgtccattacaggtctcccatcgacgatacactcggtccatgcccggttcaccccacttgaccctggaggccactggctcttcgccaaaacacctgccctcgctcctgctgttctccctgcctggaagatctcaaccctcatcctctagctcttctccacctgcccaaatgcacctcccctctctggaccctaatcaaaggccacctcttccatgaagcccaccaggatggcacactctctgccctaccccttcagagtccaggctgggcactcataaaaaaaatagattggagcacggatccctggacccgccatcagctctgaaagctcaagtttacaccagccctggccacaggagtgtgtccgggagcctgttgggggcctctgagccccaagatgcctcagacaagcaggtgcttagcacaggtgggcgactctgaagacagaggagtcggctaaccttctgttctcacagcccctgctcaggtgagtcaccctactcactgagagcttggaggggttgaatgggctggggccccacctccagctcagcacactctctcccacccccaagaacctaccgaggaggagggactgcccatcgcccagtgggaacctctggtagcgaggcacgctgacaggcggcaccaggtggaacttgggctccagcagtggctcgagccgtgaggcagaggggtctgcgcaatggaagaagctgtagacctggctgcaggcaggacgcacctggaagcctggggtgagtgggaagacagagggaagccactttctagtacctgctccctgggccctaggaggctccctggaatgcagcctggagtagcctactcccctctcaagagcctccccgggctccctgctccccacgggaacaaagccattacgttcagtttgtctccccacccaggagcgcagtgacaggcacccagcactgcagccgtgctgcacagctgcccttccccaatcaggcttgcagctttcctttctctgagcctttgctcaaaacatcccttctccttgtgggccctccctcccccatttccacggggcaactcctttagattcttccagttttcactcagttaccacctgacctaggaagccaacccaggttccttcaggcaggtcagctgccccttccacaggcctcaaggctataaacactcagttcccaggcctgctgctagagttccaggtttgccagagctggtggaacacttctctcgctgaccagcaggtgtctccactgaggcatccacctcatcggcgggcctccctgtcctcctagaacagggactggaccgtccagcatccagggagccctagggttcattagcgacactgagggcagccatggggttctgcctcctcgcctccatttctaccacccactttatctgttccatactgtagcttgtcagtaagctttggccaaaagcatggatctgtggatacccaaggtgccctgcagcctcagacggtctgtacttctgtccttaagagtcacagataccctccccacccctcatgcctgctggtgccaatcgcctggtgtgtacattttagaggagcaggaaaaggcattcgaggttgcaggtattagccgggcacggtggttcacgcctgtaatcccagcaatttgggaggccaaggcgggtggatcacttgaggtcaggagttcgagaccagcctggccaacatggtgaaactccatctctaccaaaaatacaaaaattagctgggcgtcatggtgggtgcctgtacttcaagctactcgggaggctgaggcaggaaaattggtttaacccgggaggcagaggttgcagtgagctgagatcgcgccactgcactccagcctgggtgacagagtgagactccatctcaaaaaaaaaaaaaaaaaaaaaggttgcaggtattgcatgagcaaaggcacctgaggtgggcttggggatatgcgggggtgggtggtgagaccaacctggcagtcgtatctgcctcagtacaggagaaggagagggtgggaggcaagaggttgaatattctgtcttctcttccccatagggcgtgaccaccggacaatgaggccacaaagcagccaggggcacttgacatggagagtgaaatccatctgaagctgcctcaccttcgccctgtgtcaggagggaagctgctcctctctccctcctcttccccaccctctctcctctctttccacctatcccaactctgtgaccctccctgcccctgtccccgacttcactctcctcattctgaggccctgacacggtggccctagtgacgcacaggcacctcaggccccagcccacaccatccctaccgtccagcccaggcagcaccgtcctccgcatggccaggaccaggcccagtggcgagccgaagaggaagaagtcggacacatcgaagtcaaagcggcccaggctgacctcagggagctgcggccccccagccgccggggtctcagactcatcctttagcacgctggagtggatgctgcggagggaggaggacgcagggcagggcaggtcagggaaggaccgagaatgcgggagtgttcacacagcagcgcagcctgaattctgagcgtgaagtgcccaaccctccatctctggggcggggctgagagtccaccggctgcacaccacctacagtcagcactggccaccaaggcctggctgatatttggctagaaaaggaatcaacaaactttttctgcaaagggccagagagtcaatatttcagacgacatggaccgtgtggtctccattgcatctagttaactctgccattgcagcataaaagcgcccatggacagtgattaaatatgcatggctgggatccaatcaaatgttacttacaaaaacaggctgagcacctggggcgcctgagcatcctacacactggcaggcctgcctcgtcatgctggctttgtgttggccacactgaggattcctgcactgtgtaccagacaagcccagcctgcccaacactcagctggctaacgtcagttctgttctgctgggatcagggctttcatcgtaattcctgttccaggcaacccgcagacacagatgcaaacagcttggtctccccacccccagccccagcccacagatgaagcagagcttaaggagaaaaatgtgagacacacagaattccaaccatttccaacccaggtgcccactgtcccgggaagaatccaagttacgttcagccacagacccagagtaggacgctgagaatcagaaggaaacctgggcacctccctgaccttccagctagccattagctgcagcttagagtgaatcgattaactgaatgcaaagcaactaaactacttgagtcagaggagaacaaactttagaaagagctattgaaatcatgtggacaagtgccccaccctcaggagtgagcgagtctgcaaagttgaatcctcagtctccgcactccctcctgcctcttgcagtgtgagcatctcacagtgagatgatgactctgatgtttaacaatacatatttcatgtacagcgtggtccctaaacacatgccaactacttaattgccaaagaaaccaccatctgtccctacaccagaggggaaagctggctgtgtcagaccagctcctggaagcctccaacttctcatcactctccaaatttggggctctcctaaaggatttttcaaggatgagccaggactgttgagatttttcaccttgcaagcctcactagaaggtagctgcttttctaaaggatcatctgtcagcggggctttaaacattcagagatttaaatgtgcagagtctttgacctaataattcttcctccaggaatccatccaaatataatcaccctaatatatacattaacgtttatgcacaaagatgttcactgtagggctatttatactgctaaggaattggaaacagccaaaatgcctaattatagggattaagtaaactgatatccattcattcgacattatattgccattaagaatatttatcaagtatttttaattatatcaggaaaagatcacaatataaagggtttttttaaaataaaacgatcttaaaagcatgtagaaggaaacagtctctatgttaacaatgagactgttggctccctctgggtggtgagatgattatcttccaaatgttgtaatgacctcatgatacttatcacttgggtaaggaggaaggagaaaggaaggaagaagagagctgaggagcagaggaaaaagaaagagacattccttccaatttgggtccaagttcaattaacgtgtaagctgaattaatgtgcagataatgtgtttagcccacattgattaacatgtctcttctagaaagttaaagggcaaacagttctgtagaggagcctgcctggcccataaacaaaagtgtgttggattagatacatgaacttgggatagggagaccagaatgatgatcccagctcttccgtcactggctgcatgacctctagaaagttcctgacctacttgaccctctctttccctatgagaaatgataacaacacacacctcgggtgactcacaaaacacagtcacagcaattactccgccaggttcttaaaaccatgcagtgaagtaggctgggcagcattatctttttgcagaagaaaagccgaggctcagaaaaggacgactgttcccagtctctctgcaagtcagagcagggcagggacagggaaccaggttccagagtctcagtacagggctgccgacgagtggctgtggtccctcagtacagggccgatggcgagtggccttggtcccagcatttcagtgcttatctatgggcccccatggaagggcctgggacatctgactggtcacagccctcccagttggctctgagccaaggtcttcttgcttctggacagggaggggctaccttgagaggaaggcatggtgctgggtgatggcctcgcagtcataggtggaggagtcgctctgtttccgcggcaacggcctcttgggctcctcatcctccaacccactggagatgtcaatgttgcttttgctgagacgcttgctgctggccaggctgcaatcttcctccaccgcgactggggtgtcctttgggaccgaacaggggacaggagagaaaaagactgttgtcacgggagactctggggccttgtctcctccccccaagcacaaaccaaccccttcatcctaagatgtgaggggctacccttcttccaaaagacacaggaagccacattgcaatcatggtaggattttaggcacaggctctctcccgcatccaccgggattgacattcccactgggatgctggatggctgtcgaaggggccaaatccagctctccaggcctcagtttccacacctgtcataataatcccctgctactcttgtagaattatgatacacttcttcttcttcttcttcttttttttcctttttgaaacagagtctccctctgtcacacaggctggagtgcagtggtgcgatcttggctcactgcaaactccacctcctgggttcaagtgattctcgtgcctcagcctcccaagtagctgggattacaggcacccaccaccatgcccggctaatttttgtatttttagtagagatgggatttcaccatgttggccaggctagtctcaaactcctgacctcaggtgatctgcccacctcggcctcccaaagtgctgggattacaggcatgagccactgcgcccagctggattatgatacacttctttgtgacctggatgtcatggtgccaacgtgaagaaccagcactctctccccgaggggcaggccctgctcctatgggcatacccctcccgcggtcctgtcccccggctgtacctgggtgctgctgatgctccccttccggctgctgctggcagggctgtcccctgagggccccgcactgtagcagatggcatcgaaggccaggaggccccccacacagtccccgatgagacacacctggaagagatgcagctgggactgcaggcctgcccactgctgacccctcacccccacacccggccagagcagtgctgcctccccacaggagaatgagaaactcgtccttgggaggtgttgagagagcccaactgggaagcagtgtgcaaactggggagggtcagggttggcgttggcccaggccagcccaaggacggggagtaggctactctcaggggtcagacttgggctagagagcagcatgggctcagaatcagaactcagactgttggcctctgtttttctatctgtaaaatgagggctaactcagagatctcaaaagccacctttgggctcagaggctgattcgagaacagcctggccttggccctttcagtagattccagcctctctcccaggccggggccggaacaggggaggggagaggaggagagggcaggctgtcctacctgcccactgaagccaatcccatcagaggacttcaggaactctctgtagacctggttggctcgctcgatgacggtggcgacagcatcctggtactgcggggaggagatggccaacaggggaagggcggccagagggacgtggtcctggctgctgctgaggcagccctcatcgtggctgtaggggttcaggctgcagacagggggcccaaggtgagcccagccaggatcgggcaggttggcaggtttggggctgaggatcaggcagaagagagcacatactggccaggaattgggctccagggacccttcaggaagacccaggcaggagcctggtgacacagagcacaggcagtgtggggaggagaggggaagaggattcaagcctacactgactccctgtgtgtccttcccgtgctggccatgggtgtgggccctggggtccctgtgactgcagtctctattgccctcttctgcatggccccaaagggcaccccaatcatagaggaagaagtcagctgaggacccagctagtgtggaacatgtaggaacatatcatcatggcagacttcctggaggaggtggggcttgaactaggcctcaagaaaggctttggagaagctgggaaaggaggagagaggacatgccaggcttggggttcacatgttggccacagcttggagctgggcacatagctgcagacatgatgttgtgttcattgcatcactgggagaagatcagagctttcatcagctttgcagaaagttctgtgacccccgagggggctgaaagcctgccccacagtgtccagccagcagactgtccagactttgcattggcaccctcaactccctaccttcccactaggaaatcccctcctctctgggcagctcagactcacctgagaccagtgcctccaagtcacctacccctccctctgcccccatctctgcttctgttccctggggcttccgacccagatgcactgttggacctggctggtcaggaaggaccatacagggaggctgggaactctccacccctgcccagagcctgcccttcccccttagctcaagctcaggctgatggagcccagtgcacatcccactgggactcgacagaatctggggcaggtgacagggctggagcactctcagcaggtggcagagtcctcgtggtgtacaaggctggccctgtcagccattcctcatctccaaagaacacaaattagaggaagcaggcctcgattgcagccggagagattttaattagctgagaaagagctccctcccagccgtgattatggggtgatgaatggccctggcaaggagctgcctgggggagaactaagctccctcccgctggccccatgaatgaatggccaggccatccgtcttcctggagataggggtgacccagctctggaggtcagatgtcctggggacaggtagaggggttcctgagacggatgatgaactagcacagtgaagtcctggactatcagagtgacaagggaacatgctgcgccaccagttcagcagtgagcaggtgtcaaagatgcagattccggggcacctccctcctgaatcagccactgctggagggaggcctggacatctcgcagtttaacaagaatcacaccagggatttgggcaattagccaggttgcggaattacagacctaatcttccttccttccaactctgattgagatctgcctgcaattcctgttggtgtccaaggaacgcagataaatcagagtctctgactttcccccaatctagagggggaaaaggaaggcccagggaagggaaggggcttgcccgtgctctctcctgactggctggaagctccagggcaggggactttggccctccccgcactgagccctcctcagagccacaattggctgagaacatcggctcccattctcctggggaattcggagtgcggtgcgccccacacacctggcaccctgctggggacctcttcccacccttcccagctccggagccccggggtatgagggctctgcctgagggctgggctctgcagcagccccaagtctctggcgaggtcctgtgagggggacaggcagaacagaggtgcagaggcctccctcctgcccctgactgaaagttccaaagcttccagctgccagccccagtgatctgccgaatgcctataggatttgggccctgtaggcgtttgggtcatttttgcacatatgactgctgagaacccaggtatccacccggccccaggcacctacctttagctagttcaacaggataggcaggaggggagcactgcagccctcagtgcctggagcagtgggtggagctcccagaggccccataccctggaggtcccctcagtttgtcccccacaggtgccagggcccacagtgggcaaggatgtgccagcgtcagcagtgagcaagctgcccagcgctcaaccagcccttctgtggacacatccttccctcctttctccccaccagctgggttccctgctgcgagttggaagtctctctccccagcccactctccacctgcagagagagcccctcttccagccaggaggaagatgatgtgagtcatggccagcatccccgaagctggcatccccacagttagtatccccaaggctggcatccccatggctagtatctccaagactagtatccccaaggctggcatccctatggctagtatctccaaggttggcatccccatagctagtatccctgaggctagtatccccatggctagatccccacagctggcatccccaaggctggcatccccaaggtcagcatccccaaggctggcattcccaaggctggcatccctatgtgctttctacattctggacactgtgttgagtgcttcacacacattagcacacagactcttcacagccaccctgagaggttatttactatggctaccttcattgtacagattaggaaattgagacaaggagaagttaaacaccttccccagaccacacagccaggactcaaatccaggcggcctgagagcccacacacttagccgtggtatgcaaacccaaaagtcactcctccaggaagtcctctctggcctttctcagagagcccacagtgccctgtgctctgtgatattatgctccatcagagcactgtgatattatgaggtagatagatcagatgatagatagatagatagatagatagatagatagatagatagataatggatggacagatggatggatggatggacggatggatggatgaatagatagataaacagaatagaatgatagagagagagagagagagagagagagagagagagagagagagagagaatacatagataggttttgtccacagttcctggctcccatagccgttgttataatgttggggcacttagccctaggaaaacagaacctctctctctctctctctctctctctctctctctctctctctctctctctgtctgtctctctctctctctctctctctctgtctctctctctctctctctctgacattctcctgccctccttgagctggctgtgaagaaattctctgatctccgttgtctgatttaggtcatgagaccctcatttcagaaggagtcctgccccatacccaggaggaaggaatgctgcagaggccaagaagaatctgagcagacaggccctgttgggtttcccgacttggtctgagtgtcagcccctttctgtccaaccacatatctatgttgtcaatcatgcctagccaatgacacctccattaaagggccaaaaggacaggagagcttccggagagctgaacgcgtggaggttcctagtggctggcacacctagggaagctccgtgccccttcccccatacctcaccttatgcatctcttcatctgtaacctttataataaaccagtaaatgtgattcagcattttcctgagttctgtgagccgatctagcaattaattgaacccagtgacagggttgtgagaaccccagcttgaagctgggctgtcagcagcacagataaaacaaactggggcatggtatcggtgtcagaagtttggggcagtcttgtgggaccaagctctcaccccgtgggatctgatgctatctccaggtagacagaggcagaattgaattggagggcacccagctggtgtccacagcagaactgattgcttggtgtgtatggaaacagcccctcacatgtggcccggaagtcttctgtgttgactgttatggtgtgagagcaaaggaaaaacaccattcgtgtttttcagattcctacttggctgcaatcgtgtggccgagtttgactcctgtctccatgggctgggcgaccctgggggaaactagctaaactctcaacactccgtgtctttttttttttttgagacagagtctcactctgtctcccaggctggagtgcagtggtgcaatctcggtttactgcaagctccgcctcctgggttcatgccattctcctgcctcagcctcccaagaagctgggactgcaggcgcccgccacctcacctggctaattttttatatttgtagtagagacagggtttcaccatattagccaggatggtcttgatcttctgacctcatgatccgcccacctcagcctcccaaagtgctgggattacaggcgtgagccaccgcacccggccaacactcagtgtctttatctgggccaaacagatcaggcttgttgaacactggaagtggatcaagatttcatggggaccccagcacacccaggcccaggcagaggactcttcccacaccttccaccagggatgcttgtgtttcgtcacgatctgacaccccagagagtccttgcaggtacccacctgcccacggggtccatgctgcagggggagcccctccacttagttcccccaccaaccccaaccagttcaaacaagcagaaatggactcactgagagacaagcgagaaagcctcagagcagatggcaggacaggggacgaacttgatgaggatgtggcccagggcagcagggaaatgggctcgtgtgaccttctccagcacggagctgaaggtgtggatgtcggctgccttgcaggacgggtccccggcacccgtgtccaggatgtttcccccatgcaggaccagcaggaggacatgtgtcttgcaggagcgctgcgggcagccttcctgagagccaaggcggttggaatacagagagagaggcggctggggtcgggggaggcacacagggacacacacacacatgtgcgcatacacacacactcacacacacgcacacacggggagactgaggccagagaagcaggcactatgtccagcctgtctcagctgcaatctgaggagcagtctcagctctaatacaccctgctgtgtgatagaacctctggtgcattcagagtgagggaaggacatgggctgccaggagggatgtcagggcaggaagagtcccaagagatgcttcctgttcatatgggaacccaaagcccagagaaggacacagacccacccagggtcacacagcaagtcagacgaagagctggaagaaaacgaggccgcctatgatccgagggctcttgctaaaatcctggcctctgagttgagcccagacaccctccgaagcccagcctacctcgctgtcttcgtggatctcgatgcttccctgggctgggaacctctgtcttctcaaggaaacccggtacagttctcctgcagagggaaagaggggagctcagcatctccaggcttccctacagtgaccagacactccctgggcccagctggccctaaaggtgagaccttggcttacatcacaggtgagctcaagttagagtctggagctagggagagtcaccccatccaggccctgcctctgaaaccaacacaacatgaaaccctttctcctcataaggaaaagggagggtggcagagtgaggccatcgcggatggtgctcctgaaaggaggggcttcctcgaaaggaactagcctgcgtttcttcaccaggacagcagcaagggtgagtaccacctgaggacttccacttccagttatggacagcgatttgagcaaagcctcccgctgagaacaactagaagagctggtgtgatggcaaagcgtacgcacccactcttgactgggctgagaggtgcccagagagctggtaaaacatgttctctgggtctacctgtgaggtgttttgggaagaggttggcatttgaagcagtgaatgaggcgatctgccctcaccaaggcaggtgggcaccgtgcagtccgtgagggtctgagcagaacaaagtgctgcagggagggaggattcactcttctcaagctcagacttccatctcctgcctcacacatcagcactcccgcttctccggccttaggacttgaactgggattcgtgccattttctcccccggttctctggcctttgggcttgggctggaactacaccacaggctttcctgggcctcccgacttccagacagcaggtcagggaacctctcagcctccatcatcacgaaaccatgcacgaaagccagtccctcataataagtctctttttaattttcttttcttttttttttttttttgatggagtttcactcttgttgcccaggctggagtgcaatggtgcaatctcggctcactgcaacctccgcttcccgggttcaagtgattctcctgcctcagcctcccgagtagctgggattacaggtgtgtgccaccacacctggctaattttgtattttttgtagagacggggtttctccatgttgctcaggctggtctcaaactcctgacctcaagtgatccgcccacctcggcctcccaaagtgctgggattacaggagtgagccaccatgcctggccaataagtctctttttatacatctgtgtatatatcctttcggtcggtttctccgcagaaccctaatatggctggatacatacttaaaaaaaaaatatctgtttgaagttaacagagaaataatagaggcttgaattacgggaccactttccagggaaggtagactcccagagagttaaggtcggcatttgaaacattactggcattgcccatgagctttagggtaaagctggcctttgccagaaatctctccttgctcctctcagcagcctgggctcaacgcctcctccttcaagaagtccttcttggctcccagccctccctgagctctcatttacctaacacagaattcagtaaaccacagccatggaccaaatctgccccactgcctgtttttgtaaataaagttttattggaacacactcaggctccttcatttacatattgtctatggcaggcggcttttgtgctacagcagcagagcagttgcagcagacaccttacagctcacaaagctgaaaatatttattatctggccctttccagaaatgtctgtcaacccctgatctaacacctacactcctgaatgtgatgacactggactcctgggtggagagacttcaaaggcatccaacagccacccctgagcccccacccaaatgatacctgcactctgaggcctccttcctgccaccaggctgccttcagctcctctccttcctcccccatgagatggatgctacctcccgtgtgtggctaaaacctacagccaagctgaaccacctgtttgtcttcagggaggaggaactggctcatctcttaaagtcgtaggttctagatgaagatggtccttgccttcttcacaccccacccccaccagagcctgctgctcccctctaggagtcacatctggggagggtccttccaggggctttgcgggcaaccctaggcaccctgtcaacatcccctcaccatgaccagccccaggggagggtacctctacaaagaactgcaaatgagaagcttttctcagcagggaagagcatttctgaaatattctgtcctcacagacacaatcccagtcaaagggtaactgctttatgagctccgagctactgcccacacagacaggaaatcatttcctaaatgatggaggaagagggaaaactcgtcctggggcccggctgtgcccagcacttcctagttcttcccattggctaggctctcctgcctaatttctaacttactaaagaccttgccttgggcttggctagaggagaccctggctctctcttcaggacaggatgataacacaagacaacagtaacagctcagctttgttaagcacttattatgtcctgggcactatgtgctttacatgattcatcctctctagtccccacaattactctctgagtctgaatgatcttgttattagccccattttacagatgagcaaaccaaggctcaatcaacctatgtcacttgccccacgtaccttaaaggttaaagcccaggtctgccgctgccaggcccctttccaccacgtgaactagtaccaggagggagagggtctgagtgtggcttccctgagacaaagcgctcatgcttcatggtgtgtgcggctgtgtgtgcggctctggggcaggctgtgagtcaagaagaaccaggagtgatggcagggctgaggttggctctagggctgggaggagcgtggttaaagccacggaccctggatccagaacgcctgagttcacatcttggctcttatcagctgtgtgacctgtgtctcagtttcttcatctggaatatggggataataaaagcagctaccccatggggtggtggtgaggatagatgagttcatatgcataaagggcttagagcagggtgtggaacacaggaagtgtcacatgggttagcggctattgttattattatcattatccaggggacatccagggcacagagccaggaccacagctgacaagatgggctgatggggacattgccgcctccacacttgcctgccctggtgccaagtccctccctgagccctggcatgctcctcggccttgctgggctgggcgcctgtttgcagtgtgattacaggattaaatgctgtgattgccacaaattactatggcaaggctataaatacattgcagggaagacatgagggtcctgttgtctcctgggcacgatgccctctgttaggtgggggctggactctgcgccctcacccattacaaaggccaaggagcacctccatctttgatctgtctggagccagctccctcgcgacccatgtgatgctctgggcatcaaatcggtggatgactgctgcatcctggccaccaacgatgttgaggccgtgcctggttccgtggggatgggagcctcaggccagagactgggcaggattgtcctcagtatccctcactcctccctagcaggaggaaagagtctcacctcctacgctgtttggggacagagccttgcttcctttccatgcacaaaagccaggaatgctttgctctgggagatggaggaagggagatctagcctgccagattcagattctggccccttgagagttgactaacaggaccagagcttccccacagaaaggcacacctcccgtcttcatcttagcagaggcccctgtagacaagcaggggcagccgtaggctaccttccctgtaccttccccacaggtctctgctcttctaaaagccagacattcctaccatgataattggggccattggctctgactcacccacaagacataactctttcactcgtccttgcctttgctcatgctgagccctctgcctgcaagcccttcctccctttgcagactggcaaactcctacttgtcctgcaaaaccctgctcaatggctatcacctctagaaagccgtctttgatctatctaggcaaagatggctatcccatagtatgcggcactggtcctggcttactcgtctatttccccatcagactgtgggccccttgagaatagagtttaccagttttcagggactaggatggcacttttgtgaaaaccttttggaagatcccaggatgcacacatcctgtgagacatctctgtgccattaaacccccaggagaaatcaggttcagggaagcatcatccactgagaagcacgttgcttcaaagtactcacaggaactggtacctgggaacctctggggattctagaagagtctggcctgggcttcataattccacccctagaggcttcctcagggactctggtgacaagagcagctggcagggggtcctaaggggtggagagccacataaaggggaccccaggacctcatcattaggctgcctgtttcttcccacttcctgttaatttctgtttgcatgtccctattcaggctgggtccctgcagtgcccagatttggggtgggggagcccacagctgtttttgtgacagtgttttttgacaggctttgagacaggccagctaccgcagtgccagctcccagtgccccactagctccacatcaggagaggtggtccacccagctcaccatggctgctcttgatgcctgaagaatggagcctatgtttgcttaatcacagccttggagaggtacaaatcgtgatcatcccctctaattaccaatgcgccacactgctcttgagacgaaagccaaggtcatcacccacacactcagcaccccaagcaaagcatcaccccagctcggctggagagcatagctgtctccctctctcttgctaccaacctctggggtccacaggggtggatgctgagggcccactggctaaagccaaacactcagtctcctcctccatccttggcagtcactcccaccccccgttagtcacccctggcatcaaccaagcagagctgggcccagcttgagaccatgtggcacatcctgagaagtagctacaaaagtatctaatcctctgtaagctagtggaagctcatacatgggtggaaacataaggtttttttttattttttttttgcctaaaccggcccaggtcaccaggccagggctcttcatcatcctgaaggaggggagtaagaaagggatggtctctttgttcttactaatgcctccacccctcagccctgcctcctcagagagactcttggcagggaggaaaaagtgaggagaggctactatgaggagcaggaacttcttagactgttaggccctttcagtcaagctcattccccatttaaaaagacgttacttgccggggaccgtggctcacgcctgtagtcccagcactttgggggaccaaggcaggcagatcacgaggtcaggagttcgagaccagcctggccaacatggtgaaaccccatctctactaaaaatacaaaaattagctgggcatggtggtgcgcacctgtaatcccagctactcgggaggctgaggcagaagaatcgcttgaacccggcaggcagaggttgcagtgagccgagatcacaccactgcactccagcctggcgacagacagagcgagactccatctcaaaaaaaaaaataaaaagacatgttatgctctgaggatcccctgtcaagtccaccctggccctgcctggaagtcaaaggctttgctattttgctgtgatgtgggattcatccatatacctagatgacatctgggaagaactacagcctcattcagtagcacctgggggactcaatccacagcccccattccccaggtgagcccgcatgacacacacatgcagaaagaaggggacacacacagacttacaggggagacaggccctggatagagtcctcggatgggaaactaaccctctactcagagggtgacctcagacacgctctgcaaaccaccgcaaaaggaggggtttgcctacattccccggtaagagtcaggcagtctgagattctatgagtccaagcataagtgccctctgtgagtgctagcctccagacccagcagaatttggcactaggaccttgaaggggacccagagtcacaatgatggagtcactctgagaggctatggagaaaggaagagcaaccaaaaagctgcaggcggcaaatttcactttgcttttcaaagtggttgattccagctaggggcttggcgttgattcctaggcaagtcctggggcaaattaataaacaaacgctttgaggacccttagaaaaggaagcagtggggccgggcgcagtggctcatgcctataatcccagtactttgggaggctgaggtgggcagatcagttgagctcaggagttcgagaccagcccggccaacctggtgaaaccctgtctactaaaaatacaaaaattagacaggcgtggtggtgggcacgtatttagctgtaatcctagctacctgggagactgaggcaggagaatcacttaaacctgggaggcgggggttgcagtgagccgagatggccccactgcactccagcctaggagacagagcaagactctgtcaccaaaaaaaaaaaagaaagaaagggaaggggaggggaggggagggaaggggaggaaaggggaggggaggagaggaaaggggaggggaggagaggaaaggggagggggaggggaggaaaggggaggggaagggaagggaggggaggggaggggaggcgaggggaggggaggggagcagtggctcccagagctctgataggtactcttggaaccagctcgctaaccctgcatcatagcatgtggcatagatagggtcgctggaccagcagctcaagggaatgccaagggcttaggggcatctggggaggggaacacactggcagaataagaaactatctaaggaacccatagctctcaccacttgagctcaaggaatgtgggctcatgaatgggaacctgcggccacacaagatgtggggaccaacagccagtagcagatgcggatggaacagcgtgaagctgttctgaaggttttaaaacttttttaaaaacaggggaaatttttagccaatgaaagttcccttaggagcccaatttgcaaagatgaaagtggatcggctctggctgaagcaggctggggggcccagagcccaccttcctcactccagcacatccctgtccctaggcagctcctgagggcttcaagagactgaaacttaaaagccactgagcttgttcagcagccagactgcaggccaccctcctctgcaggttcccagctcctagcattgcagaaaaggaaaaatgacaatctaaataatggtgggggaggtgggggaagaagcttggggcctcatattagaaggaaacacactaaaatgtttacagtggttttctctagatgctgggacaatggaatatatatatatatatatataataaagaattaattaagaattaagatcctgtgtttgggttaaaaatgaactagaggggctaggcgccatggctcacaactgtaatatatatatatatatattttactttctactttcatctattttccaatttttctctaaggagtccatatttcttttagtttaaaactatttatgaatgtttattggatagataatacaagtatgtgtcatgtttatgcaaggaactttttttttttttttttgagacagagtctcactctgtcaccaggctggagtgcagtggcgcaatctgggctcactgcaacctccacctcccgggttccagcaattctcttgcctcagcctcctcagtagctgggactacaggcgcccccccaccatgcccagctaatttttgtatttttagtaaagacggggcttcaccatgttggccaggatggtctcgatctcttgaccttgtgatctgcccacctcagcctcccaaagtgctgggtttacagacatgagccactgtgcccagcctatgcaagaacattttaaaaccagccacaacctcctattttagtcaatacaaacactacaaagaaaaaagtgtgaaatgttgtcctcccctcaggagctgacaggctaatgagggagtataaaaggataagaaatgcttgtggaaggaaagaataaatgtggaacatgatgagtgaattaagatcctgtgtttgggttaaaaatgaactcgaggctaggcgccatggctcacacctataatcccagcactttgggaggccaaggtgggtggatcagttgaggtcaggagttcaagaccagcctggccaacatggtgaaaccccgtctctactaaaaatacaaaaattagttgggcatggtggcgggtgcctgtaatcccagctacttgggaggctgaggcaggaggattgcttgaactcggcaggtggaggttgcagtgaacagagatcctgctgttgcactccatcctgggcaataagagtgaaaccctatctcaaaaaataaaataataaaataaaataaaaataaagtaagccttccaaggacttaaaaaaaaaaaacaatgaactcaataccacttgcctattcccaccctattggttattgcccaaacttgtgtcaaggctgaaaacaccaagaccaatcagacacagcatctgccttcaaagatctctcaagcccctgggatcacatgaccaagagtaggtcatgtgaccaaggtcgggtcaatgacaaagacctaggtcatgtgcccaagatcagtcacatgaccaaaggctacaaacagcttgagtcagggtagtggggctgccacagttacttctcaacctctaaggctgcacaaaccagagatctcagttcaaaatgagagggagacatccctgccctgcccctgcagctcaggccctgctgagggtatgtctgatgcccaataacagagcaggaaagctatagaaaggggctcaggaggttgagagacccagcctggagaagagcagcagctgcctgcaaatctatgctgagcctcgtgtgggtcaagggagcagagggcaaagccaggacaaataagggttggggtggtttctggagagccattccaagttttagcacaacctaggaaatgtttacaacagttcaagagtgacctgtgctgacctgcaagcaggctgttctccttcactgaggttagacaagcaagttatataagtgaccacgtagcagggtgctggggagggaagtttcatccagagtctgggggagctggtggctgaggtccctccatgactccttaacgctttcagggtcagaatctaatcacgtccacctggattcatctgactaaccaggctaaggtgatgtgttcaaaccttcaacggcccagtgagcctttcacagagacactaccccagaccagggcctggcccttgcgagggcctatgccctaaaccctgccccttgagaacatgttgttagataccccaagtgaacacggggttagttcggaggaacagttctcatgggggatcccagttcagatcagaggtgccatcctgaatcgggcccagtgaaatttccaggtatacaaccatgagaaaactctgccaccacgacacagggatgctagagggacatgaaatcccaaaccctggtgttcccctacagactcctttgcaacaaacacagccctaagactggtcctgagtttctagtcctcatccggtgtctcaggcaatcttcacattcatcctgtgaggtcaggagtactctccccatcttaaagatgagaaaaccaaggattggaaaggtaaagtgatttctctcaagatgtaagtggagggctgggtacttgaacccaggtcaccaggtcagggctcttcatcgtcctgaaggaggggagtaagaaaggaatggtctctttgctcttactaatcccttcacgccacagccctgcctcctcagggagactcttggcagggaagaaagagtgggaagaggctactcatagcaggaacttcttaggctgttagcctgaccccctaatgatcccctgtcaagtccaccctggccctgcctggaacagcacatacacaaaggaatgcagtggcacactccagcccatgcgcacctgcacagtaacccctgccaagtgtgtgcggcatccagcacagggcctaggaatggctctcacacataggaaaaaggtgctcaaccttagaaccctaaactagaggaaggctcattgaaattaccctaagacaacttttttttttccacctgtcagactggcagttgtgacacactatgggccagggtgtggaaaaacgatctcttcattcattgctggtgagagtaaacatcagtatagcctctgtgaagggccatttggcaatgtcattcaacatgcaaaatgcctttgacccagcaattccaagcccatgtgcaaaaggacatatgtacagtgctaaccattgccacattgcttttacaacagcaaaagacaggaagcacctatatgtccaccagtaggggacagattaaataaattggaccacagtgaaattgcacatgcccattgcaaaaaacaactcacctctaagcatactgagctaaggagacaatcatgatctagtatcaacatctgagaaaagcaaggtgcacaaagaaaggaactgtgtgctcccatctgtgtgagggtatagatataaaaatatatataaatgcatatttatggatagactcttgtatgcagagattatctctgaaatggaatctaagaagccagttataatcttttcttctagggagaattgtgtgcgctggaagacaggagagggaggcattttataccatgtatatgtgctacctactcaaaagacagattaaaaataagaatttttctaagtgcatgtagcagggtggtttttttttagataccaatttatatcttctcccagctctggctcctttgcctctgggaaggtttgtggcagagcttcctggcttttgtttccaaaagctcttttgttcccaagaggaaaggatttggagacagagaatgcttcagggtgaaaagagatcctcacaccctggccctgggtggaggagagagtcttctatacgggtcccttcgcaactccaggaagatggagaacaacataagaagacctggccatcccatgctccagagagcgtgaacccttgcagccaggagctgcaagcccaggacaaaagggaccaccaggctgggttctggggtcctcgtgctcaccgctgtggacgaaggaccccttgcacatgtgtgcatgctgcaggcacccttcccccaccagagtgctgggaagacccctggagttttgaggcgatggcaggagagggaggaaagagaagctcctggacacacagaggaggaggagtccttcaccagcacagctgcaagggaatgtacagtcaaaatcaaagtggcttacagaaaaacaaaggaaagggcgattcttccacgtggaagtaagtagactgtgcagtgaggtctctctttgcccctccagagcctcagtgccccatctctgcccgactcagcccgaggccgaggccccctagctacaggttgggtgtagcgatggaaagcaccagtaggagaactggggcaagggagccccctccatgccgggtcatcgtaaggtggtctctgctgaaggctcatgcaggagcctctctgggctcttctccttcaggggtgggaacaaccccagggtattgctgatgccttcttggtttccttaaagcctcactcacctgtgaataaagtctctctgctaagccctcctcccacctgtggtttgtgtgagccttccgtttcctgctagaaccctgactgcatcacgggctggatcctaagtgctctatgcaaatcccatcacctcctcccacaccacccctctccaggcttctcttatcctgaccaagcccccgccttctgctccgctctcccacactcgcccctccctctctgaactcagccagttttcgcacatcccctttccctctcactgcagagtcccagcaaatgttccccgggcctgggctcttctctccactgccccgtgaccagataattcccacaggaacctcagtgttccttccttccgggggccttccactcttcctgtcctctccacaaaagcgccacggtcctctctttcctggggttaatcctcacgcttttcattttatgactatttgattattatcttcccctcctccgtctcccagatgacaagatccttaagggctgggactgggtttgattttgctctattttatccccaaagactatcatgatgttggcatataaaggtgctcattaaatattttttaaacagatgggtgaatgaactaatcatttgttcccattttgcacccctataagtgtcggaagctgcacgtgccccagcaaagcccagatgctatgtagatagacttgtatatgcgcacagagacgcacactcatcctcatgaaagtgaatgcaccaatgcattggcatagaggctaatgcacatcctcatgaaagtgaatgcaccaatgcgttggcatagaggctaatgcacacatacaagtgcaagggcacacacacacaaacgagaaggaacgatgccaagcagagacacacacacacatgcaagaaaagtgctcccaaggcggacgtctgccaccctgagctcattaaagctggctaaatatagcctgtctgcagctgtgctcagcaagctgcccacacaggccaggaaaagacaccagttaccaggcagaggagtggagaggccagccgtgggcaaggggcttcacgcatcctgtctgtggtggggggtcttcctggggaggccaggggctgagggtatgtgggaagggaagcccttcggtggctggtcagggcattcagagctgttcctctggtcactgaccctaggcagtggggtgcgaagtcaaaccacatgcccacgatggggagaggtgagctgagccatctacatctctctgcatctgagccgaggacccaagctcagtccaggaccaggggctggagttaggacccagctggggataaattggggctcagttggtggctaggagagaggctcagtagaggatgaagataaagggtcagactgggactagggttgggactctgtggaccattgccaggtctttttctggggacaagaggaagttcacagccccacagagcatctgctctaatgtgtggacgtggctgtgggaagaccctccccgcacgtgggacagctgcctgcggccctcacccctgcagctgatgccaggcgctggctctggaaaagccatgagacgaccagcatggctttgggtcacatgtgtcaggtggctgttgtcatccacacaggcagggtccaacttcaagggccacaatagacaggtcttcctgctgtagaatctgccccccaacccatcctgcatgggggtggggcagagggaggctcctctcaactcgcactttcccagcctgtgcactgcggagccctgcccctcgtggagctgctgagactggaagggagaggcatggagcgggtgaggcagccgcaggtctcctgggagaatgtcatgcctcctcccaccggacgttcctggatgggggcgtgggcagaggaaggggagttactgcccctttgagacaacagctctaccctttgcctcttctatggtggtggcatattgcagcaggaggggtgagccgggcttgctggattcagcacgtgtgagcccagcagccatgaatggagccacaagggcagaggccaacagtgcggggtccagagggaccctggtccttcccaccatttgctgcagaggaactgcttctgtctcctccgcagagatggatggtatgctcaggcttcccaattagcccacaagaaaactgtgcttagagagtccacgctcctcccagagctagcctggggaaacgggagagctgacaggaagaggggaaagtggtcgggtaaggttgtatggaggcaaggttcacgcttcattcgagaggatccatgggagagaaagcaggggctgtgagaaccagcctttcctcctccaaaggtctctctgacacgctgaagggaggatcagagtgggtgagatgggaagcaggaaggcagggaggccgggaggcagggaggcagggacgccagtgcacaggaggatgcaatggtccaggagagagaagatagggcctcaactagagaagggatggggacagggaggagtgggtgggtctcatagcactgctggaggttgaatgacactagcagaggctgatttgatagtggatggtgacagagacagagaagtctagaaggtttctggcttggattcatggaggatggtgccattcacactggatggaagcacagaaagagtgaggttcaatggaaacatacaagatccctgagtccctacagccagcaccatggcaggtatagtgggagcactccggaaatggtcactgtgctaactaacggagcagcatgaacaaggcagaaacagaaagaggcacagacagaggaagccaggggacagagaggtggcaacagaagaccccgagaatgtcagaaccaggagggactccatgaacagacagatggggccccaggcacgagctgagactgcacagcaactcggcagtaggtcacccaggtctcctcccccaagtccaaggccctctctcttctctggacccccaccaagcccccacacacaatggttcccttggcttcctctagtttggtttcaaatatcaggctcacgccagtgacagcaggctgccaggctgccaggccgcctgcccaactgcacaatgaaggctggggctgcctggcagccacaaaggagaaagtctccaagacacccctccccgcatagccactgcagacaagcccttgcaacctcatacctgcgcatgcctgagaggcccatggagacctccctccccacacttgcaacccaagaggccctgtgctgtctggctggctcatgtcctcctctctggggactccaactcttggggaaacactgctgtgacaatggcaactgaggcagccgcaggaccagtagagcgccagaaagactgagccccacttgataagattcatcatcacatggggaccaggtgttccagcttccaaggcacatccgtccagtaacaagtgacaaccatcagaactttctatccagcctgtgcggatcctagtatctcacagatatcatctctggtgccctcagcaactctaagaagtagatgatatggccatcttttcttttatttatttatttatttatttatttatattttattttatttctgaggcagagtctcactctgttgccaggctggagtgcagtggcacaatctcggctcactgcaacttccacctcctgggttcaagcgattttcctgcctcagcctcccaagtagctgggattacaggcgcatgccaccatgcccagctaattttttgtattttagtagagatgcggcttcaccgtgttccccaggctggtctcgaactcctgagctcaggcaatctgcctgcctcggtctgccaaagtgctgggactacaggcatgagccaccgcacctggcacgacagtatggtcatctttccacaactgagtaaactgaggctgagagacatcaagtaacttgtccaaaatgtcacagctactagacgagagaagctgagtgtcaaacccaggcctttccaaacctgcaaccccagacaccatcacaccagtcccagcatgttctgactcctggttccagggcaacttttaccacctcgcaatttgtttttagtgagttttcaaaaatccagtggaactattaaataaagtatacttgcatgcaaattgtcttatgtggaaaagcgccattataaatgcaagccattgcgattcttcttgttttaattcaggtcacagattttttcttctgccaattttgcattaaaaataaacacattaccatcgatcgtcaccatcatttcataaaagaaaaagcattttaatgccaaaactgggcaggacataattgtagaattatgtgaaaaggagtcctctcaattgaatgcactcaacattatggaaaaatacatcacagtattattgtttttctcactgctgaaaatcttgggttcatttgggcatccccaacctagacaacctccaaggtaccatttcagctccaaaattcatctgcacatacgctgtcattctttgctaaataagaacactctttttttttttttgagatggagtctcactctgttgcccaggctggagtgcaatggcataatcttggctcactgcaacctctgcctcctgggttcaagcaattcttctgcctcagcctccccagtagctgggatttcaagcatgcaccatcacacctggctaatttttgtatttttagtagagacaggttttcactatattggtcaggctggtctggatctcctgacctcaggtgatccacccacctcagcctcccaaagtgctggaattacaggtgtgagccaccacgcccagcccaataagaacattcttaaggagcagaatttgatgacagccttcagcaatagaattctaactacttaaacacacatttttcttcagccaggtccagaggtcactaaacatctcatcaattcaattgtgtctgtggaaaacagagctgtggtttggcatcccggagacaagccccatgtcgggtggctgtttttgcttcggggctgccgctgtctcctctggccaggtgctcagaaggggagatgattggttcttttcctcttctgcattcctggggaatggggtgacacccctatattcatcatgcttgttattttataatgttttgacatctctggggcctcgctggccaggaagagactgcccctcccagagctggctaattcctagaggtaataacaactccctttgagggcacctttcataggcaaatgaaccaggcccaaacccatatccccaaccaccttctctaactctcacccaccaagccaatacttccctggccctaaatcaacccaaggccagctaccaggcaacgggacaccagccctagagcctagagcccagagccctcgacatgcaaatcagccagccctgcatggttctcctgctctgccctgcctttccagagaaaaaaccaacaagggctctgggccttgcagctttggggggctcagtccactctgcccaccacctccctgggctcaggtctgcagccactctgcaagctcttccatacctcagttgctattttctgaggtggaggcgcctgtgacaccagccttcctatggcctggaatccagccttgagttggattcctggcccttctgtctcctgaccaaaccaagtgcttcccccgtggccttgcatggtgtggaatggccccatctctcaaaacctgagctgaaaatgttttgatgacatgagcctctccacatgctcagtcacctctacactaaagacccacaggtaattttaacacattccccttgtgctgagctcagttccttacacccctacgagtgctcaggaaagagaactgccctctctctgccctgccctttccatggcctgatgcccttatggcctgagccttggggtgcccctgacaaaggcattcacacttaccagcccctgaagggctttgtctatgaaattgccattgaatgctagaagcagaaaaaggttctccatgtagggtgtggtggctcacgcctaaaatcccagaattttgggagaccaaggcgggcagatcacctgaggtcaggagttcaagagtagtagcccggccaacatggcaaaaccccatctctaccaaaaacacaaaaattacccgggcatggtggccggcgcctgtaatcccagccactcaggaggctgaggcgggagaatgatttgagcccgggaagctcaagaggttgtagtgagccgagatcgtgccattgcgctccagcctgggtgacagagcaagactctgtctcaagaaaaaaaaaagagaaagattctctggcaggggatgcctgtgcagccactcaaggctgggttccaggccataggaaggctggtgtcataggtccttccacctcagcacagcaactgaaggatggaagagcttgcagagcagccacaggcctgagctcagggaggtggtgggcagagtggactgggtcccccaaagctgcaaccatagatcaaaggagcaggagagagaagtcaggaaagttctgagcacaaccccaccccaaacacacatggagtcctctcctgacccagccacatatggaagtcaatactgccaacagcaaagacatttggcccagacattggccaccgagtcctcccagaacatccaaggaagatgtcctgaggtcactatgtcagcaaatggccacatctcgaccaggtctttcccaggtccaatgctgtgctcatctctctgagaaaacacagggggaaggaaacctggagacgcctgtataacacagaggacagggactcagccacagggccatgggctctgcagagaggtagcctcttcgtggagcaatactgaggatcatcaccccgggcacatccaggaatgaagtgtctctgaacctcattcagtcatgtcagtcaccatggcaccgtcagtggttcctggaagttgtgtcacccaaaagtgatgggcacaggggccatgttccccatccccgtcctcctctctctgtcctcatgccatgatctcagctgctctgctgagctcacactcccaacccaccagcctcccacccctcactctggccctgtggagtccccagagagggggacatgagctggcctgagctgcccagtgataggaactcaggaacccgaggaggctcagttcatgggttagagagggcccaaactcaggctgagtgaccccaggccctccggtactgcctgcaggcaagatggcagggatcctgccatcctttcaggctctgagtggatgagaggggacccaggctcaatgagcttgcacccatccaaggggaagaaatgaccccacagggtcaggcttgactcacgctgcttctcctggaggatgctggatgtgcacggcgcggtcccttctcctgcagaaaaagaaaagaaacatgagcagatccttgacactgttgccaggcactgtgtttcccagggaggctgcttggagctgcctctgaccctcactctagagcttgggatgggcagaagtatctcctaccacttcatgccctgctctgccctgacctgacctagcccttggcccttcatgccacacctgatgccatttctggggagagtacggcctggctcctctgcctcctcaggcgttttcacctctgtcttgtcctccagctcctcctctcctccctcctctataaagcagcggcttcccaggagctgcctgcctctctatactcactctctcctctgagggtccacactgaactccaagcccacaaaccactgccagggctctgcctctggcccaggcctctccccttagctctggatctgcatatcccactgccccccagacgtcttctgtggccactcccaaacactgcacactccccatgaccaaagcttccctagaagtctgcggcccctcccaaaatgtgtctgtggcttcctctagggccccaggtctctgaggaaggtttccaaggcagaaagcgaagtcacctcctggtctccccaagggactcgagaatccttccccatgcaaagctacctcatttcttcccctacagaactgaagggcaactccagtctaagaacctcctccatctccacagcccacactccagggcctggtagatgactcctctcctgaccccatgcctgcctctcacaaccccgtgcctgcctctcacatgaaacttctccaggtgttcatcagaatgaacttctccaggtgttctccagatggattcattagaatccatcaccctgtttctgtagccctctgcctgccagggccatcttcatggcccacgtcccctgaatcctggggtcatggcccccgggctctctcaaaagcaggcaggggtaaacaatgggaagagtgtccagctggaatctggaggctgactccattttaggctccctctggcctgctgtgtgatgtaaggcacagcactctccctctctgggttcattcctacaagatagcacggatccagtgctcgctaagaacctccaggtcctgaaagcccttgagtgacactgcattataattggatacctggattcaaatgccagcttcttcacttacgaaccatgcacccttgggcaagttacacaacctgtatatgcctcaatcttccaatctataaaatggggatagtactggtacttgcctcggagggttactgtggatattaaatgattaatatatgtaaagccggctaggcacggtggctcatgcctgtaatcccagcactttgggagacagaggtgggcggatcacctgaggtcaggggtttgagaccagcctggccaacatggtggaaccctgtctctactaaaatacaaaaactagccaggcgtggtggcgcatatctataatcccgaagctactcgggaggctgaggcaggagaattgcttgaacccaggaggtggaggttgcagtgagccgagatcacgccactgcactccagcctgggtgacagaatgagactccgtctccaaaaaagaagacaaataaaatatatatatatatatatatgtaaagccttcagaacacagtcaggcacaaaacaggtgttcaataagtgaggatggctctgattcttgttttatttacttgtttacttctaaccattgattcaagaccttgtcccttttgtcttcatcatgatcccaggtgcagccagatagagacaatcaatggttaatgctagatgccagctcacagcactccctagacctaggggccgtgacaaagcctaggcccaagaggggcccagatagagaacagagacctggacaccgtcatagagcagtccccacacagcacaataggatggacgcagactgtttcccaggtgcaacagcagcacagatgtggacagaaacaaggaatgacccagtatccaatacacaggtcagggagcgaagaccagcaccatgtctgagcaccagctaaggcccatgaaactctggcgtccctaagaagtcaactttgaccacccagcagagctggggcctagcagagaaattaagacataagacatgcattcaaaaaacgccttctatgggccaagccccatgctaggggccatggaggatacagagatgaggaagtcagagtgagtgaggagcaagaacacctctgtgcagagaagcacacggctaactgcaatgagaggcgagaccggcggggagagacggggagggaaagattcattctgactgaggactccaaggaagcttgtgccagagcagagatttcagttttgacagtagaggaaagggcatggcattccaagcagccagcaagatcatgtttatggaatgccaagttcaaggcaaagcgggggtgtgagagagcatggtcccatttacagataagaaggaaggaaggcaggaagcccatttacagataagaaaaccaaggcctgaagaggtgaaggagcttgcagactcttccaaatccaaacctcctgctttttctatcatactccaccaaaaccagctgcataatgaggaaggcctcatgcaaaaaggaaatgccgggtcccttgttcaaacagaaaaaaaaaatgttgctaaaggtactaaaatataacatttttccttttccctgaggatgctctaaaacctgttatggtgttttctttctttctctccttccttccttcctttctattcttttcttttcctttctctctttttttttttttgacagagtctcattctgtcaccaggctggagtgcaatggtgcgatttcggctcactgtaacctccgcctcccaggttcaagcgattctcctgcctcagcctcccaagtagctgggactacaggcacccgccaccacacccggctaatttttgtatttttagtaaagatggggttttaccatgttggccaagatggtctcagtctcttgacctggtgatctgcccacctcggcctcccaaagggctgggattacaggcgtgagccaccgcgcccggccagtgttttctatttgctactgtatttcctcatgcccagggagacttgagggatgagtgcaggccctcccaggccccagggtccctgctccttagcttggcacgtacacacaggctccaccagcacccaggatccccctcctgccagccactgggccaaacaaaccatgctgtgagtgacagttggaaagttgagccaagcatgcacccctcccacaggcctgctggccccatccagggtagacaagagtattgcaacctccatgctgaaacgcactagttgagtgagaggttttttccctctgaatcacccttggaatgctctatggcactgccagcccagggtggggacagctgcctcgccccaagacatggtggagtataagcacctaacctcagccctgcctgctcccaggctctggcttggagggaggccagcggctgtccatgggcaggggaaggagaagaaagctgggtgggggtggggctgagaagccagagggcaggagagcagcaggccaagatcccaggaggcttcaaggcggcaggaggcaggaccatgtgagagccgcccaccaagtacccccacacatatgcactgtcccgtcagacttcactcacaaaacacaaacttggccgggcatggtggctcacgcctgtaaacttagcactttgggaggccaaggtgggtggaccacctgaggtcaggagtttgagaccagcctggccaacatggtgaaaccccgtctctactaaaaatacaaaaattagctgggcgtggtggcgcatgcctgtaatcccagctactagggaggctgaggcaggagaatcacttgaacccaggaggcaggggtagcagtgagccgagatagtgccactgcactccagcctgggcaacggagtgagactccatttaaaaaaaaaaacaaaacacaaaaacacagacttgaagataacaccattcggacttcagaacagcaaacccaatacctgcagccctctggagcactggccctgagccctgactataacacagacacttctggcatttctcgggcatctactatgtgtcaggccctggaggaggggaggactccagcgcagggaggagccgggtctgagtcattacctccacattctcatgccaagtccatagtcggtactcacggagacagtttatgagttctccagaccatccaatactttcattaccagggtgtaaatatgacttagcctgggcaggatgtccagaggtggggaggtgggaaagttggggaggtgggcaaggatgagagctggggttgctgggaatgctggggatgcagctggggttgctgggaatgctggggatgcagctggggttgctgggaatgctggggttgctggggttgctggggatgcagctggggttgctgggaatgcagagttcagaggccggaagaagctcggggacccaggtgccaagaggccaggaggtgagtgtcctggaaacgccagtgcgcaagcttcacgtgggtaagaagagggaaaatgtcagaaaggaggtcgggaccaagctctgggactcctcaaagccagccctgagtgcggcctcagctgcataagccttgaaggctgcacctgggcacgcaggtgctttctggcttgcctagtgctttcccgcacatgaaatcgttggcttccatgcctatgcaataaggctgctgagcctcagcgaggtaaagtcacttccccaacgttgagatctggtcccttggacaccccaatactgggaagggctcttcccacaatttcaccccgcctcctattggtcgggggcttcctagagcagtggcttcccaggacggctcaggcagcctgggtagtgcttcctggaggaggaaggcatgggacagcgaaaggctgccacagtcaggggctgaggggtgaggaggacgggagcagagaaggggacatttgcaaggggtgcagagaggatgcgtccagaggcttggggactggctggtgtttgcctcgggcttcgtctctcctgcagcgcagcctgagccaggcatcccagggttcccagggctggtgaggccaccgacggggtcaggaataagcctgctgtttgatgaggtaagtgtggcgcccggacagtaggaagccgggcttgcctgcccagtccaagccagctccatcttccctggaaaccgccagcgagggaggagccggcttgaacctggcttcctgatttagcaggctcccaggacgagggtgattaaccaactgtgcagctggctcagctgccacctaaatgagaccccacttagcctagagctttgcaaggctcatgggcctgacagctttgcctctgctggagcttgtttcaagtggaggagctgccagaaactcctgcagacaggatgggctacaaggaactgggaaggcagagttttgtcatgcaccccaggctctgggccccaccaatcttgcctgtcctgaactcacacagccctggaaggctgagccacatcatcttttctgagaagatgcttctgagtcccgctaacggtttcctgagtgattttataactcttcttccaatcccctcccaacaaatcatgagttccccaagtgcaagagaagcaaagtgtgtggccaagaacagcaaagtgtgtggcaaacttctgaaacaggagagccttcctgcatcacactggagagttggtggctgcggagagagtgattcagacagacggggccttggagaataaagaattgggaattctcctgataaaccagaaagtgtcaggaacagcccctctggagcagagacaggagccgctgaagccggaatttgccctgggctctccccttactgggcattgggagccctggccaggctccgggccagactggtggctttgctcatgaagcctggctgaggagcgaagacctgcatgctccctccctgctcaggccactcccaacatggagcctcccctgcatgctcctccctgctcaggccactcccagcatggagcctcccctgagctgcaggttgagactcacgctcattacccttcacctggcccagcgtaagcccctgcactcattccccggcccctcctgttctcctccacattggcttctagaataatctttctaaaaagtggctctccgctcccctgcttaaaccattcagtggatccacaggggcactcccaagaaggcccctaactcctcagcctggcattcaaggccttcatctccagcttttccacccctgcctcttttccaagacctcccacccctttttaccaccccctagctccacacctcacccccagcccaatgctccacaccccaacctcagacaggacaaactccccaaatctccattcttcccataccttttattctacgtctttcccatgtcttttatttcatccgtatggtatgttacatcgattgattttcacatactgaataactttgccttcctgggctaaattccgcttagtccttgacaaatcttgtcatctcactattcttttatgcttggggtttttatatctcttccaggacaatttatactaacaatctatgagctgtcatttaaggaatgacaacctcatagattgtccaacctcagtcaagacaaactctccaaatctccctgcttcccacacctccctccgtacctttgtccctgcagctccctctgccctcactggtctgtcccaaccccagcaaagcctccttacctcctcatgtggcagctccagcgctacctcctctttcagccctctgtgccttgttccccatcttgttagagcaattagctcactggactgtcactgccccacccccgtctgggagccggtcaattctgagtccacttctgagtcatctgtgtgtcccctgcagtgaccagcacagggtctgacacagagtaagtgtccattcctgtgcattgcatgcataagtgagggaaggaatgtatgagtgcacagtgagcccctcaccactttgggctcagacagggaggaaagggacacacccagaaaagcacagctgtcagcagagtggtccgtgctacagacaagagaccaactcagctgtgctgggcatgaggacagtggtctgggagaggctggagtatcaaggaggcttcccagaggcagcgcatgggattgtgggagctagagatgaagtcaggggaagagccggggcaaaggcaggaagctgacgagctccgcatgagcccagggatctctctgcaagcagccccctggccatttgactaggagacagtgggggtggaagaggaggggagggatggccaggaagccatgaatatcagaatcagagataaccttggtattactgggtttagcaacaatttgacagcccctttatgtccctcatggtagctctcccagggctgtttgattcctgtagtgataggaaacttactaactctggaaatttatgattgctagaaggaaggctggaaccacattgtggatggccttcggtgccaggttgggggatctatacttcatactgcagtcaacaaagacctacttgccaatttcgtggcagaatgataggactggatttctattttagaagtgtcgtggtaggattggataaagatggtaaactgactacacgatctagtctttttctcctcctccagatccctagaaaatgacatcaagcatttttatgtgaattaatctttagtagcactgtaaaataagaagtgtccttagcagaccagaaactgtgtggcatccccaaaagttagaaggcagagagatctaaggagggaggcaggactggttacataattttcagggcccagtgtaaaatgaaaatgtgggtccctttgttcaaactaattaaaaatttcaagatggcgacagtagagtagaaaatcaagtgtgtggagccttgtgtgactgcaaaggacaaatgctcacaaggctagcccaggagaaagaaaaccataacctcaagcctgcaaagaaaggtctgtggcttggccaggcacagtggctcacgcctgtagtcccagcacttagggaggccgaggtgggtggatcatgaggtcaggagtttgagaccaacctggccaacatagtgaaaccccatctctactaaaaatatttaaaaaattagccatggggggcaggagaatcacttgaacccaggaggtggaggtttcaaggaactgagatcacaccactgcactccagcctgggcgacagagcgagactccatctcaaaaaagaaaggtctgtggccagtgatggaggcagcacagaaggaacagcaggcttatgggtgaaaaatacagaagcaaagaaagctcttgtgatcgattgtctgggcttccatagcagaggagccaggtgtcttggtcctcccccaacccctgcttatgccaagcaaagcatctgtcccaaagtgtgagaaaggatgagtgtttgaaggacaggacaccatggaaagctgaaaatacccaagaggaataaaacagaagcaactggctcaactcacaccagtgacattttctaccttctccaataattcgatgacagcaggtttcagtaaacagacatattcctatcactcagagatagataggctgacagggaactgcaaacacaaactggcatgtgcacaaatattagtaaatattagataaaagccaacaatgtggaaggaagatgtccaactcagtgactgaagggaagagggaattggacctgtggagtccttaaaccaacttagtgtcatggtcattagtggctctcaaattttagtgcatcggaatcacaggactagttaaaatgtggattctgagccccgctcccagagtttggctgattcagtaggtctaggggtctagaaatgtgacccccaaagtcacatttctaaccagttcccaagagatgttaatgctgttagtccagggaccactctttgagaagcgtgtattgagatacaaggtcataaaccagagtcagggggtgaatggtaggaaaaaatagctctctggaatgctagaggcagagaaattaatcagggatacccaggcagtgactgcttccttcctgtcaacaagaacgtggccttgctgacactgtttgttttaagaacaagaagaacctagattgtaaatcattccttaaatgatagctcatagattgttagtatacattatcctagaagagatatataaaccccaagcataaaagaatagtgagataacaagttttgtcaaggactgagtggaatttatcccaggaatgcaaagttattcagtatgtgaaaatcaatcgatgtaacgtaccatattgatagaataaaagacaaaaaccacatgaacatctcaatacatgtctgcaaaaaaaaaaaaaatcctgcaaaatccaacacccttttatggtaaaaaatacattcaacaaactagaaataggagggaacttcatcaactagatgaaggacaacaacaaaagattcatagttaacatcatatttaatggtaaaagactgaaaaccttccccctaagatcaggaataaaacaagatgtctgctctcatcacttctattcaatattatgttggagactctagttaaggaaattagataagaaaaggaaataaaagctatccagattggaaagggaaaagtaaaactacctattcaaagacgatgtaatcctatgcatagaaagtactaaagaatccccccaaaaataaaactaaaaaatgagttcagcaaggttgcaatatagaggatcaatatacaaaactcaattatatttcaacacacttgcaataaacagtctgaaaatgaaattaagaaaacaatttcagttacattagcatcaaaaagactaaaatacttaggaataaagttaacaaaacaggtgcaagacttgtacactgaaaactttaaaacatcattgaaagaaagaagacttacataaatgtaaagacatctcacgttcatggattggaactaatattgttaagatgacaatactcctcaaattgatctacagagtcaacacaatccctatcaaaatccccactggcatttttgcagaaatcgacctaaaattcatatggaagtgcaagaagcacagaatagctaaacaatcttgcaaaagaagaacaaagctagtggacccccacttcctgatttcaaacttactgcaggtgtacagtaatcaagactgtgtggcatattaacatatacacctgagtggaatagaactaggagtccagaaataaacccatatgtctatgatctattgatttttgacaaacctgcctaaacaattcaatggatgagagatagtcttttcaataaatggtgccgggaaaactagttaatcacactcaaaagaactcctagctcacaccatacacaaaaattaattcaaagtgaataaaagacctaaatataagagttaaaactataaaactttacaaagaaaacatgggggtaaatcttcatgaccttggattgggcaatggtttcttacatatggcaccaaaaggacagacaataaaagaaaaaatagataaaccaaacttcaacaaaattttaagatttagtactccaaaagacattatcaaaaaaaaaaagtataaagacaacccacaaaatgggagaaagcatatctgataagggtctggtgtccagaattcattaaagaactcttacaactcaacaataaaaagacaacccaaattttaaatgggcaaaggatttcagtagacatttccccaaaggagataaacaaacgatgaataagcacacgaaaagatgctcaacatcattagtcattagagaaatgaagatcaaaaccgcaatgagacatcacttcacacctgctaggatggctatatccaaaaaggcagccagtaacaagtgttggcaaggatgcagagaaattggaacctttttacattactggtggaaatgtaaagtggggcagctactttggaaatgaatttggcagctcttcaaaaagttaaacagaattaccatatgatatagcaattccactcctatgtatatcagcaagataattgaaaacatatccacacaaaaacttgcatatgaatacttatagcagcattattcataatagccaaaaagtagaaacaactcacatgtccatcaactgggataaatgagacatggcatatccatacaatggagtaatattcagccataaaacaaaatgaagcactgacttatgctacaacgtggatgaatcccaaaaacattatgttaagggaaagtagtcacacacaaaaggctatatattgtttgattccatttatatgaaataccaggggctgggagaaggggaatggggagtgactgctaatgggtatggggtttcttttttcagaaatgaaaatgttcttgggccgggcatggtggctcatgcctgtaatcccagcactttgggagaccgaggtgggcggatcacttgaggtcaggagttcaagaccagcctggccaacatagtgaaaccctgtctctactaaaaaaatacaaaaattagccagacctggtggcgggcacctgtaatcccagctacttgggaggctgaggtcagagaatcgcttgaacccgggtggcagaggttgcagtgagccgaggttgcaccattgcactccagcccgggcaacagagtgagactccatctcaaaaaaaaaaaaaaaaaaagaaagaaagaaaagaaaaaatattattgagctagataatggtgatagttgcatcccttcatgaatatactaaaaccacactgaattgtacattttacaaaaaggtgggttttatggtatgggaattatatctcaacttctaaaaaagaatttggcaagacctgcttcacttgaatagtgttaatggcagctgtgtgcctccttagatcattcaaatcaagatgtctcctgctctgtgttgtaatctcacctatgatctttggctgaataatccaatcttaagtgtgtagttattcccacccatatctaacctacagaaaactctgaaatgttctaaaacaagcagaaggagactttaaaaaatgtagcatgagcccatgcttccatgaattaagatcagattgctaatcaaaagaatcaatcagagcacatgaaaatgaaaagatgattttaaaaaacaaacaaacaaaaaaacaaaccccaggcctggcacagtgacatacgcatgtaatcctagcactttgagaggctgaggccggaggatcgcttgagcctaggagtccaagaccaaccaagacaacacagcgagaccctgtctctacaaaaaattaggcaggtgtggtagtgcaggcctgtggtcccaactactcagaaggctgaggcaggagaatgagacccaatctctaaaaacaaaacaaaatacagaagagctgacctgcagaatggagactgatgaagagaaaatgggtgagctgttggttagagtcaaagcatattctcagaacccaccaaggaccaagaaataagaataagaagaacaaggtaacgtgtggttagaaaagtctctggaagagaaagaaatacttggccgggcgccgtggctcatgcctgtaatcccagcactttgggaggccatggcgggcggatcatgaggtcaggagattgagaccatcctggctaacatggcgaaaccccgtctctactaaaaatacaaaaaaattagccaggcgtggtggcgggcacctgtagtcccagctactcgggaggctgaggcaggagaatggcgtgaacccaggaggcggagcttgcagtgagccgagatggtgccactgcactccagcgtgggcgacagagacagactccgcctcaaaaaaaaaaaaaaaacaaagaaagaaagaaatacttgaagaaatcatgaaaagaaggcttcacagtagtgaaagagcacagccaggtatggcatgaccaacaaacacctccacaacaaaaacctactcagaaacgtcgcttgaaatttcagaatacaaggactaaagatgtaaaaaacctaaaggctgggcatggtggcaaatgcctgtaatcccagcactttgggaggccgaggtgggctgatcacttgaggccaggagttcgagaccagcctgggcaacatgttgaaaccctgtctctattaaaaaaagaaagaaagaaaaaaaaatttaaaaacgtaaatcttcaggaagagtaaaaaccatattactcacaaaggaatgagaatcaaatttatctcagacttctcaccaacatcactaaattcaagaggccatggaggaatagctgcagagatagttgggaacgtgataatggaggcagataagctcacattcaaatgagcaagcaaaataaagacatgtttagcaatgcaaggacctagaaaattgctatccacagttcctacctgaaagaattactagcagagacattctagtgaaaagagaaagtaaatccaagaagaagtcaggaaattgaggaagtagcagtgagacctatatgctacaaagggcaaattttactgaatataaatcatagctcaaaatacttaacccaaatagaatgagaaggagggggaggtggcggaggagttgtcactgccaaagccaccatgatgagaaaacaaaaccctccccaaaagtaaaacagcaaaactaatcattaagttgaaatgagaattggcaacatgaaaccaaatggccaggggccatgggagctggggagttaggaagagaaggaagaaaaaaggtacaaacatccttccctgttcagggatagcatagatagagctactgacttaatccaaaccctggtagaaaatgccagtttttatttttaatttttttttttttgagacaggggctcattctgtcacccaggctgggttgcagtggagcaagcatggctcactgcagccttaacctcctgggttcaagcaaccctctcacctcagcctccagaataactgggaacacaggcacatgccatcacacccagctagttgtttaattttttgtagaggtaggagtcactctctttacccaggctggtcccaaattcctgggctcaagcgatcctcccacctcggcctcccaaagtattgggattacaggcatgagccactgtacctggccaaaaataccagttttcaaatgtatgttaaaactgtacgtttctagaactacaaaaaaaggaggtatataagaaatttgatggtgtcaataaaaaacaagaaaaggggaaggagaaaactgtattgataatatctttaattttatagagaatttataacccaacatatacagtatatagataatgtatatattttttaactcataaggaacattcacacacccacactagaccagggtttagacaagaaagaatttcaaaaagatatcacgttagggtcacattgtccgatcatagtggaatcaaattgctaattaacaagaaaaaaatctatttgtcaggattcttgtacatggctctcaacagctctttgggtaaagaggagaacgtggaggttttgaactatgtagacatgatggacagtgagggggctacttatccaaaccctgtggaatgtgtccaacatggctggatgcaggttttctggggactgaggttatacaagtttggggtccccttttaaggaaaagattatccccccaaaaaagcttacttttataaattttaccaaaaaaaggtaatgggtaaaaaagcaaaaaaaaaaaaaggtaaccttgctaggaccctcccttggaagggaacagtgcgtgtgtcatttaaaaaataagattaaaaagctcttatctctagaaatagaaaagcacaaatcacataaattccaaggaagtagaaggaaataattaatgaaataaaagcaatgttaatttacaaaaactaagtagagaaaacggtagacaatagaactgattaataaaagtaagagctatttctttgaaaagaccatcgaaataggtaagcctttggcaaaacttactaagaatgagagagaaagagaaagatggagggatggggaaaaacacaaatgaacaatgaggggaatgagaaagaagtcataactttcggaagttaattgttttcaacttgatgaagggcatttctggaatcctagggcgagggccatgtttgttggtaaaacattggaacgtttccatcacagcactacagtcaggatccaaccagaaagcccgctaccgcttgtcactctgcattgacctggagatcccatgcaatgcagtttaaaaggaaaaataagaaaggagagtaaatgctggcaaaaatataactgttaagatttgtaggccgggcatggtggctcatgcctgtaatcccagcactttgggaggccatggcgggcggatcacgaggtcaggagatcgagaccgtcctggctaacaaggtgaaaccccgtctctactaaaaatacaaaaaattagccgggcgcggtggcgggcgcctgtagtcccagctactcgggaggctgaggcaggagaatggcgtgaacccgggaggcggagcttgcagtgagccgagattgcgccactgcagtccgcagtccggcctgggcgacagagcgagactccgtctcaaaaaaaaaaaaaaaaaaaaaaaaaaattagctgagcgtggtggcgggcagctgtagtcccagctactgggggactgaggcaggagaatgacgtgaacctgggaggcggggcttgcagtgagccgagatagcgccactgcactccagcctgggcgacagagtgagactccgtctcagaaaaaaaaaaaaaagatttgtaaacaaggctggatgcagtggctcacacctgtaatcctagcactttgggaggccaagtcgggcagatcacttgaggtcaggagttcgacaccagcctggccaacatggtgaaaccccatctctactaaaaatataaaaagtagccaggcatggtggcgggcgcctgtaatcctggctattcgggaggctgaggtaggagaatcacttgaacccaggaggcagaggttgcagtgagccaagatcacaccactgtactccagcctgggtgacagagcaagactctgtctccaaaaaaaaaagaaagaaagaaaagatttgtaaatgatgtgatgctgtaactagaaaaaacccaagagaatcaactgacaaactattagaaccaacaggaaatgtcaccaaagtagcaatatttcaaatatatagcagactaataatttacttccagaatatatatgaagatctcctaaaatccaataaaaaggataaacaatccaatagcatattggcaaaaattatgtttaagaaattcagaggaaagaaaatatgatcagtcaacacatttatgaaaagatgttcaatctcactagaaactgggtaaagacaaagcaaaacaagaaaacgtttttacccgaccattacataaaatgttgaagtttgataatatcaaatctggtaacacattgtggggaaatggctaacttaatccatggttggtgtgcaaatataaatttgcactgttttttggaaaaccatttgacagtatctattgcaattttcagtgcttatactttaaacccataaagcattcttataacaatgaaagattccaatgtctatcactgcagaatggttaaataaattatggtacaactatagtagagaatattatagtacaggtaaagagaacagagtgaatctatatatacccatatgaaaagctctccaagatcttctgttaaatgtgagggaagaggtaagttgcagcactaatgtctaataccatcgacctctagagagatacgttgatcaactccacaaggaggtctgtaattgaaggaataactaaaggagactttggttttatttgttgtgtttgattttttccaatgagaatacatttaagaaatcaggtggatatttataatgtttgtagcagcattattcatggtagctaaaacgtggaagcaacccaaacgtccatcatcagatgaatggataaacaaaatgtggtatatccatacaagggaaagttactcagcccccaaaatggaataaagtactgattcatgttgcaagatgaacgaacctcgaaagcattatgctaagtcaaacaggccagacacaaaaggacaaatactgaatgatcccacatatgtagggtacctagagaagtcaaattcatggagacagaaagtagaatgatgtttaccaagggctggggaaaggaaaatggggagttggtgtttgacgggcacagtttcagttgcagagagtgaccaagttctggagatggttggtggtgatggttgcagagcgatgtgaatggacttaatgccactgacctgtatacttaagaaccgttaaaatgggccgggtgtgatggctcacacctgtaatcccagcactttgggaggccgaggcaggtggatcacttgaggtcaggagttcaagactagcctggccaagatggcaaaaccctgtctctactaaaaatacaaaaattagctgggggtggtggcggacgcctgtaatcccagctacttgggaggctgaggcaggagaatcacttgaacctgggaggcagaggttgcagtgagccaagatcacacaactgtactccagcctgggtgacaaagcgagactccgtctcaaaaacaaaaaaaattgttaaaatggtaaattttatgttatgcatattttaccacaataagaaatgttacacaaaaataacaagacaaacaattgcaaaaataataatagtataataaataataatatttgaacaattgtaaaataatagtaataacaacacgcttctgggtgttcagctggtgctgaaggatccctttccattaaaaaaaaatatatatatatactgggcaatatgttgccaaaaaagataaatatataaccaagcttaaaataaaaaatgtataatacacagtgccagaaacaaaaaaggaatccagagacgaaagcagaagctgagatagaggagatccgtgaatcccatgagtcagacgaataaagaaagaggctccagggccagagcctaaaaaccacactgtgaactccaccaacctgacctcagcctgtggatggcaaggagctgatgtggcacccactttatagcagggacacttgaagggccattccatccttacaggaacttacaaaaagaaccttctttgcggaagcggcaaagaaaccattcacagacagtgagagagaaaattcacacatgagtaattaaaaccctaagcctgtgccacttctgggtgtagggtctaaatttacaccacccatgtagaatggaaactctaaactataaatttagcctataaaatattcaagattagtgaaacactcaggcccagcaggaaacaaggccggtctttatgaggacattttcccaacctagggcacaaaagacttcccccaaaaagaaaagagaggtatgtgtgaccaagatgagttcacaatcacaaatgagaaagaagacccatgaggtatatttagtgtgcgcacacacacacacacacacacacacacagagcagaattaacacccttgagaactggagggatgagagcagtctgaaagtgctgatgaaatatatgacttaaatggttagggagagaaaaggtaaaatacaaaacagaattcaggcttaaagggaagaaggttggctccatttggaatttgtggagcataaggagtctttaggacatccaggtagaggttagcaggaggttaccaaaaatgcgagtgtggagcccagaagaaaggtcctggctggagatagagcaaggagttgtcatcgaggtggctggagcacccatggaggcagtgtgactggccagagcgtccagcatgaggcaggggaggggggcctggaatgagtcctgtgtctaagggcaggcaacttgaagaagacaagaggatctgctctgtctatgccaccaatttccattgcattcctttccaggaagagttcacggatcttcctttccccaagatacttcccagagcctctcagagccttgtcccagcctgccttactgcatagtaacccctggctctgatctgtcgcttccactctgctgcaagcttctcaggaatgacaaggccatcctgcttgtctttattccccctacattgagcacagggttgagcccctgtgatggctccataaatgattattgaaatgaatgtgtgtgttctgtcatgttgtgggaattcacattatgaattcacacgagaatgggacttggaaggagctggaaatccagctggtttcctcttcctcttaccctctctcctctcttcttcccgctccccattctgtactgggaggaaatagtaccaaccctcggactcaggtaagcactgcccttcattcatgagcatcaggaagcatttgtgagggctgccacttgtgcaacattggtcatgcttctcccccttccatcattataagaatgacctgctatcgaatgcactttgcaaatatcatctcatttaatcatcacagcttttttactagtcctccactctgcagatgaagaaacagaagaccagggaggtgatgtgacttttcctgaccacacagccatggagtggcatggctgaagttcaaacccaggcctctctgactccagcactgcagcttctgcctctgtcctggacctcccgctgtgcttcctcgtcccctgccctccagtgccctcccagctcactctgcctcttgctcacctgaccgactgcccttagctctcactgggtctgagtcatacattctttagcagacaagtggggatgggggatgggaaggggatggccaaatggatggtacaaatccatatttgtcttttcaaggctacaagcactattgtggggcaggacctagaatccatgaccccttctaggccccctctggggttcttgggatgaaggaaagagcagcaaaggacccactggcagatacatggctatgacgactggtaagttgtctctggattgcccttgggggccagagtcagagcccccccttctcgtggatgggacagtggtacagggtgcctttcctttcagactcatggttccttgagcctgactttgttggggcccagaactgtgccaagccttagtccagtccgggaggtgaagccctggactgggaatcagaagaccaggaatctgagcctgatgttgccaccagcttgggggactttgggcaagacgtggctcctctgagcctgggttctttgttggttagatgggatgaccacaccaggcctgcccatttctcaggatgagtgctttggcaaaaggagagctctgaaccaaggaggcaaggatggggatgagaaaaggaacaggaacagggcaagatggtcactaccaaggcagccgttcccgtgggctgggccaggaccatctcactgaatgcctcctgagagcatggccttgcccactcggcaactctgggccagagcacgactgcgaatgacaggagcaatagaggaaggagaagagaagatgaagaagaaataaagtaggaggagtggtatgtggggtggggaaggagggatggaagaaaccaacttgagggtaacaggtacagaggttagcaccctgcatcccagatgtgggtctagccctggctctgcttctcactccattgtaacattaatcaaatacagccctcagctgaagatctctgagctcagtttcccatatgtgagctcagattttacgacatcttcagccacgttgtccgtttgaattttaaagccttgccccattgcttcactgtcaggagcccttcctggatcccctctcctgcctcctgaaagtcatgcctctcccttctgagctaacaccctcagcttaagcctgatccacatatcttgacttatacgtgtcacacatcacaagacagaggcctcagatgaatcacctttggttgctcctgccaagcacttatacacagtaggtgctcaatgagcctgttagtgatgaacaatagccaaacagatggatagatggatgccaaaaagaatcagcctgctttgtaggctgatcaaactcctggtcaaaactcttctccatagaaagcctcctggattaatccccagccatatactccttcttcaacaactccaccaaaggaaatcctgattctcactgctgtccttctctctccccttagacctcagctcctgtcctgctcaaaggctcctccaactgtcaccctccttattcagcagattccaataccaaagacctggcagtccaaggagcttggacccaggcacctgccattaaccacccgtgccactggggtagtcattctgtggacaaaggaagctctgttgaagtaggctggagcttttatgccacagaaaaccccacagaagtccccatgagagttcctgtaagtggcaaaattcagggatgctatgaaggaggaaccaaggcagatagactcttcacagaaggcccaagccccagccccagtcaccagccctacagccccccctgcaacacacctatgtgcacatcctggtcatgagagaagcagagtctcaccttgatgctcgtccagtttccccatggtctcgatctgctccacgaggtcattggagttccactggctcatcccaatgaggatggcattcttcccttcagccatctcctctgtgggaagaagcagcggtgagcagaagcaggtgcagctagggataggtagccctatcaggagcttatgtctgagggacattttctcttgtcctatttcttccttgagttgaggtacacctcaactcttgaaggtgtctgtagctagacagttacaagacttgcagagatttatcattgaaagaaggtactgttgtaccctactgggcctccacgtgcaacagcaaaagaaagtaacaaaaagcctgaaaccccatagaaagtaccattcctagcactgatggcagtatctcttgaaagtcagtgtgtttgggaagaaagagcaaaaccttgtcatttgcaagcagtttttctttaaattactgacttctctgaccctcgattttcccatcactaaaatggatctggccacagaggtgttgtgaggattaaatgagataatggatgtaaaggtcttagtgcagaggaggtgctcatagatgagagcaatcatgatgatgtcatcacatgagaagtaactcaccaccaggagttgagtggatgaggatttgtgtgctgcagaagcagctctggagtaactggaggagaagaaaccttccggttctaaggaagctttgacttgtatggaacctttagcccccatctgaactttatgaccctcttaattcctccattctctcccactcctcccctcaaccctgtctctatccttgttctttccttgtctgagcatagtgagtcttctgggagaaatcagtggggctatattccataaccacgctgaatacaaggccctgggtcccacacatcagatacacacatctggtaccatccctcatcctacaaagggacatttcttcaaagacaaacccttaggcatgtgtgctctcctccccatactttgccgaaaaacagatgtgcctttctggtgaagagctttgtgccctccctcgcagaacagacatcaaagggtgttgaggacaatctccaagcttatgataattaagaataaagggttgagatccatttcactgccaaagaactttacctagcagaaggaatcaatatggtgcatctgaagctttgggagctgtccagagttctgattcactcaagagctcagttgaccagacccccaattctggttaggacatctcctcctgtcttattttatgtatctatttgattgacttaacaacacttatctaaccgttaccatacactgagattattataagtgctttacaaatattaactcgattctcaaaacaatacaaaaaaggtaaaattgttattatctccattttatagacaaggaaactgaggcacagagtagctgagtaattcttgcccaaggtcactggctagagccaggatttaaaaccaggtatactatttcaagagtcctgaaatcctgccatcctgatagcctgccctggacatcctgtattggctgcccacactccagccaggcaccacacacattcggacaatttcctgagcccagtgtgttccatctgggaactggtttattctgtgctgggcagggccctgaccaggttccagtgcagatcctgctgcatgtgagctttgtgcttttccacaccctccaccactgtgtctgctttcctatcttttaaacaacaataacgactcagggtctatagctctgtctagcaagctgctgtggggacaaataatatagcaaatttgaaaatacgacgcaagtcaaggtgctgtaaacaaatatgaggtgatattattcttcgggaagcagaattatgaagaggttaagagctcaattctcatgttagattgatttttttcaatcctggacccaccatctgctagcaatacaactgcagtttcctcatctaaaagtgatatcatcgtagggcctctgtcattggattgttgtgagcattaagtgagaagatgcaggtaaaggtgtttgtaagagtgccccacacacagtaaaagcacaggctgagatgccattgcatgatggtatcatcatcaccagcaccaccaccaccagtaggagcatgggtgttatgccccacactcactcttggttccactcctgctgttgttggcccctatgacattctaccccagctgtagagtgaggtaatcaggatcagcccaattaccaccttgagttctttgtctcctggttcagttactcaagcatggagctatccatttgttcattctagcattcaatctacggtgaatagattcctgagcacctactgtgtgcagggtgagacacaacctccctcctgctggaatccagttttgtgaaaaacatgatagaaatacctctgacataagctaagagagccaggtatgcagcaggcactcagcacatcctagctttcttctacagtgccataagtcctgtcccagtggtttatgcaaggctactggaaccctgtggggtctcccagggctctggaggtctgagcatgcctactcctgcatggcccaggccactttcctctttttcctaatcaccagtataaccctgctccatctttggcttttgggcttttgtctgtttccgatcaaatatgtccttctctaccagagtctcaccgtgcttctctcacgctttacatctggccctgactcactcagatctgagctctctggacccctttctatgggtctgtgtctctcttggtccttgtagttctctttgcctctcccaagctctcccatgctgcctgccacatccgtatctctctctgggtggaacacgtatgcattgccttgctctcttctcaccccagcatctctctctttcctttctctgggtctcatcttatcaggctgggtatgtctctttcttgatctctctcattctctatggatttctcttttgtctctctgggtccctgtcctcaggatctctccagccccctgctccctaagggtgttctccctcccctccctgttctctcttgctatgtgtgtgtgcacgtgtgcacgtgcatgtgtgtgtgcatgcatgtgtgtgcatgcatgtgtgagtgcatacatgcattgtgtgcatgtgtgtacatgcaagtgagtgtgtacatgcatgtgtgagtatgtgcatatgtgcatgtgtgtgcatatgtgtgtggccctctctccctcctgctccctctcactctctgctttatcttaccttctctggcattctcacactccctgcccctccgcccatccctgtctctctgctgctctgtgcaccctcccaactccccaacatgctttctctcccacactcagcctttacgtcttcactctggcaacaattggcttgtcccctgagaagcaacaagaacacacacacacacacacacatacacacggaagcagcagcagcaatatctccttttggagccattcaggcaaagaggggagctgcagggctcagcttgaagtctttgctctgcttcccacattgtaggacatgcctccaacaggacctgtggaggccacagcgtgctcatttgtataaacgccctggttgattttgcttttcaccttctgatgactgtctcctgcatgctaattctcatcctggtgacctctgcttcggacatggttttagcatgtacttcaccctactgagacctgacccagctctgattaagctccaagctgagcctcacccactgtcacaatagccctggccttgaccacagattgactctgaccctgaccaaaacctggttatactctactcctgtaagcacaacctacaatgccataaggaaagcctttcttcctatcctggagcttctgtttctactgttgacaggactccagagtaaagaatctctttgtcttggccaggcgcagtgactcacacctgtaatcccagcactttgtgaggctgaggcgggcaaatcacaagggcaggagttcgagaccaacctgaccaacatggtgaaacaccatctctactaaaaatacaaaaaattagctgggcgtgggggcgggtgtctgtaatcccagcaactcaggaggctgaggtggaagaatcgcttgaacccgggtggcagaggttgcagtgagctgagatcgtgctactgcattccagcctggtgacagagtgagactccatctcaaaaaaaaaaaaaaatctccttgtctcatgccaggaaagcttcacctccagctcatggagccgagggcttggtcacattctgcagatggcccatccagtaccactcatcatcaggcccacaacatggatttctccaaggacctagatatgcattgcttggggctctggaccacaagattgctcacattcaccttgcactgcctaccacatgcccccatggcccccctatagccaataccatgactccctcttccttgtgaggggcagtccccacacagcccatccccagacatgttggggctggttccatggcgttctcttttccacttcccctcccccaatgggggaaaaggtagagggagagtgggggcctgtggcacacctgtgctttgcttctgtgatggctccttggcccaggaataatcacgcagcttcccacggtgacatccttccactccctccaggagacaaacagttctacccttgccattctacagatgaggaacctgaggctcagagacccaagacttgcctgagatcagagggcagacagtcagtgacaactatcatggaaacctggtcctctatgcccagaggacacatatcattttcttctgttcccccttctctcacccttggggttggaaactgccgggaggctgagtgatcacagggaaagctcagatcaaaatgagaaggcttggcatgtgccccccattctctgtgagacctgaccctgactttgaaatttcgtctgtaaaatgggatgatttagccgtgcactaccttcctctcccaattgctatgggaaaccaggagttagaggcacaagcagattccgcaacacagaacccagctcctcaggccccagcctcccaccttggggagtgggggaggggaggaccagccaggctggccactgagagagcaagaaaccaaggacacaaaagacatgggggtaaatgcagaaaggaggactcctccagcttctagctcagagagttcccttagccctgctgaaggagacaagtcttgtgctttgctcttgatccagctacccagtgccagacgtgccctgagagtaaatcctagatccaccaccaccaccaccatacccagcccattcctggccctgatggcatttttgtctctgcaactgtcagggcctggcctgcttatgcatattcatggagggagggctatttagatgctggagggggttgggaaaccgaaagaaaagtatttcccattcaagtgagggaatggacctggacaccacagccaacagagccttgcaaggccatggggagcctcattgacagatccttccaggtgaagcccagcatcctcattttacaggtacagagctgtgccactggcccacggccatgcagaacctcaggggaagggctgggccaagaatcgagatcctgccaattaaaggcactcccagtaacactatctcctggcagttaatttcatgaaaccacctctgtttgtacctagatgtttgctggtacaaataattggatattgttccaattatttccaatatccaaataattggattattctttccatctaaggttaaagtgaaggatgcagctgatattttctaaatgaagacatacattttgctataaaaacagaacacaaagtgagctagtcttggcatatccagccaaatcccaaataaactcaaccaataccacagtgactgcactagccccaaccttgcatcctttcagggatgaagacttcaaaagaccgtttcatttttctctctagaacttagcgtttcatagccaggaaccctgggaaacctgggctgctctaacatgtcaacccatcctccttggtccactaagcttttcttacccatggcttctggccagactacctgtcacccagcaatcttcatccctcacaataaggagctcactcaaggtccaggcatggttccattttgaggatccatcctgcactacggactctgagttctgcatctctggccttctctgggacagggacggggtacccagggccaaccctgagcctggccaggaaagcgtgtccagaggacacccactgccttccacaatatgggctactgggtctagtctgccccctctctccttgctggggctgtgaacccacagcactgagccagtgcctccctggctcactctggccacaccagccttcctgctgttgctcaaagatgccgagcttgggtgcagtggctcacgcctgtcatcccagcactctggaaggctgaggcggacggatcacctggggtcaggagttcaagaccagcctggccagcatggtgaaaccccatctctactaaaaatacaaaaaaaatcagctgggcctggtggtacatgcctgtaatcccagctacttgggaggttgaggcaggagaatcacttgaacctgggaggcagaggttgcagtgagccgagactgtgccactgcagtccagcctgggtgacaagagtgaaactccgtctaaaaaaaaaaaaaaagatgccaagctcattccaccaatcaacactttgcgctggctgttcccactgtctagaacactcttccccctggattcgcaggtggctcatttctcattactcagctctcagctcagggccacaccccagggaccctctagcagccatccactctatcatgtccttttatgttatatggtggggacagtctccattttttaaacagcattactgaggcataattgacattccatcaactacacacctttaaagcgcacagctgggtaagttttgacatatgtacatacctgtaaaaccattaccccaatcaagctagtgaacaaggctccatcccttctagaagttctctcctgcccctatttatccctcctcccccaactccccatccccaggcgaccgctgatctgctcctggcaccacagattggttttcatgtcctagacttgtgtataaatagaatcatacaggatgtactctgcttcagtctgacttctttcacttggcatgattattctgagatttatccatattgttgcatatatccgtggtccgttccttcttaactgtaccacaatttgttcactcactgatgctcatttgggcgttttcagtgtggggctataatccatcaagctgctgggaacattcatgagcaagttctcaggtggacaaatgctttctttttcttggggaaatgccaacaagcagaagggttgggtcacatggtagtgaagtatgatttgcttcttaagcagctgcaatcaattttccaaaatgattgtatcatcatacattcccgccagccgagtttgaaagtcccagtgcctccacatcttggtaagttattattattattattgagacggcgtttccctcttgttgcgcaggctggagtacaatggcgcgatctcagctcatcgccacctctgcctcccaggttcaaattattctcctgcctcagcctcccgagtagctgggattacaggaatgctccaccatgcccagctaattttctattttcagtagagacagggtttctccatgttgatcaggctggtctcgaactcctgacctcaggtgatccacccgcctcagcctcccaaagtgctgggattacaggcatgagcgaccatgcctggcccctggtaagttattttaatcagccattctaataagtaggtattggtatctcattgcagttttgatttacagtaatgacgtcattccctaatgatgaatgacgtggagcatcttttcacatgcttacttgccatgtatatatctgctttggtgcagcatttattcctttgtgttattttgtttatggtgttttgttgttgttgtttttcttccaggcagagtctcgccctgtcacccaggctggagtgtaatgtcatgatctcggctcactgcaacctctgcctcctgggttcaagcgattctcctgcctcagtctcctgagtagctgggattacaggtgtgtgtcaccatgcccagctaatttttttgtatctttagtagagacgggctttcaccatgttggccaggctggtctcacactcctgaactcgtgatccgcctgcctctgcctcccaaagtgctgagattacagccactgtgcccagcctatggtaattcttaatagaatgtatttgcttgtgtattgtcttcctatttgtcacctaccaccaccactaggctatgagctccattggctggggcaggactcgcttgctcctgtatcccccacacccagaagagcacctggcacttgatggacggacgcaccattaatactgtggacagagtaaatgaatgaggctgaattctagctcccgctctgcctctttgtgtggccctaaacaaggttccccagcctccgtttcccagcttgtaaagtgagtcagaggtgttagattcaaaaaccttgaggagcctcccagctctggcttgttctgggttggaggccacatccccttctggccactctgggttttcccttaccctgcatcttccaacctcggcactgctgggctgtggccccccagatatcctgtcttgacaggggagggagtgacacttcttttgaatctgggagcctggaccccatagcccaccctgcagcatctaatcactcctgagccccagacctgccaccttagccagaggagctggcaccctgccgaggagttgttatggttccagagagctcaatactcctgcctgactgttccctaatccctcccatgccttccatacagaaccagagacccccagaacccagaactcctctctgctcccagaccatgagctccaagggcctctccaggtgaaccccattgccaggccaaagggttggggctgatggctgcaagggagggaggacggtcctaatcggtaacacatcaaagggaaagggctgacctggacactaaactcccgggttccagcccctgcacttccaccttgatgtgtgatctggtggtggtggggggcagggggtccctttggtgctgtggcctcagtttccctattagtgcactgaggaggaaggagatacactgttcccaggtccagtcagtgctggtacctagctacgcagtttcttccagtgtagacgccgcttggtttctcattcctctggtcatttttgtatcagttgaggtgggcaggggtgggggatcacgacggcggttatgggcagaggagggagtacagatgcaggagctctcagggacagaaggctgcccaggcagcaatgagactgccatacccagggcagcacgaagcccaggagttggctgcaagtacccagctggtctctgcagggagacacagagaaggtcacctgtgaagacctccacacgtgcaggaactgttgaaatagacatccatggcagccaaggagtcttttgaggggctcatgggggaaacccagggagctctggaggctctggtgcaggatgtctgagtggggctggatttaatggtgttggccccaccacaactagagttggaactgttgaggccacaggatgccaggccatgctcaagcggaagacagagaccacacccagggtcagggtcagggtcagggttcagcctgggctggagagcagagggcagggaagcagaccctcaagggatactcagaagcccatggcctggtcccagacacagagcactggctgggctgggctgggctggaccagagccctgggagagagagaaagcatggcttcacctctcactgccttgagccaaggaaacacacaaaggccttggtcagggaggaatggaaaggaggttagcagttggcaaatcagaactaaacagggtcccagcagcctgtgaggtggatcctgtggcttaggaatgcagatgctctggaagagggcagatgggagggaggctgcagagatatacgaggtcctgtagggtgtgtggagaggcagaagatggggaaagacgggagagtctgggatcccgaaaaaagggagaagaaaaaaaggaagtggccgggtgcggtggctcacacctgtaatcccagcactttgggaggccaaggcaggcagatcacttgaggtaaggagttcaagaccagcctggccaacatggtgaaaccctgtctctactaaaaataaaaaaaaaaattagccaggtatggtggtgcctgcctgtaatcccagcactttgggaggccaagacgggcagatcacttgaggtcaggagtttgagaccagcctggccagcatagtgaaaccctgtctctactaaaactacaaaaaaaaaaattggtcagacgtggtggcacatgcctgtaatcccagctacttgggaggctgaggcaggagaattgcttgaacccaggaggcagaggttgtagtgagccaagatcgctccgttgcaccgccacctgggctacaaagcgagactccatctcaaaaaaaaaaggaaaaaaaaagaaaaaaaaaaaaggagatgatgagaaagaaaacacagggccaccaacatgggaggagtgagaagtggggccgatttcacggcagaacaagccgtgagatgggagggagaggacagagacaatggaggggccagggagacagccgtcagcatgagaagcactgcagctgctctcagggacggcaggtgagcagggcccgaagggatagagctgaccctcgcgccacccacagatgcctctgtcgtcagctgggaacgcagagccctgatgaactgcagaaatgttttaaatgaaagtcttccaagcatcaaaatattgaagctgttgttgtctcactgtgggttagttgctatggagaaattcagccccagcagccactctaattagacgcccatgggagacaggccccaaatgggctggtttagggctggcctcagggaaggggttccccgcccagagccaagaatgggggacagctccccacctcccagccacatgtcctaaaaatcacccaaactgagtcttctccactgttggaggcatagagctggtagggaaactgaggcccagagaaagtgaaagccccgccaaggtcacagaactagtcgatggcatggctgagaccacatcccaagtgtcccgctctgggtattgacgtcttcccagcacgtagtctgtttctcttccaagaccccgtttgccaagcatttcaaagccagctccgtctcaggagtaagtcaacaccctaaatatggtgacttcccagagtggggccacgcaggccaagcaagagccagggactgtcctgggctgtggatcaggaccctggtgcttctccccaactcctctgcagcccagcagagcatggctagggagggtcttctctgctcaattccagaccgattctaccttcccatgcctgtacacctgcctgggtactcgtgcctctgagccttcaaggctgatctctgcctgaaatgtccacccctttggatgcccctttctttcaatcccaacgtcaacaatgctccttcctatgtctcatgggttggccgggaagagatgcagaggtcatttccccaccctccttgtccctcacctgaacactggcaacagtctttctaacactctggcactccctgcatctatgaggctcatttattttttctttcttttttttttttttttttctgagacagagtatcgctctgtctgcagtgccatctcggctcactgcaacctctgcctcccgggtccaagcgattctcccgcctcagcttccccagtagctgggattacaggcacccgccaccacacccggctaatgttttgtatttttagtagagatggggtttcacaggaccacctgttaaagggaacacatctgttaagggaatacacatgttggccaggctggtctcaaactcctgacctcaggtgatccacccaccttggcctcccaaagtgctgggattacaggtgtgagccaccacgcctggcctgactgttctctcttacaacagctggcacttttacttagcagcggcacttttacttagtggcgatggtccccattcgtcattgtattttcttggatgtctgcctctcctgcaaggctataagtatgatgagagcagcaatgtgacgactgattgccacaggatccctggcacctagcagagttcccggcacatgtgaggggttcagcaaatatttcaaacagtgaacagacgaaggctgagcccctgctcttggcacatccacaggatgggtaagtatggagtgtggagctgcagataccacgtctgagtggggagggatgcggacccccaaatgggatcttcttcttgaggcttctaggaaggtcacccagccagtgatatgagactggggttcactcacctctggcatcaaagaattcatcatctgagctctccacagagtcactgaggacatttcgaaggtgccagggggcaccgccgcccgggggaggaccacctgttaaagggaacacatctgttaaccaagcctgagatgttgtcccagtatgagggaggtgacccaagacccccctggactaaaggccagttagcatcctgcacatctgtgccctctccctccgaggcctcagacctcacagagccctccctctcctgtgctgtcattgaagctcaaaaacctctctgagtaagtgcagcagagcaggaatgcgtgtgcccattttccatgtcctaacactgaggctggtggtagttatgagcctttgccaaggtgactttgccaagcagcgtctcagtcagcacaggggaagctctgctgtattaacaaatgagctcagacgtttaaacatcaatggttcatttctcactcacatacaggttggaagggagctctgctcattgctgtcactcataagtgccaccaccttacgatgtcaccagcccaaaaggagacatcaagttctggccaagcaggggagaagagctcagaaaatctcacctagtcttaaatgcttctgcccagaaatcacacacttctgctcgcatttcactggccctgactaccaggcacacacgtcctgtccctcagagacctgcattcttgtatcagcaatgcccctgcctcagtttttccatctgtacaatgagaatcctggcagagactgtcctttgaaactcttctactctgactgatattggaggagcccacctggcccacagtaactgacaataaacaagcatggggcggggggtggacatcctccctagccactgccaggtgagcctgatggtgcagtccttcgagatacctgctacagtcccagttcaccacaccccctaccctgcaggatgctggcactgttccctgccctgagtccagatcccagagcataaactgttcctgaagggagacggtcagcccaggccatccagggacacagccctcctgcctgtcgttcctgcctggcccaccacaaactcccaaacacacacccagtttgtgcttcatggcttggagcccagtaagaagcacattctgagacatcaaaaggacagagggtacagtgaacaccaactcggtagtcacctctaggtacaaggctgattccctaagcttctgatcccctgtctctaccagtgtgagctgacgttccaccctcgggccctggatttactgcaaggggggtctgagagttcagatgcaccataactgtgtgttcctaacacagatatgggacgattttccaaatgtatgtggaggacattctagctattgcaataagacaagaaaaaagaaatgattggaaaggaagaaataaaattgtcttcattcccagatgacataattgtctatgcagaaaacaaaaagtctacaaaatctatattaaaaaaactaccagaactaacaactgagtatagcaggattgcaggatacaagatcgacatgcaaaagtcaattgcattcctagatacaagaaatgaactgaaatttgaaaatgataacgccctttaaaatagcgcacacaaaatacttaggcataaagcaaatgtatataaaaatttctgtgattcaaaaactacaatcacttaaaattattcctgaattatatcaactgtatgttttctcaatcaacagatactaaaggtataaaatctatcatatctactacatttgcatactatgtgaatacgctagattaatatacagacatcccttgctatcccagtcttttccgttcctaagaagtaagaatttggatagtcagcaaagtcctattatccccatctgttcagctcctgagttttagatagtaagaagcaagagtttaagtagcaacaaagtcagctgaggatttatctggatccatttggctcctgagtttgaacagcaagagcccagtgagaggctcctctatgcggtggcctcatacatgcacggtttagatccatccgagaacaaaggcagaggcattctctctgatgacctgtgcaggggtcccagcaggaggtctggggcagagggaaaggctgcagggaggccagtcagctccatttgagggagcaagttctcccagctacaggtgagcagaaaaggaaggggctggtaggcatcaaaggggcctctcattccacagacactgtgttgggaactgggaacactgtggggaatggacaggattgggtgctcgcaaagcttacattctgcaggcggggaaggaaaagccagcctcagtcaaataaacaacccagataatttcagcccaaaacctctcccttcctacactatgtcctccttcctcaagtgtctcttatgtgataattacagcctaaagaacagacagacttgaatgtgtggatctgtacttccgtggggagaaaatggttggggaaactcagcctcagacatcaaaagaactttgtcacctattgtagttataaatgctgaactaacatgatgtctcccttttattattgcggctctcttttgtggttaaaatatatattcttttcaaatgcatattttatcttgtttactattattctacttgctttcaaaatgtatacctgccttggtgttttgttttgtttttgaaacagagttttgctcttgtcgcccaggctggagtgcaatggtgcgatcttggctcactgcaaccttcacctcccgggttcaagagattctcctgcctcagcctcccaagtagctgggattacaggtgcctgccaccatgcccggctaatttttgtatttttagtagagacggggtttcaccatgttggctaggctagtctcgaactcctgacctcaggtgatctgcccgcctcagcttcccaaagtgctgggattacaggcgtgagccactgcatctggccccgccttggtttttaaatgtatactggataccaggtcttccctcccctccagcaggggctgcccaacaaacttctggaaaggtgttggggtgcagggaacctcagttatatacctgcaaaaacagatatgttaagatggaacatgggaactcttccctgcatctcttcctccagcatgcagattttttggcaaacaacaaaggtcgtatttccaacaaggagaaaagcaatgggcagtgtctcaggaggggttagaggggaagacctttgtggaaaggtgtcaggcaagcagaggcctgaataataagaaaacccagatatgctaagagtgtgtgtgtgtgtgtgtgtgtgtgtgtgtatgcacatctgcttgtgcacatacatgtgtgggatggaccgggcaaaatccatggataagagccttcctggatgaaagaactgcaagggtaaattcccgtatgagcttggtgtgtccaaggggcagaaagaaatccatgtggctggggccaatgattgaagggggacaggaataggggaaatggagcctgaccaggtagggtaggacctgtcatggacggaagcttggaacaggtgagttttaaggctcctcccactgccaagcctctatcacctgcaaacttcaagaggaggggaatacagatgctgaagagtgtcagaaagtctcctgggggaggggaccacaagtcagatgtgctagaggccacctaggttcctgagagtcacagcaggtgggcatgacgaccccagaacagcaagggaaaggctcagaagcagtgtccttgaggtgggtccttgccctacacttccctgcattttctgggtccaacacaaagtcccacacagaagagggccaggaagtgtttgacaaacaagtaaatgaataaaaatgatttgcttggtgagtgcggcatgccaggcagtctgctagctgcttttcagacattagctaaagtcatcctaaccaagcctagcaaagtagacatactgaatccccaccttacagctaagaaaacagagcctcagggatgtttcaggaaggcgtttgctctgcggaagagatcagggcgggggacctcagtctcctcctctctccattgcccgctctcttggaaatagcaacccttctacctgtttctggccagctgggcaaggggccagaggcctgcccctggctcctcatgggggccctagccctggggggctcagctgtcccagttctagaaccatctgcccatcaggtctacaaatcagtgtctgggtatccttgtgtctgtgggaaaaatctaaatggatgtctacattcctgcgtagaggtgtctagtgttacacgagcatctgtccctgtgtctgcttggctgttgtgtgtgtgtctacattccttggggagtgtgagcttacccacttgccagcccccttcctaatattgttcctaagaatcatgcatgcatgcacactcccataattctctccctctctccctcacacacaaagtaaatcagctccagccatgggtgaaaatttagcagaggttagaacacgggctttggaacaacacaaatctgggtgcagtgttaccagtggctaatctaggacctgaagcaagttaacttcactgagcctcacttttctcatccggaaaatgagcatcataatacttaccccactgttaggagatttaaatgacatcagcccccagagcgtctagcccactgcctggcacttggaaatggtggccttgtcagcgacaggaccaaggattgaggcagggtaagcccacctgaggggcttccaggcagctgccaggggccctccccaaggcctcagagctctatctgtgtcctccaaggcccagcccacctcctcctgaagaccctccttccatccaccttcactaccacatttatttatttttattttttgttttttaattgagacagggtcttgccatgttgcccaggctggtctcagactcctgagctcaagcgatctgctcacctcagtctcccaaagtgctgggattacaggcgtgagccaccacacccagacctacatttatttaaaatgttaagtcaggatgaaagagaaggggaatatcccaactcttcttctagcaatttagagagaaacaaatgacccttcaccccagcaatgccagcacagctccgagctgggccgctcagtgggaggggctgctggaagccatccccactccctctcctggccccgatacccaccacctcaggtccagggtggtctcctggaccttgtcatgggcctgggtctccctagcatgggtgcagccaaagactctgctcagatcgtcagctcctcctggccatctttcccactcagggacataggactaggtggacagagagacagacaggcagacagatggacaggcgtctcctatgtgtgttctgctctatatcagggaccccaaggcagccccagccccaggggcagagtcctcaggcgaagggagatgcctcccccatgctcaggagccctgtctgaggggaagacatttcacagtgaggaacgccctgaccgtaagatgcagaacaaaggtattggccgatgcttactgggccagaccttgggccagatggtgccaggaaggaaggagtagggggcagagctgaactggaacagtccctgccctcagaaatgccagccctgggggcacagccctacactgcttcctgcacagagcacaggaggaacagaggagcagacgtcctggcccgtgtgaaattccacacccaccatgtctgtcccgcggcaagtggaaatggtcctcccagaagcagggactggctagggtacccagagggtttccgggggaggggaagccaagatgagcctccaaggaaggggtgggcagggttggccaggctggggcaggtgggaggaagggagagacacaggccaaaacaatcgagccctttccaaggaaagctggatctagaactttctcctcaagggtaaggagcatcggggcaaaggagggcacatgggtgtctgctggcagctgtgactccagggacattcagataacacgtgcaatttccagacctccagggaggaacaggtgcccctgagcgaggccctggtgggtgcacagcattgggctggcacctgcacctactggcctgtggccacagcttctaggcccagccctgcctacggctatatcagaaactgcagcctgccaatgctggatggacttaagcaatctgtgcctcagaagaagaaagggaggccaggcatggtgccgcacacttgtaatcccagcactttgggaggccaaggtaggaggattgcttgagcccaggagtttgagaccagccacgtcaacaaagtgagaccccatctgtacaaaaaagtcaaagtaaaaaaacaagcctggcagggtagcatgtgcctatagtcccaggtactcaggaggctgaggtgggaggatcacttgagcccagcaggttgaggctgcattgagccatgatcatgccactgccctccagcctggggaacagagtgagcctctgtctcaaaaaaaataaaaataaaataaaaaacagaaaaggagaggagccaagagtgagagcagtgcctggctgcagggctgaggctcatttgaatggtgtctctctctctctctctctctctctctctcacacacacacacacacacacacaaatacacacatacacatacacgagaacagcaggttctacaagcacaagcatcagggtctaactcctggcggctgatgcagctgaaaataatcaggccttgggatgtcccatgggcagtgggagccccgtagacacatagagcccagagcacacatgtggctcatgcagccacacacacacacacactcacacacacacacacgcacacatgcacttagaatcacacttcagtgctctcagctctgccttggggtccctggggtccaaacgcagaatgtggagtgcagtgcttcctacagcctggccgaggctcctgcggacaggcaggtgactgtcaagccccgcctcctccgtgcctcctcctccctcgaggaaaccaccatcccgctcccacctgactgcttccagccccagttctgccacttaccaattcgtgatcttactaaatgacaggaaacccttctgtgcctcagtctcctgctctgtaaaacggggaggataatcatgcttacatagtgtcgcagtgaggattacatgaacaaacatttcaaaacggtttagcagagtgcctgagactccatcagtgctataaaagggcgtgttaaataaaataataaattgtgattctccaagagcttttctttggttctttcatccgtggcaacttccaagggcagacccctctccttcttctcgggcccctggaatgggagcctcgccactccccaaaggctggaaatgcttgcccctgcccacgctcgtgaggccaatccccctctcctccctcccatcgcaggtccctggggcttgccttgtctgctccctaaacttgaactactgcaggccaggacctgctctcccatcccagcctctccttccagcagcctgggcttcagcagcacattgccaccagtagagccttcacaccacgctcctcttcctctccaggcctttcctcctgcaggtcctgatgcctgaaacgtcttctatctccccatcccacccccaattcctattgatgcttgaagcatcagctggaagtctttcttggcccctgaggccagcccgggtgcctgtctccttgtgggtccttcatgtgcagcacctgtgtccctcagagtccctatttacagactgggtccaggcctgcctgccccattgggctgtgggttccccctgagcagacacctggtaggaatcctctccaggctcctatcctgtgccaggtcagggctgggcacacagaaggctcttgtcaggctcagtgtggcccagcagaggggagatcttagcaaggccccctctcaggggagcatccccgagggaatgtcctcaggcttcctctctggatcagggtgaatttggagaccagaccagtccagggccagccagcctatcctcagccttgaaggggggctgtccagggagagatgagaggccaggagaagctgcttccagaaaaaggcattattgaaggaaaccagtactggttgggggttggttgctatagaaacatgtcctaactatctcccaaactgctatatgtgccaccgatgagctcatgtgctcgtctgtttcaggggacacgccaggagccctggaagggcctatctgcccgagtacgctgcatctgaagccaacatcctggagaaccccggaagaaatccagcttccagggcaaccagaggggatcatccatccatcggtaatgcacttaaagactgaggctgacttcagattgcagaactgtcctgagaacagctcaggtctgagactagccgtggcccaaacctcaacctcaaccatggcctcaactttcagtttggccatagaccgagttacaaccatggccacaggccaggccacaactcctgtctcaaaccacaccacgaacctgaccacagacccagcttgactcagtcacagagcaacaacactgctagccaaagactaagccctgaccctggccacacaatggcacccagcacaatcaagggcttgtatcaaataacttgaaggatatgttcactctaaagtctgtacagggcagctgtggtggctcacgcccgtaatcccagcactttgggaggcggaggcaggtggatcacctgaaatcaggagttgcagaccaagctggccaacagggcgaaaccccatctctactaaaaaatacaaaaattagccaggcatggtggcacatgcctgtaatcccagctactcgggaggctgaggcagggagaactgcttgaacccgggaggtggatgttgcagtgagctgagatcgtgccattgcactccagcctgggtgacagagcaagactccgtctcaaaaaaaaaaaagaaaaaagtctgtacagcattgcatccggttgcctgggatttccacagcctctgctgcctgtcgtcttcacgatagcccagggaggtcagtaagaaaggactcacgattcttgttgacagatgagaaaactgaagctcagaggagaaaactgatgtgcctcctgtcatgccgcctgtttctaggggtaaggggagtctccaagcagggcacagttggccaaaccagttgctttggggaaaatgtgctttttgaagacctgctggtatgtcataaatatgccatttaaatacccattaattaccttatttaggagataattagtgattaatagctttggctatctattgtactttcatttgctctgccaattaggctcccaacagttctgaattatttggaacaattctcccaaggcccagctgtcccccctatgtcccgccagactcttgttccataaggaggaggctctctcctccctctaaaacgagttccccgtagcacctgccactgtgccacaacaggctctgccacctgcaggctccccaggagggcagcccgaaagacaggacagcaggaggcattccttctgctcatggcaggacccccttgcagagagctgagaataggggctcaaggtccaggcacctacccaggcaacgggaggccaggttggaatcagactcctcaaaggacgctggggtctcttttcttttcttttcttttctttttttttttgacagagtttcactcttgttgcctaggctggagtgcaatgccacgatctcggctcactgcaacctccgcctcccaggttctctcctgcctcagcctcccaagtagctgggattacaggcatgcaccaccatgcctggctaattttgtatttttagtagagacggggtttctccatgttggtcaggctggtctcaaactcccaacctcaggtgatccacctgcctcggcctcccaaagtgctgggattacaggcgtgagccaccacgcctggctggggtctctttcaaagaccaccacctcaatgaaacgaccagctttttgggaagtgcatcaaaggctgccattagcctggagcaaacagtaggagggtagcagctccccaccccactccatgccagcaagagccaatgtgaccccctgcaggtgatccgactcataccacctgccactgctggactgcaactgagcaaagatgggacccaaggttgcctctgcccccaggcccctccatttggtgccaaagcacagtgccaggaattgccagccaaagccccagaggcggagctctcatcactgctccagattatactatataagaaggaaacacagaggctgcgaggggtaaacacacacacacacccgaactgggcagtaatgggaaagctgaaaatagctctttttaccacaagggatgactctagagttgctcggctgggactagcctcacggggggcaggaagtaggagcaaggggaagagaaggaacccacaggggcgacatcagggccaaaaggagttctgttgagggtagtaatctggatcaacccagaacaatcagaaaaggtcaatggtgcatgagtgacgggcagccacagacactcagactctctgaaagacagactctagaacaagtgaaagccttccagctgtcagccccgagagctcacagtcccacatcctgcacacctaggtctctccccaaggagggcaggagtgcaggacgtgacgtgctctgcaaatacccagagccaggcaaacacggtgtcagcagcagacagctcagaagaggcctctcagatccaccagaactcaacgcccctcccagacagagcccaacgcgtttctatttttgctttcaacccttgtttggcatccctgctaccagctaacagacggttacttcccctccttccagaagaatgggtcatctgggaagaggaacacctcctctctggcctcccatgtcccaggtcttgtaataaacaggctgaccctcccaaagagagatgaggctcccaacacccccaggaaccttcccctggtaggtggttcactccaagctgtcctgctcaccagccctggagaagagcttctccaggacacctagagagagcagcttcacaaaacctgagactcctgctttccagaggcagatgcaaccccccgcagccccttgccagccctggccacacggactacaccccatggagccccaaattcactcacactgtgccaactccagccacagactgaaccccaacatgccacactctgcaccccatctctagcctcaaatcaagcactgacagtgaccacacaggcttccagcctggcccaatctgagctgtggccccatgaacgtgtgagcctcacaaatccagccctaggagagcctggaggaagcaggttggctgtgtggggccccagtgctgggacccagctcccaccccagagtcatggacagaggaggcttctgccccctgtctacccttgccacacacgcaccctgtgggggctggtggccacacagctgtgcaggcctccacaggcacacgtgggaccctggaggtggcatttacctccggagtgactcactaagcctcctattccatttgcaaaagggggtgcaatttagcattttctttctctttagaaaacaggaattttaaaagagagagagtggagagagatttgagggagtgggtggggagctcagatctcatttgatttccaaactcatttgttatgcattctctcctcccccctcccacaccgagcccttcccctggggaccctggccacccccttccgggctcctggctgcagacctggtgatggcctgccaggaggcacgtgctctccacgtccacgtcctcagctccccatggaatgactgaccctcaagtctgggaggatcaatgcaaggtcagagttgagagggggcaaggcctcttcaggacacagtaaaacccacagccagggaggctctctccaaaaaggagagagcagtgttggagctggaaagagcctgaagctcatcctgaccctcaaactcttccctttcacttttacagataaggaaactgaggcccaaagagggcagttcaaggtcaaccagtgccaaagccagggctctccttcgttagacaagttagctcccaggaatattgactccaacagtagaagagacataagctctaatcccagctttgcctctaactttatgtgtgattctagccctagatatttaaccctactgggcctcagtgtctcattcataaaatgggaataacattggctctacctcagagatgctgttgagccattggacagaaaagcatgctgagagctgctataggatctgagccaaatgggtcccagcatgcgaactcccgatcctaggatctcagaattcctggaaggcagctgggtcctaccaggaagtccccagtccctaaagcctccatggtctctgaaagttcacactctgtccttgaaaggggaaaggatgccggatctcaaagagggacccttgactgaaagggtctggtctctgtctcccaacctgcttaacaggtagaacaggagaaccaggccacctccagccatgaagtctcataacatatgaagatgtatgtgagaaaacatcacagcttctggccaatctgacccagacatggcccaggcaagtggctggggcagggacactgtccagccatgtcctcgtattctgtgtcctgccacactggacttccaaacacaggtcaagtcacagaggcctcaaatgggggataaggggttccaggcccagggtcacaggcttgaggtggaacctctctgtttgagctgcaccatccttggctcaaacaaggacaccacagccagaactgagcggcaacaaacgtctcaggctgggacctgccaggtctgctgctgggataggtgatttcacagaggtcggcgtatttgcataggaacgtgaggccatccaagttccagcacaccccagactgcgggaaagcttttgaaaagcctggagtctggccaggcacggtggctcacacctgtaatcccagcactttgggaggccaaggcaggcggatcacgaggtcaggagattgagaccatcctggctaacacggtgaaaccccgtgtctactaaaaatacaaaaaattagccgggcatggtggcagtcacctgtagtcccagctactcaggaggctgaggcgggagaatggcgtgaacccgggaggtggagcttgccgtgagctgagctgagatcgcgccactgcactccagcttcggcgacagagcgagactccatctcaaaaaaaaaaaagaaaagcctggagtctggacactggtgtctgatttgaccatatttgaccataaccttcccattggggaccaaagaaagtgagtttaccatctccttgcaggatgcaatgcccgtcccaagatacacagtagagtaatcggtgccctagggctgggagtttctcagagtcatgcctcaaatcctctggcacctccccaaagatttaagaatcccagcgttgtccaggtatgatggctcatgcctgtaattccagtactttgggaagccaaagcaggaaggattacttgaggcccagagtttgagaccagcctgggcaacgtaatgagacccccatcgttatgaaaaaaaaagtattaaaaaaatttttttttttttaatctgcgctagtcccctttccaagcttccagatgtttcctcctctgagtgatccagccactagtcactgcccctgggagccacagagtaaggggcccaggagaagtctcgctttgggaggatgtgagagcacacgccccactccaggaggaccccaaaggaggctgactcagcagagcaaggtccaaactctggaaacccaggctctgccgtcaccttcttctgtgacgttggccaaatacctacctctcacgggccctcagcgacccattgttaacgaggacttggaacatgagtatcgaaatgttccctcccatcctaacaccgtaggatcagtactttactgactcaaattactaggtttgccacatggaagcctgccagctacacccctcagagcagaggctaacacctgagaggagaataaactggttcctccagcctgggaggcccaaccctgtggcctcggctctgtctctgcagatattcctgccccagcctgagaggtgccaagaccctctaggctgttcactctgctcctgcctaacctggggacctggcccccaccccctaccctcattctctcagtgggagagaggggcagcctgttggggtgcagagggaggggcacagggaggtagacaggaagggaggggcagtgtggctggcaggagtcagaatcaacccttcccaacaaaggcagctccaccaggctggcctctctccagcttcccaggagccctggcgtcccagccagagggatctgtcgaaacacagtgccaagtcttaccccggcactcctgtcttcatgctctttggagttccttttagccctctgcattcttccgctccagccaggtttctttacttttgggcacttcctacccaccttccacccctacccatagcagtcctcccacacttacacatgtgcctcttcctttccatcctcctagcctttgttcaagccactacccccacctggaagccggcccctggccacctttctttttcttttttttttttttttttttttgagacggagtctcgctctgtagcccaggctggagtgcaacggcacgatctcggctcactgcaagctctgactcctgggttcatgccattctctcgcctcagcctctcaagaagctgggactacaggcgcccaccatcacgcctggctaattttgtttttgtatttttagtagagacggggtttcaccgtgttagccaggatggtctcgatctcctgacctcgtgatctgcccgcctcggcgtcccaaagtgctgggattacaggcacgaaccaccgcaccgagcccctggccacctttctatacaaactgtgccagcctttagggcccatctcccagagaaacccagccttcactgtctgtctcaagccactcactggcctctctgctccgtggggagctctgtactgtaaattgtccctcctactcagagcttctgaatcctccccacccctgcccccacctccctgttgctggttagactggggccaccataaatgatgcctttctgtgtaactgaaatctcccctagagattgagaactggtaataacccatctggattcaccttctgaagatctatctcatcctctctgggccccgataacaatttctcttgtacctggattctcctggcagtgtaagagtcctttcactgcctccttttagctcttgtccgacacaagccatgccacaaatctggcacagccatgacctgctgctcaggctgtgcactgcacaactccaggggtattattcactagaccacacgtgatgacctaaagtcaggtaccatggcagccctggggcccaaagctctgccttttctctccgtgggtgatctactggccagattttaaagggaacatctcacaggtcatggtgcagacccctcattcacaggccgggtgccacagcctccactcctggccttcagcagccctttgttcctgtgtcaccccccgccgccccaccccgccagagtgaaggcctgatcattcctgcccatcagtctgcccatccgaggcaggtggtactgaacagccaccccgctctctatgttctccttgggcctcagtttccccagctgtgaagaaagagatgggttcctgatctccaagggctccctctgttctgaagctcaccaatctattcttcacagatgttgccaatgaggaatatgtgattctcatacacacattactgtgtgttgtttttgattcagtaggcttatgagcatcaagaagagaagggagaccaggcgcagtgcctcacacctgtaatcccatcactttgggaggctgaggcaggcagatcatttgaggtcaggagttcaaaaccagcctggccaacatgatgaaaccttcgtctctactaaaaatacaaaaattagctggatgtggtggtatgtatctgtagtcccagttacttgggaggctgaggcaggagaatcgcctcagcccaggaggcggaggttgcagtgagccgagatcaagccatgccctccagcctgggagacagaccgagactccatctcaaaaaaaaaaaaaaaaaaaaaggagagaagggacatttacaaaatgcagaggagcctgggagagctgagctgagaagggagaggtaaccagactccttgggatgactgctgagtgtggggggcaggagcccaggcactggatctacagacacggggaatctgtgttgcctcgagggaaagggccaagcgtgaaattgcagcagaaaaaaaccaaaatgttagaacagcacaaggcattgatgctcagagcagggcagtttttccacctgtcactggaacaaattcccacagactctcagcccagggaccaaaggacccacaggctaaggcagagggactgagactggcacccccatttggtaagggggtgacctatcagggcagtgacagagagagtccttcgagtccaatagacctggctgtgagtccaggctctgcccagaccctctaagccaccttgaggctgctatttctctgagtatctgtttctagatgttttaaaagtgggagagtcgcatttcctccctcccaggatcacggtacagtaaagagcttagcactctgcctaatacatagaacaagcagcaaatgttcactgccgttgcgatgacagtgccctggcaggtgacctgtgctcaaggcgtcccagtgcacacacacactcacacacacacagggtagggcagcagatgggacacacgccctgccacaggccattttaaggagtcggggtgggtgaggacccaggcacggtggaggaaagagggaggcaagaagcctttttcagcttccttggtgtcatctcacagtgcctccctcaggaggggaaaagggaggggagtgagaaggctgtttagctgtgttccatactggctgtgcctcacacaaccggccccaccccgacaggactccttggggacagaacgggagtgcattctcaggcacctaaatcttacaggctcagtgcctgcacagggagacgggtccgcagcccagggtcccgggcagctttcgggcttgggggtggattgacacacagcccgatggtattcacacccattccttcactgtcgcgcccggtcctgggggacggcatggcaccagccaacgtcacgggttgggtgtgagttcatggtagattctcacacgccagcctcacaagaggcactgccgagaccaggcttgctgccgcctactgtatggccggccctgtgggcacagctgtcctccacccgcctcccaaggcaccatcgggcccagaatgtgcccgatgagtcacgggcctgggtctccccagcatgggcgcagcaggggggctgagtccgcctgagccccggtgcccagctcagggtctggcacagagcagatgctagtgaatgaacgtcgggctggatgaatgaacgaatgactaatgcccgctccctcaaaccacaggctacaccgtctgagcctgggggagggcagagcccacgggaccccagaagaggcctccgcagctgaggctttgcgtcccagggtcgatgggggagggggcggggcggccagcagccggcgcggcacggggctcccctccttcccgagaaggaatctgggtctctggactgagctggtgacgggggctggggcggggggttgtggcgtcctggatggagagagctgcaggagcagggggcgcgtcccggtttgcgttggggtgtgggacgaagcggcggccgcgggacatccccttcggtggcgaagcccgggtctgcccggggcctccgcggggtgcagagggctcccaacggcgggactggcccggggcgccgcagacctggccctttccggcggggccgtggagaaggggacgcggtgtcccccgaggtgaccgggggcgcaggaaggacggggggcgcgcggagccccctctccacgcgcgggaggtccagccccgctaccgccccctacgccctcccgggacctccgcccacctgcgcgaggggttcacctgggccggcggcccctcctctagacgcgcgagtccctcccccgggccccggccctgccctccccgcgcccgccctcacctgcacggcccgccttggccatgtcccgggcggcgggctccggcggcgctacgcgcgctcctcgcgcttcccgggcccggccccgaccgcctccggccccgaacggactccgagcgccgcgcccgcgcccccgccccgctcgcctcggctgccgccaccgcagccgccgccgc

SEQ ID NO: 551 - DNA, 105296 bp, Homo sapiens; identical to SEQ ID NO: 550

SEQ ID NO: 552 - DNA, 319984 bp, Homo sapiens
tcccgcacccacctcccggccccaggcacactgcatcggcgcggacgctccggccccggcgaggtggctgcaaactcgcgggcacgcacggcgcccggggagccgagggactcgggggaggggacgcgcgcggaaggcgccagcttcctcccgcccgcccctggcagccgcgagccgaggttggaggcgcccggggccccagccgggcagagccgagcggcggcggcggcggcggcttcccttttctccccgagccgagccccggagcggcgcggggaccggccctaaaaagagcaggaaatcttgtttaccgcccgcggagagaagccgatcgagcctttgtctggaaagtcagcatctccggctccggctgcaatgtgttcctggtgacattagcatcgggcagacccgccggaggaggggggtcgccaggttcccgtctgctttcggaggcggatcgagcgggtgacttttgtgcattcgttttaatttttggaaatctctcttttttcctccctcgctcgctgccgggcatgtcctgatctggcggccgctcctaccaccctgggcagccgagcagagtcgtccccagcgggtctccctccctgcctccctgactttgcaacaccgcgttccgggaggaccggcctcggcgagggaggaggcgggggagctgcgaacacccagacccaaaccctgacatgctctggggcggagaggaggaagccaggagctgagcgcgccgcgggggctgcttcgccctccggctccgagcgccgggctccgggcgccctgccctgcgcctgggcagcagccttgctggtcttgggggcgccccccgcttcccgccccgggggtccgcggccggcaggaccatgctgctgaaagagtaccggatctgcatgccgctcaccgtagacgaggtaagcgccgcgcccggcccggcctcgcccgctccgggacccccgccgctaccgccgcctcctggccggcgagccccgggcgagcggcaggaaacccaggtggacgttaccccgcaaacccgaagcctggaggagaggagggaggggatttgcggcttccacttgtcaccccagcgggggagggcggcgctgggtggggcggcggactccgggtgggcttttcgggggcgcccagaatccagactgttggggatcactatgagccaaagggagtgggtgcgccccctccctccaaataagaaaatgaataaaccaaacccaagagcccccggcgcgcgctgtagctggggtttggggggcatcccgtcctggccgtgggcccagcctcccctccccgccctctgcggtcaggtaggggtgcgaggaggagccctgcgccctcgggatctgcacgccccgagccccgcgggaggaacctctgagcccttaggggaggtccctgcggggcccgacttctcgccgtcgccgcgggcttgggcgcagctcccggcacgtccgcccttcgaggctcgggacccggctgtgtcctttcgcaaaccgcctggctcggaaactttctgcgtctcttgtttcttccgccgcggggagcggcgcgcgagccgggagcggcgggggctgcgacgcggccacaggagggcgctccagcacgtggtgccggggccgcggctgccggctgggggcgccgggcgcggggcgggggctcgtcctccaagcgcggctctgctgtccttctcccgatcctgcgaagccgcgagctccagtattcaggaagtggtgactcagataggattattccggccccggcttccctttcttccccttcttcctccccacctttgtggtgattccacgactgctgagcgtctctgtccagggacagcgagggagcccaaagccaagcaaggcaacgtgaaactcactagtgtggtttggtgtggcaacacacatgaaatcagccacccagaccgtctttatatttaaatctggtgcctcgaaactatcagatatgtttttgagccactacttggtgagaggggcgatgtgctttgggagagaaaaagatgcataactgagaacatggctgagctcacaggggctgtccgtatttgccatctggaccaagggttaaggtaagacccaagtacaatccaagacaagatcaaagtagctgcaagtttacaaaacgcatcacggggacacaggctgccaaggagggagagatcagcttccaccagaatgaacaaccgagttttggagttcgttggcatttgaggaggtagcatttaagcagggtctggaagggtggatgccaggtgggtagacagagattcgagttgcatatgaccttgtaagtggagaagcaggacatagctttgtggagaaagagaagggcaaatgaatgggactggttaataggagtctttccagaaaaggtggagattgtcccaccttgtgggcagttgagctagagtaattcagctgggaggcatggatccctctactccatatcctaatgaccttgttttttgatatgagtttggattctaggagcaatgttgggactgcatgaaatacacagaaaattgcaggtgataatcaagaaaagaaccagttctagaatcttctctactaactacaaaatctctttatcctagttggttcccttttcaggctttctgaaacactcaggcagatgcttttcccacttttgtttttgtaccgaaatacccacaggtataccgtggggtaattacatttgaatgatataggtggaggcccttccttccttccttccttttttttgtcttttcttttcttttttttttttttgagatggagccttgttatgttgcccagggtggggcgcaatggcgagatctcggctcactgcaacctccgccacctggattcaagcaattctcctgcctcagcctcctgagtagctgagattacaggtgcctgccaccacgtctggctaatttttgtatttttagtagagacggggtttcaccatgttggccaggctggtcttgaatgcctgacctcaggcaatccgcctgcctcagcctcccaaagtgctgggattacaggcatgagccactgcgcccagccagcccttcctttcttaattggccaacaaaatcagactcatcagactccacctgtaatataattataaattctttaatgtataattcattttggccaaagtatgattcagtttctgtaaggttcatattctgaagtcattttcggctttgtcagagaagcaggagggcaatttagattaatagatgtttccaattagtaggattcagattagctaaatctgatgatggatgaagaaatgaggcctagtttgccagatgttaaacccctagagtcagaactgatagtaaattccacagtctccaccatccccttttccactgaccctttttccacattgaaaatgaggaagcaacttgagtttctttaaataagatgtttaggtaaactttggaagcctaactttttttttttctttttgagacacggtctcgctctgtcatccaggctggagtgcagtggcgtgatcctagttcactgcagcctccatctcctgggctcaagtgatcctcccatctcagcctcctgagtagctgggacaataggtgtgtgctgccaacccggctaatttttttactttttgtagagacagggactcgctgtgttgcccaggctggtcttgaactcctgagcttgagtgatcctcctgcctcagccttttaaagtgctgggattgccgggtgcggtggctcacgcctgtaatcccagcacttggggaggctgaggtgggcagatcacgaggtcaggagatcgagaccatcctggctaacacagtgaaaccccgtctctactaaaaatacaaaaaaattaagcaggcctggtggcgggcgcctgtagtcctagctacttgggacgctgaggcagtagaatggcgtgaacctgggaggcggagcttgcagtgagctgagatcacgccactgcactccagcctgggcgacagaacaagactccactcaaaaaaaaaaaaaaaaaaaagggctgggattacaggcatgagccactgcgcccggcctgggagcctaacttttgcttccactcttggttggctctgggcctgattcaacctacatggaacttctggaacttgtttctctctcttttttttttttttttgagacggaatctccctctgtctcccaggctggagcgcagtggtgcaatctcagctcactgcaaggtccacctcccgggttcacgcgagtctcctgcctcagcctcccgagtagctgggactacaggcgccagccaccgcaccctgctaattttttgtatttttagtagagacggggtttcaccgtgttagccaggatggtctcaatctcctgacctcgcgatccgcccgccttggcctcccaaaggcgtgagccaccgcgcccggcctacttgtttctctttaatcaccagagttcattggtagcagtgtccatacttttgaaaatgaagcaaatgctcatgctttgaagaatcagtgagagaacccacactttgcctgcttcttgtgcctggccttatcccttctccctcatttaacactctggtggtggcgggcggtggagcattagtggcactggtgtgttattatctatattttgcagatgaatacattgagattcagaagggttaggtaatgtgctccaggccacacaactagttaatagccaagccagaaggagagcatggtgaaacccattatttgtttttccttactctgctttttgcctgtcactagtgtttaatccagcaaaaggaaaaacatttcttgaaaacagataaagtcagcactatcaagtaaatgaaaaatcagaggccttttgacttgctatagacggtactggcctctactatttctctagctttattttaacacataaaatgttctctagttccaggaaaaaagaacagctctgggcgatcaagaaaataaagctgaactactgtctagattagagtgttggtggggttttttggtgtgtgtgtgtgtgtgtgtgtgtgtgtgtgtgttttagacattaatttcagagtaaagaattaataaaagtaacattccatagattaattttaattaaaacatttcattggaatagtccctcgtttgtgttaaatgtggtggtctctgaactcaatataagcctgttggaaaggtatgaacaggaaaagttcctgagagctgagagttgctatagagagaaagttgtcattatcttcatttgaaacatttggtagacgtagatgtagattctagagtttttgtttgtttgtttctttttctgagccacactctctcgctctgtcgcccaggctggagtgcagtgggatgatttcggctcactgcgacctccaccgcccggtttcaagcaagtctcctgcctcagcctcccgagtagctgggattacaggcgcccaccatcacgccaggctaattttttgtatttttagtagagaaggggtttcaccatgttggtcaggcttgtctcgaactcctgacctcaggcgatccgcccactttgggctcccaaagtgctgggattacaggcatgagccactgcccccggatgattctagagttttagacttagaaggcgtattggagatgatttataattgagccatttatttatttatttatttgtttgtttatttttgagatggagtcttgctctttcacccaggctggagtgcagtggcgcaatcttggctcactgaaacctctgcctcccgagttcaagagattctcctgcctcagcctccagaatagctgggatttacaggcttgtaccaccccagccagctaatttttgtgtttttagtagagatggggtttcaccatgttggtcaggctggtctcgaactcctgagagttcatgcccggtgagccatttcattttataatgaagtctagacctgtagtaggtgcagttaagttgtctacctcattgacaaactctaggctagaaccaggtctgatttaaggctcaaggctgttctactatatggaattctccctcctctgagattccttggtggaagaaaatattctcctgaggacccatgtgtaaagcaggtacactggctctactctctagttgaaggtggctggggactccaaccttgtgtctgcttagcgggacacatagggtagccccattggaacctattggaagggtggcccacctcctcccgcagccactcggtcccagtgagcgacctgctcaccaaggaggctccttggagcacagtctgaagatcaccctgcacctgccaccctcgccacagaggtacttgttagtaaaatgagcgtctctcaagagacgctaagcacatcctaatattatctaaggcaggaatccttttgttttcattgctttctttactgtttaaccgttctggccaggcgcggtggctcatgcctgtaatcccagcactttgggaggctgaggcgggtggatcacctgaggtcgggagtttgagaccagcctgactaacatgagaaaccccgtctctactaaaaatacaaaattagccaggcgtggtggcgcatgcctgtaatcccaggtacttgggagggtgaggcaggagaattacttgaaccagggaggtggaggttgtggtgagctgagatcgcaccatcgcactccagcctgggcaacaagagcaaaactctgtctcaaaaaaacaaaaacaaacgaacaaacaaaccaaaaaccagttcttgtttaacagttcctgttctgactgcattcacataaatgtgtatacttttagggattgatttgtggtctctagggatatggtgcacaatgcagaaaaatagaaacactcccctcccctccgagaaaagagaaggaaaggaaagaaaagaaaaacaactttttcatacagaatattattttcttttttgccctggcagggagccagtgcacttcatccaggcacccccagggtccccagagagttttcttgcgcacatttctgagaacggatttgggatcagggtggtgctgcctctggaatgacatgaatggaaatgccaaaatgcccaacagtgttccttgttctctttttttttttttttgagacggagtctcgctctttcgcccaggccagagtgcagtggcgcgatctcggctcactgcaagctccgcctcccgggttcacgccattctcctgcctcagcttcccgagtatctgggattacaggcgcccgccactgcgcccagctgattttttgtatttttagtagagacggggtttcacccttttaaccaggatggtctcgatctcctgacctcgtgatctgcccgcctcggcctcccaaagtgctgggattacaggcatgagccactgcgccgggccttgttctcagttttaaaccattttcctgaaatgcatctgcaaacatatcaaggcagaaattattgaaaggaagagattttaagtttgctgctggcgtcaatacctctgaatataaaggataaagactccttggattaatctcacagactttccccaaggtttcttgtaaatgtaatttggaaaatgttttccttgtctggtataaaaattttattctgaataagataattctataaaaagttttctcaagaacgagcacaattttgagaggttgttttattttattttaaattttctgttgagaagggaccaaggtcagggtcatgcgtgtgatttctgtgtgatccaggtggtttccttggtggcttgttctgggaggtgaagccagttggacttcttggtccggtggggacttggagaacttttctgtcttacaagaggattgtaaaatgcaccaatcagcgctctgtagctagctagagatttctaaaatacgctaatcagcaggctgcaaaaacgcaccaatcaggtctctgtggctagctagcggtttctaaaatgcgctaatcagcactctgcaaaaacgcaccaatcagctctctgtggctagctagaggtttgtaaaatggaccaatcagtgctcagtaaaatgcaccaatcagtgctctgtaaaatggagcaatcagcactctgtaaaatggaccaatcagcaggacatgggcggggacaaataagggaataatggctgaccacccctcccccctcccctccccccaggcaccttccaggctgtggaagctttgctcttttgctgttcactcttttgctgttcacactaaatcttcctgctgtccgctctttggtccgcaccacctttaagagctgtaacactcaccgtgaaggtccgcggcttcattcttgaagtgagcgagaccaagaacccaccggaaggaaccatctccggacacagttccacagccaggggacagtggaggtttggctagctgtctggcaaagctccggtttttttttttgtcataacgggcacagggaaaggagggcgggtaaatagatttgtgcaaacctttcaacactaatggaacagacaaggagcagatgctgtcctcctggctggtcagtgaaattgactctgtccatgaaggaagctgcattttcccagtgacttgggtggaagtacctggcgcaggagatagatacagggatcagggaagcaaactgttgttaacaaaaccctggttaaaagtaggtagtaattaacttttgctttttcttattgtgatatggaggaagttcctaaggctcttgaaagtcaatttagaaaccttgtgtctgattgcgtgagtgtgactgatactccaaagcaaagcgagtaatattcatttcagtaaggctgtcgtttcaggcgaatggagaatattatttattgtaggcattaaaagaaattaatatactttatttattttgagacggagttttgctcttgtcgcccaggctggagtgcagtggcgctatcgcggctcactgcaacctccgcctcccaggtttcaaggggttctcctgcctcagcctcccgactagctgggattacaggcgcctgccagcatgtccagctaatttttgtatttttagtagagtcggggtttcaccatgttgtccaggctggtctcgaactcctgacctcaggtgatccacccgcctcggcctctcagagtgctgggattacaggtgtgagccactgcgccccgcctaaactaaattaatatagtttaaacattcaacctctttaagagcttcccctctcctagggatgtgtaggtatgagatggggagtggggaatcacaacgttttgggtttttaaaaatgtgaaagtgtatgcacaaaggcagtaaatgtgtttttcagaagcagtaattactggaaaagtacatctaggttcattgctttagcggcctgagtgagatcgcagcaccctggctggcttgtgtgggctttggcctgttttctgttgcctggaggtctgtagtgttaggcaagtctgaaaactaggtaacacttttgccctgtatcagagaaacagactgagttctagaaatcagctaacttgtactgagaaggttttatgtatctttaacaaattcagcccaccgggagaggaaaaggagaatttcagactagaaatcaggaattttgtatattcccaagtgaagatttttcttgtaggttacaaggaggatgaggcgcaaatatattacaaatattaaaacggacaaaccaatcgtatctggaaaatgtagagttgtctggaaaaataatcttggaaactttactttttgtactatgcaacctctaatttacaaataacatccaaatcattcaaacgaacagcgtcgcagggctgcacaccgccagggggcgccatttacatgggacccagtgggagtagagcagtgtgatggcctgcaactgaccaacctgccttttactgccctttcatgctcccagcccctgctgctctcctgggttagaaattgaaagtttataccaaactcatgggtttacaagtggaaacatcacacccttagcatcgtctttcctgaacactccatctacaatagctttttcctcatctaaatctctggccaggcacagcggctcacgcctgtaatcccagcactttggggtgccgaggcagacgggtcacttgaggtcgggagtttaagatcagcctggccaacgtgatgaaaccccatctctactaaaaacacaaaaattagctgggcatggtggtgggcgcctgtaatcccagctactcgggaggccaacgcaggagaattgcttgaacccgggaggtggaagttgcagtgagctgagatcgaggctgcactccagcctggctgacagagcgaaactctgtctcaaaataaaatataaaataaaataatcttttccttaatattctcgctatttatatcctctattatctgcctctccacgcctgtttattccttcagagcatttatcgcaatttgtacttattttgtttaattgtttgttgtctatcgccatcattatcttttcaacatgtaatccacatgagaaaatactgatacaatcttttcacttatttttttcacactaagtctttgaaatcaggtgtgtattttccgtggacacgcatctcagtttcactggccgctctgcagtgctcaaggaccatgtgtggcttgtggctgccatactggacagtgcaggtctggtgcttaaacttagggtccacacatagtaaatacttgctgaatgaatggataggaagaagctgaggaaaacaggaactttttaaggaaccctgatcctctatgtcctcctgtaaaaggtttaaaattttttcacttgtatactgcctgaaattttaccaattagagattcttttgtatttaatacatcctcattaaaaaatttcttagtgatacccctgagaagtttgaaatcagtcacatatatttaggagttattgccgtcagactgctttcctcccaattcccggaggagtatgtatattagttttcgtttctttttttcgtgtttttttttttttttcccttggagtcttgctcttgttgcccaggctggagtgcagttctttcagctcactgcaacctctgcctcctggtttcaagtgattctcctgcctcagcctcccgagtagctgggattacaggtgcccaccaccacgcccggctaatttttgtatttttagtagagacgaggtttctccatgttggccaggctggccttgaactcctgacctagtgatccacctgtcttggcctctcaaagtgttgggattacaggcatgagccactgcacccggcctcttttgttttttactctgagacatagtcttgctctgtcacccaggctggagtgcagtgtgcatgatctcgactcactgcaacctccacctctcgggttcaagcaatcctcccgcctcagctttcttagtagctgagactacagactagcaccaccacacctggctggtcttgtatttttagtagagacagggtttcaccatgtaggccaggctggtctcgaactcctgacctccggtgatccacccgcctcggcctcccaaagtgagccaccgcgcctggcagtatattagttttctattgctgtgttacaaatgatcacaaactcagtggcttacaataacacccatttattagcacacaaattctgtgggtcagaagtctaggtgcagcatggctggattctctgctcagggtctcataaagctgacatcaaggcgtcagtcaggctgcctttctttctggagcttggagttgtcttcagggttcacatggttgttggcagaatgcagttccttactgcatccatcagttagaggctcgatcccagaggccacctgccgtgtcctgccatgtggccctctccacaacatggcagtttgctcttgcaaggctagcaggagcttctactgcaacttcagatctctccgacttgctgtctctgacttcttgattcttttccaaaagggctcaccaatcagtgggaatcttgggggccattctgcctctcctagggagattagctgaattagagaagtagttatttcttgaatctggaaaacagggctatggaagttccaggctggcatcatgaaaacatccattcacagatactttattgaactcctgctctgtgccgggtgctaggcctgcagcggctgacagggcaggtagatccctgccctcctgaagctcctaggccagaggacactggagaggttttattgccatttaaaaatagatgatggccatagttgcacaagtctgtaagtgtattaagaaccattgaattggtatgtaaagtacatctcagtaaagctgttttttgttttgttgttgttgttgttgttgttgtttttgagatggagtctcactctgttgcccaggctagagtgctatggcgcaatctcggctcactgcaccctccgcttcctgggttcaagcaattctcctgcctcagtctcccgagtagctgggactacaggcacgtgccaccacgcccggctaattgtttgtatttttagtagagacggggtttcactgtggtagccaggatggtctcgaactcctgacctcgtgatccacccacctcggcctcccaaagtgctgggattacagacgcgagccaccgtgcccggccaaagctgtttttttagaaatagaagtgcttacagatttgtttgagcagaatagatacccatgttcagagagagagagagagagccattgagaggcagagagtgccgaatgtgaattctgtgtaaattgaaaagttacggtccccgtccataaggagatggctctggttgtcttgaatttagacagctttccagaggaggaggttctctcctgcagcagtgtgggaaaaaaatctaccagatttggaccagaatgactgcaatttaggtcagaacatgatacttagagggaaaaaagtaatcatggcttgaatagctgccctaaggccagctacagggctgcaggggtctgtggaacctttcttgtcagaactcaggatccttaggagtccccacaagggcatggaggctgtggccatcatgagtggaagaaccagcttccaaaggaacctaggattgttctggccctggctccaggtgcatatctctgctttccgtgagcattgaatgggaaatcacgtgttagcagaataaatcccagaatacacattcaggaggagatggttccacatggcacgtaagtcctttgccttattgatgtttgtctggcagatgtccttaagccttcccatcaagggctttattctaagggtggctaactggctatttaaacctcatctcaatagtgtctgtctaggatggcaaaatcacaccaggttctgctgggcaaatctcccaggtggcgtattgctagaggagagcgccactgcagaggacacactgtcttggccactggctttgcaaaccatagtggaggagggagtctggggtcaccaaccacttcctggctgactgcctgagccacattatacaagactgtttgttgacttagtaatactgaagccagagctcaccaagattctgacatcaagcatgaaagtgactaattctttcatttcccagcactttgacaaaggggactctcttaaaactcctcatcggacgttagtggaagtcgactcatgtatctaaacatgtagccagcgtaagttcttggtcagattgatctaatgacttttttagcgtgtgtgtgtgtgtgtgtgtgtgtgtttaatctttttaagtttgggtgaagtttgaccttctagaattcctgtttattcctgagcaaagaaaaaaaaatcaaccctttttaattcctttagcatcatatctgaccatctttagggtgttgtttctttcctagactgaatcactcagagaaataagattggccaacaaatgtaatttgatgataccctataataatgttgtttaagtacctaatctaagccgctaatctccaaagactgttcccccgccccatgtcatcttacacacacacacaggcacaaaaacacacacattctgttctgattatatttgctgtattaaggccaaatccaggtgtttctgagcactagtttgtgtgtttttatgttgaaaataactagtttatgtatttatttatttatttatttttgagatggagtctcacattgtcatccaggctggagtgcagtggtgtgatcttggctcactgcaacctccgcctcctgggttcaagtgattctcctgcctcagcatcccaagtagctgggattgcaggtacccaccgccacgcccggctaatttttatatttttagtagagatggggtttcaccaggttggccaggctggtctcgaactcctgacctcaggtgatctgctcacctcggcctctcaaagtgttgggattacaggagtgagccaccgcaccgggccaaaaaatccaatttcttagagattaaataacccttcaggattatcaaaggaaataattagggaaaggtagatgttctgtcccagtaagagaagaaagtggtccagaaattttatctcccatcaaatgatccattttacttaagtattaaaccaagtgacattcttcagtttaactctgataaatgaatcatattcctcttcgaaaataacttttgtatttcgtgctctaaaaagagaaccacccctacactcttggaaattattccttttaatggcagtaaaaacctttggctttcataggcatcatcagcagagatgttagttcatgagcacctgtgagtttctcaaaattagtatctgaaaatgatgggaacacacaagcgataccatcatgtctttggcacatttagttgaaaacttaaaattcttccggtggaggtaagcaaattggaaggtattaaaaatgatcagagtgtactattcagagttatagatttacccttccatccaagatggctgcgccttggaaacccccagctcacttttactagcagtgcctccagatccagtttctaaatcacacagggagattaacattattcttttatagtcacactgcatgtggactaaaataattttttttaaagagaccggggtctcgccatgttgcccaggctggtctcaaactcccgagctcaagtgatctaccagccttggcctcccaaagtgctgggattataggtgtgagccgctgcgcttggctaaaataaatattttaaaatttaacacgattattattttgaaattggaactctaaaagacttttcaaaattcaaaatgatcaggaatgttaaaaacaatgaaaaaaagcacccctaaacctgccctagattccccaggggagagtcaaagatgttttgctttgtatcagcactattgaaataaacatattgtcacctaaaaggaactatttgaagaggactgcacttcactggatgtgtatatcctggtgagttttttattaatgtttattgttttttaaaaaatgtgttaaaatggctgggtgcagtggcttacacctgtaatcctagcacttcgggaggccaaggcaggcggattacttgaggtcaggagttggaaaccatggtcaggagttggccaacatggtgaaaccccatctctactaaaaatacagaaaagttagccgggcatggtggtgcacgcctgtgaccccagctactcaggaggctgaggcaggagaatcgcttgaacctgggaggcagaggttgtggtgagtcaagatcgcaccactgcactccagcctgggctacagagcaagactccacctcaaaaaaaaaaaaaaagcagaaaaatgtgttaaaaatatacacataacatttgccatcttaaaacttttcgagtgtacagtttcagtagaattgggtacacttacattgttgtccagccatcaccaccgcccatcttcagaacagttttcatcttgcagaattgaaactctgtatccatttaaccctaaatccctatttctccctaccccaaagcccctggcaaccaccatcctactttctgtctctgtgaatttgactactctaggtatctgatcaggtttttttttttaattggttattacttatcattaaactcattcatcgtttcttgaaataaacccaataaactttaatggaagctcataagaatttttttctgaattctgccctctgtcaaaggaagaaaatgacaacatggacgcatatctgtatttgggtggcattaatgactcagtgaccttcacttttgcagccagcgaaatacttggcaattttaatttagaaatattactgtatcatcatttaacagaaatacttactaaagcagaaatatactgactttagaagcatttcaaagaagcagggttggcactgaccagtgttctcttaaggtagaagacagaatatttgactaaagacagtgctgtagcaggtagaaatagacattatttagaccccttttctgagtaaggaagaccagttaaaatgttagcttattttttgggattttagaaatgtttaactcaagagaaaaatataacttaagtcagtgtaatggcgtatgaataagttaaccgtgtaacattttcttttttcttctgcctcagcctcgcgagtagctgaaactgaacaggcacccgccaccacacccgcctaatttttgtatttttcacagagatggggcctcaccacattgaccaggctgttctcaaactcctgacctcatgatccacccatctcagcttcccaaagtgctgagattacaagcgtgagccaccatgcccgacccatcttattttttaaagagggagtttagtactgattcttagatcaaaagcagccaaatccccagtatcacagaagagatgagggtctggttatgtggcccaggctggtctcaaactcctaggctcaagtgatcctcccgccttaacctcctaaagtgctgggattacaggcatgagccaccaagcctggccttctttaacctttgtgttgtaaatgtgtaatgttttggtaacagtaagggttaaataaacaccttttctccctagtaggaaaatgcttctcagattggattgaaactctgaagaccaacatttttctagatactttcttggatagtgttcatgacaaactgctacttgaaagtggcaggaccattgtactataaaatctaataaagcccaggtcattggctatagggagttgaaagctctatttgtagacatcactaggagaactgacaagaatgaaaatgttacacagttaaggccgggcacggtggctcacgcctgtaatcccagcactttgggaggccgaggcgggtggatcatgaggtcaggagatcgagaccatcctggctaaaccccgtctcgactaaaaatacaaaatattagccaggcgtggtggcgggcgcctgtagtcccagctacttggggaggctgagatagaagaatggtgtgaacccgggaggcggagcttgcagtgagccgagattgtgccactgcactctagcctgggcaacagagtgagaccccgtctcgaggaaaaaaaaaaaaggttgccaggagcagtggctcatacctataatctcaacactttgggaggatgaggtaggaggatcactgagcctagaagttcaagaacagcctggccaacatagtgagaccccatatctatttatgtatatattttaaaagttatagaaaacaacgctcttattaaactggtaattagcaactaaagtagaaaaacatcactggatagatggctgagaaaagggatctgtaatcacctgcttatctggacaggttttttcttttttttttttttagagatagggtcccactctgttgcccaggcaccatcatgactcattgtagcctcacacttctgggctcatgctatcctcctgagtagctaggacaacgggtctgcaccaccatgtctggctaatttttttctttttgtagagatgggcggggaggtgtcttgttacattgcccaggctggtctcgaactcttagcctcaagcaatcctcctgtcttggcctcccaaaatgctgggattacaggtgagagccaccacacctggcctggacaggtagttttgaaaacaggggttatcactagagaagtctgtgcttgagctgaggagcatgtcttctgaaatgtgtaaatttcctatagttagttccctggtggcgtggccctccatcaagaacattttgctgagttttccctgacttaaaataataacagtgatgctggtgctgatgaaaagactgatgtggcccttacatcccacatgaatcatcattcgggattattgtagcctccataaaagtgacgcagtggatgaaagtggtttttctcaatacttaaaaacactgtgaaaatgagataggtttaaagatataaatgtgattttttaaatcctgcccccccacccaagtgccaggagtttggtaactagaattgcatttagtcatcggggtacagattgtactgtgcgggctggagactcaaaccctgggctattgaaggccatgacaaatgctcattttttaatattatgtttttgctgctcatgaagaagcatcatgttcaaaatgaaaaatctttagattcaggacttaatagttcacctcttttggattgcgtttgacggaaacttggacacagctgagtgtaattatgcttttcagcagcatgacttatagtactgcagatatgggcatactttgagatttttctttttgccaaaatttgtctgaaaaggagcttggtggtggttgtgtgtgcttgtgtgtttttaaggtaattaggctattagaggtccaaatggaataatccccttaagccttttcaggaaaaacactttggaaaggttaagtaaatttaaaattagccattatttacgtaggtgctcagccttttgaccatgttctctaggagttgtttcttttacatttaggttatgtttgtcagaaaccatcttattttttatttttatttttctttctttctttatttttgagatggagtctcattctgttgcccaggctggagtgcagtggcgtgatctcagctcactgcaacctctgccctcaggttcaagcaattctcctgccttagcctcccaagtagctgggattacaggcaccggccaccacacctggctaatttttgtattttagtagggacggggtttcatcatgttggccaggctggtcttgaactcctgacctcaggtgatccaccagcctcggcctcccaaagtgctgtgattacaggcgtgagccaccacacctggccttatttttattttttgagatggggtctctctgttgcccagactggagtgcagtggtgcaatcactgctcgctgcagccttcacctccctgagctcaagcctcagcctcctgaatagctgggaccacaggtgtgtgccactacactgggctaattaaaaaaaaaagtttagagacagggtcttgctatgttgcccaggctgtttttcaactcctgggctcaaggaatcctcctgcctcatcctcccaaagtgctgggattacaggtataagccatttcacctggcaaccatcttatttttttaaatttatttttatttatttattttttgagacgaagtctcactcttatcccctaggctggagtgcgatggtgtgatctcagctcactgcaacctctgcctcccaggttcaagcgattctcctgcctcagcctcccaagtagctgggattacaggcgcctgccaccacgcccggctaatttttgtatttttagtatagacggggtttctccatgttggccaggctggtctcgaactcctgacctcaggtaatccacccgcctcggcctctcaaagtgctgagattgcaggcgtcagccaccacgcctggccgtgaccatcttatttttttaaagagagagttcagtactggttctgagatcaaaagcagccagatccctggtatcacagaagcttcatcacggattcatctatttttcatctccagaatggccacctcagtgctgtcctggccaaaaatctgttctctagacctggagaaggaactgccctgagggtcttccacacctctctttttgagaaaagttaagaacaaagtaaaaagatgcagtggagaaatgacgtcgggggttaatggattgggattttagggctggagtccaggcttatgttgctctctgctgagctcaggatctgcactgaacatctctctaaatcatgggctggggtaaaacctgcttacactggctcagaccggaggactttgcagccacctcaagacacacgtttgggtgtgtcccatctccaatcaggatgttcaacttgctttcttggatctttttgaattgcgaatttggccatagctgaccacttgtttttgcatcaatacttcaaagggttcaaggccaggtgcggtggctcacgcctgtaatcccagcactttgggaggccgaggcgggccgatcacgaggtcaggaaatcgagactatcctggctcacatggtgaaaccctgtctcgactaaaaatacaaacaattagccgggcgtggtggcgggcacctgtagtcccaactactcgagaggctggggcaggagaatggtgtgaacccgggaggcggagcttgcagtgagccgagatcgcgccactgcactccagcctgggcgacagagcgagactccgtctccaaaaaaaaaaaaaaaaaagtgttcaaattttaagtcctggtaatttatcccctcccatagcaagtattggcgcaaaagtaattgtggtttcagaccatgaattttaaatcattgtaactaggcccaaatacatctttattaatcaaaataatcaacacatttttgccaatgagaaataagtttgttttttcctttaatgtaaaaatctgtgcttcgggattcagcgaactcttggaaagcatttttttcttcatcctgctggttgtggaagcgtttttctgtataaaaagttgtcgagatgcttgaagaagtggtaatcggttggcaagaggtcaggtgaatatggcggaggaggcaaaactctgtagcccaattggttcaactttctaggcattggttgtgcgacgtgcagttgggtgttgtggagaagaattgggcccttcctgttgaccagtgccggctgcaggagttgcagtttttggtgcatctcatcgatttgctgagcatacttctcagctgtaatggtttccccaggattcagaaagccgtaatggatcagaccagcagcagcgaccaccagtgaccgggatctttttttggtgcaagtttggcttttgggaagtgctttggattttcttctcaatccaaccactgagctgatcatcaccagttgtcgtataaaatctatttttcattgcacgtcacaatccgatcgagaaatggttcattgttgtggcatagagtaagggaagacaacacttcaaaacgacaatgtttttgattttcgctcagctcatgaggcatgcacttatgaagctttctcacctttccaatttgcttcaaaggccgagtaaccatagagtggttgacgcagagttcttcggcaacttctcgtgtagttgtaagaggatcagcttttttttttttttttttttttttgagacgcagtcgcgctctgtttcccaggctggagtgcagtggtgcgatctcggctcactgcaacttccgcctcctgggttcaagcgattctcctgcctcagcctcccgagtagctgggattacaggcacatgccaccacgcccggctaatttttgtatttttagtagagacggggtttcactgtgttagccaggctggtctcgaactcctgaccttgtgatctgctcacctcggcctcccaaagtgctgggattacaggcgtgagccactgtgcctgtcagagggtaaactttgatggttgttctcagttggtcgttgtcaactttcaatggctgggcactagcttcatcttcaaggctctcgtctcctttgaaaaacttcttgaaccactactgcactgtgcattctttagccattcctgggggcaaatgcgttgttgatgttgagagttgtctccgctgctttaccacacattttgaactcgaataagaaaatcgcttgaatttgctttttgtctaacatcatttccatagtctaaaataaaataaacagcaagtaataagtcattagcaaaaaaagtgaaagaatgtgcattaaaatgatgtataacataaccacatttatttaagaatgtattccaatatcaaatggcaaattccaacagtgcaaaaacttacccctgaaaacaggcatagtcactttcaaacttgatttttctttcattttactctaccttttcatttgatgaaacacctttgcattttatctccctgagccaaagtacctgtaagttgcccggagttggggttggtgcaatactgtggaagagtgtggacacggaagacctagtcagtccttgctgtgtgatatcaatgatttgattgagaaagactcattttcctgggcctcacctgtcaattttctcaactgtcaaatgccctcttttggcctgtattaggggctgatctcatgcaatacggagcctactctgcaaatacaaggggtcatggtcattgtccatttgtggggagtgtgaaaacacctggtgatcatgatgggctaggtactgtttcacactttaaaatgcctttattttagggggaccctctagtgccataggtattttggagtctctgctttccaaatggcctatgggaaatcctgagatgtccgtgggatctaactttgcccagtgggaatgttgtgtcatagtcataaaggcttaaggattagtttatttccagccctgcaggggctataaattgctactttaaatttcattccagcaccctgatgtttatgttgctatggtggtgtgtctcttgctcgggtgacaagattgccattggaaataggccaaaataacagcctaacaggtggctgtgctttgggaagtcatttgcaaaactattttgcgaagaagtctggtgcaaataagtcacatgactgtgcccttaactgtagtttatagtttagcatttttttaaaacgcattcctccccctttccgttttatatatagacttttttcctctttcaagtagtgccgtgctgatttcctgtagtaacacaaggaaagatttcagctcattttatttagcagtggatgtcctttccttattttttgtaaccagagccctctttctaaaaataacccttcttttcctaatgtgattcttcttatagctgatgtactctatttaaatgaaaggcctctttttaacatgcccattttaatcgatatatatttattacatataactatatataataaaatacatatataaatatataataaaagtagatttccctgtagggtctaatccttcgtgaatgtggtagcagaaattgttcgttacgctttcacctgccaattatgattgttttctttctttctgtttttttttggagatggtgtctcactctgtcatgtcacccaggctggggtgcggtggtgccaactcggctcactgcatcactgcaacctccacctcccgggttcaggcaattctcctgcctcagcctcccgagtagctgggattacaagcatgcaccaccacacccagctaatttttgtatttttagtagagacggggtttcaccatattggccaggctggtctcaaactcctgacctcaagtgatccgcccgccctggtctcccaaaatgctgggattacaggcgtgagccaccgcgcctggccagttttctttcttttgagataaaatcacggaaagaacctgagtattaaaccagttaaacttcctacccacttaagagtcctttctatgataatcttggatggcaatcatcttgcctttgggcttaataccagccatcgcttgggtgtgggctctttttggtaatacaacctctatgattttccactttgatttgttggaagatgctttctcatgtttagttggtatctgactccttagagctttcaggatcgtttctaccactatagtgacaaacacaagccctttccacatgctgactctttaaacatttaaagaaatctataatgttggctgggtgcggtggctcatgcctgtaatcccagcattttgggaggccgaggcaggtggatcatgaggtcaggagttcaagaccagcctggccaagatggtgaaaccccatctccactaaaaatacaaaaattagccgggcctggtggtgggcgcctgtaatcccagatactcaggaggctgaggcagagaattgtttgaacccaggaggcggaggttgcagttagccgggattgcgccactgcactcaagcctagaagacagagtgagactctacctcaaagaaaaaaaaaaaagaaaagaaaagaaatctagattgttctcctttgatcttctcttccactggcttgctactctcaattccttcagattgaatttatgaaatgcttttgtctccctcaccattcctgtggttcctctttcttattgccctttagaaaatattgaacgcaatgcgttacagcagaggtcaactaactttttctgcaaaccgccagatagcaatattttagacttgcaagccgtaaggtctctgttgcaactactcaactctgacctcgtaacatgaaagcaggcatagggcaacatgtaaatgaataggcgtggctgtgttccagtaacattttatttgtggacactgaaatttgaatttcataaaattttcacatgccacgaaatattatgtgccttttgctttttcttttccaaccatttaaaaatgcaaaacccatttgtagttggagaggcgtacaaaaacaggctatgggctgcatttggcccatgggccgttatttactgatcttagatattggaggaccagtgctgaaaccactggaacttcagctttaacactagcactgtcattttcagaagccgcatcaaactgctggctgcttctgacaaggtggtcagttacacttggtcttctccaccccccatcccccgcccctccgccatttcctgacaaagctgtctctctaacctgtgggtatgtgttctgccgaaaacaagcagccataccacagcagccgtaaccataggactttgaaacaaatgcaatgaatggcatccactagtttcaagtttgaccacatgtttttattgtttgtttgtttgttttttgagttggagtctcgctttgtcgcccaggctggagtgcagtggcgcaatcgctgttcactgcaatcttcccctccctggatcaagtgattctcctgcctcagcctcccaagtagctgggattacaggtgcccaccaccatgcccggctaatttttgtgtttttagtagagacagagtttcaccatgttggccagactagtccggaacgcctgacctcaagtgatctgcccaccttggcctcccaaagtgctgggattacaggcgtgagccaccgcgcctagcctgaccacgtttttgattcttgcttctgttatatctgtattaaccgttcttcttagcttcgtggcagatgtgataagcatgcctttgtgtctttctctaagtcactgacttttcagtaacatctaaatcataaaacataggtctggccaggtgaagtgcttgtgcctgtaatcccaaggggccaaggcgggaggattgctttagtccaggagttggagactagcctgggcaacacagtggacctcatctctacaaaaaaaaaaaaaaaaaaaaaaagtcatgactgctttcctttgttgcagaaaccagtaggtatttgggtgtagaaatgaaaccctcaattatattcataaggctaaaaatgaactattccctacttcctcatttgttttgatttttaaaataaggttctcgttagatattttgagaaacagtttaagattataattttgtatgcagaggagaaaatttagaaaatggtgaagccaacttttttagtgtataaacatttaatcataattatatatgtgtccgtgtggacatttatttaccaaggctttgctttaaggggaagggagaacacagagggccaacatttatggaacattctagtgggccaggcccaatgtgttaatcatctcatttcaattttgcagttatcctccaaggtggatcctattatcttcatttaacagacgtggaaattgaggcttagaggatttgacaaaattacccccatcattaatggcagagctgggtgtaaaccctgggcttggactggcgttatgtctcacggctgtaatcctagcattttgggaggctgaggtgggtggatcacctgaggtcaggagtttgagaccaggctggccaacatcctgaaaccctgtctccactaaaaatacgaaaattagccgtgtgtggtggcaggtgcctgtaatcccagctacttgggaggctgaggcaggagaatcccttgaacctgggaggtggaggttgcagtgagccgagattgcgccgctgctctccagcctgggcgactgagccaggctccatctcaaaacaaacaaacaaaatccctgggctttttggctacaaattccattccaacaacacctttgttttgcataaccaaagagaagttgatgttaattcattgtcaagttatttgtaccgatatactaaatatcctaaaatggggatatgttcctcaattatttactggaatggtaacatttctggagcatatatcttcaaaactgtaatgtaaattaagaatatgaacattctcagtggaaaatgactgttcaagttaacattatttgcatttgccattcttttgtaaagccagaaacgtagatacaattttagattaccttcaagctattataaatcttgagggaaaccttgattgttttttagaaaaatatgtctatctagactgtgtcttgcaaacaggcactttaagatgtcattatatgaatattcagaaactcagatgtaatagaacctagatgagaatgtgtgataatctaaagatatcatttaagtcagggctttaaaaatacatgacttcaagtgaaaaactgagccttgtaaagaagttctttacaattcaccaagcatgctctaaacctgcatccatcctgagttctttaaaagcagacttataaaagggagatgaaagatattttcaaaatatatttttgaagcacaaagtaaaacatatttaatattttaattgtttgaaatgagttgcttaaactagtagctgctgctgggaatgacaaaagcttggctaagattattctatggggaagctggtttatggctttctggagctggtggccaggcatggtgtagattatgggttgcttgtaggattatgtttgttattgcctctttttttaactccctataggagcttttatagtgctttgcacatggtggttgcttcgttgaggatgactaccagtttatggtcatttaaattcagatttagggccaggcaccgtcactcacgcctatgatcccagcactttgggaggccgaggcaggcagatcacctgaggtcaggagttcgaggctagcctggccaacatggtgaaaccctgtgtctactaaaaatacaaaaattagccaggcatgatggcgcacacctgtaatcccagctacttgggaggctgaggcatgagaatcacttgaacccaggagttggaggttgtagtgagccaagatcgtgccactgcattccagcctgggcaacagagtaagactccgtttaaaaaaaaaaaaattcagatttagggacaggcgcagtggctcatgactgtaatcccatctactggggaggctgaggtgggaggatcatttgagcctgggagttcagggctgcagtgagctgtgattgtgccactgtactccagtctgggtgatagagcaagaccctgtctcaaaaaaaaaaaaatcaaatttaattttgtgttgattgtggcttaaaaaacaagaaaaatatattgctgttcaaaaatttttattttttattggatattgcacgggtatgaatcaatttacccataaatctatcgtccgtttaataagtagaatgttacgagtttactcaacattttctttctttctttctttcttttttttttttttgagacagggtctcgctctgtcgcccaggctggagtgtagtgtcgtgatctcagcttactgcaacttctgcctcctgggttcaagcgattctcctgcctcagcctcccgagtagctgggattacaggcatgcaccaccacgctcagctaattttttgtatttttagtagagatggggtttcgccatgttgcccaggctggtcttgaactcctgagctcaggtgatcctcccgccttggcctcccaaagtgctgggattacaagtgtgagccaccatgcctggcccctgttcaacattttctatatgtctcttcctgatcccagaccttctgtacatatgacattatagatgatttagtcttcaataacttgctattttttcctagtaacttttcaaagagatatcattcacatgccacaaaattcattcttttaaacaaatgtacagatccctagtttttagtatattcttaaggttatgcacccatcaccactattcaattctagaatattttcttttccctttttggagaatgggtcttgctatgttgccgggctggagtacagtggcttttcacaggcgcgatcatcacgcactacagccttgaactcctgggctcaaacatttctcctgcctcagcctcctgagtagctggatttcaggtgtgtgtcaccttgcttggccaattctagaatattttcactactcccaaaagaaacctcgtatccattggcggtcactccccatttccctgtttccccaaccactggcagctactaatctatactttctgtccttatggatttgcctattctggacatttcatgtaaatggaatcacacaatgtatggccttcatgtttggcttcttttgcttagcataatgtttaatgaaaggtgtgtgttgcagcatgaagcagtaagtacttcattccttttcatggcttaattatgtatatattatatatagtttttttttttttgagataaagtctcgctctgtctagcaggctggagtccattggtgcgatctcagcccactgcagcatccgcctcccaggttcaagcgatcctcctgcctcagcctcccgagtagctgggattacagatgtgtgccaccatgcccggctaatttttgtatttttagtagaggcagggtttcaccacgttggcaaggttggtctcaagctcctggcctcaggtgatccatccacctcatcctcctaaagtgctgggattacaggtgtgagccaccatgcctggcctcatggcttaataatatttgattgtatggatatacatatatatttcggacatttgggttgtttccagtttttggctattatgaacattcacatacaagcttttatttaaccacttgctttcagttctttgggatatatacctaggggtgggattgctgggtcatgtgtaattttatgtttaggtttttgaggagctgccaaactggtttccacagtgcctgcaccgttttacattcccacctacagtgtacgatggttccaatttctctacatcctggccagcactgtactttctgtctttttggtcctagccattctagtaggtgtgaagtggtatctcattgtgattttgatttgcatttccctaatgactaatcatgttggaaatcttttcatctactggcaatttgtatatcttctttgaataaatttctgttcaaatcctttgtctagttttcagttgggttacatgtcttcttttgttgagttgtaaaacttccttatatgttctcgatgctagaccctcatcaaatatttgatttgcaaatattttcttccattctgtggtttgtcttttcactttttcatagtgacctttaaaacacaaaagttttaaatttaaaaatctaaaataaggccgacgtggtggctcacgcctgtaatcccagcactttggggggctgaggtgggcagatcacctgaggtcaggagtttgagaccagcctgaccaacatggagaaaccccgtctctactaaaaatacaagattagctgggtgcgtgtaatcccagctacttgggaggctgaggcatcaacctgaatcgcttgaacccaggaggcagaggttgcggtgagccgagatcacgccattgcactccagcctgggcaacaagagcgaaactctgtctcggaaaaaaaaaagaaaaacaaaaaaaactaaaataaattatttttttacatcagataggcaatgtgctgatgtcatagtaaggtttgagagcggcacatctcagacatgagtgtgaaaacccaatcgctgtgcttgtgaaccacaaaaggatcataagttttattttattttattttttgagacagagtcttgctctgttgcccaggctggagtgcagtggggcaatctcgattgaacgcaacctccgcctccccagttcaagctattctcctgcctcagcctcccagcagctgggattacaggcatgcaccgccacgcccagctaattttttgtatttttagtagacacagttttaccatgttgcccaggctggcctggaactcctgagctcaggcagtccacccacctcagcctcccaaagtactaggattacaagtgtgagccactgtgcctggcctaggatcaacatttttaaattttgataaagttcaggccaggcatggtgactcgcctgaggtcaggagtttgagaccaaccagcctggccaacatggtgaaaccccgtctctactaaaaatacaaaaattagccaggtgtggtggtgcatgcctgtaatcccagctactctggaggctgaggcatgagaatgacttgaacctgggaggcagaggttgcagtgagccaagatcgtgccactacactccagcctggacgacagagtgagactccgtctcaaaacaaacaaaaaaaaagttttttgatgaagttcagtgtttcccttccctttccctttcccttttcctttccctcccctcctctccctttcactctcatttcctttcctttccttttcctccctccctccttgcttgctttctctttcttccttccttccttccttccttccttccttccttccttccttccttccttcctttctttctttctctctttctttctttctttccttctttttctttctctagtcaaatgcagtagtaagaaagggggaaagaatagaacaagttcaatctgtaactcaatgtgaacaatcaattgagataactcactacgtttggaccagccttctttttttcttttagttccttgtgccttggtttaacatctaagaaaacattcctgaatgcaaggtcacaaagatttatgcctatgttttcttctaagagttttatagtttcagctcttacatttaggtctttggtccatttggagttaatttttgcatatggtgtggggtaggggtccaaattcattcttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccccaaattcattcttattcatatggatatccatttgtcccagcaccatttgttgaaaatacatttttccccattgtattgtctgaatcttgttctttttcactcaacattttgatcctgaaattgctgcatataactacaaatcatttcttttttttttttggtggtggtggcggggcggagtttcactcttgttgcccaggttggagtgcagtggcgtgatcccaactcactgcaacctccacctctttggttcaagcgattctcctgtgtcagcctcccaagtagctgggattacaagtgcacgccaccacgcccagctaattttgtatttttagtagaggtggggtttcatcatgttgtccaggctggtctcaaactcctgacctcaaatgatccactcaccttggcctcccaaagtgctgggattacaggcatgagccactgtgcctggcccacatcattcatttctttatggctaaaaaatagtatcctttgtataaatctgccatgatgtatttatttattctttgttccatacagattgggttgtttccagaagttgctattatgaacactattgctctgaactcacttgaacgtgcgtgcgtgagtttctctccagagtatgtgcctagaagtgtagtgtgtgcatgtgttctccaaagcgattgtcatacttatgcttctatcagcgatgtgtcagaactacgtttcagaaaacagttttaagcattctgtttgttctgtctctcattgaaaaaagtcattactaaaaagaaacaagtggtatttgcaagtgaaatttgccttttaggcctctaatattttattagcaagaattaaataagcaaaaggccaatagcttgagaacgtagtatgcaattagtatctctttgtttgatttattttattttttcacagtgaagacttaagtatctctttacattttaaaatattaatgtggaccttaaacaggtctttggctggttgaggtagtggtttgtttgtttttgagacagggtctcactctgtcacccaggcgggagtgcggtgcagtggcgcaatcacagctcactgcagctgcgacctcccaatcccgagtgatcctcccacctcagcctcctgagtagctgggaccacgggtgtgcactgccatgcccagctaatttttttgatttttttgtagcgatgaagtctcgctatgttgcccaggctggtcttgaactcctgggctcaagcgatcctcccaccttggcctcccaaagcactgagattgcaggggtgagccaccaaccgcacgggcctggtgaaggtttttgctgttagtaggtgagtctgcgtgttaattaaagcaacatcacaccagcctactattgctctcttaactagggtgtggagcaagtataatagagcagttgggctgcgctgggtggctcacacctgtaatcccagcactttgggaggccgaggcgggtggatcacaaggtcaggagttcaagaccagcctggccaagttggtgaaaccccgtctctactaaaaatacacaaattagccgggcgtggtgttgggtgcctgtaatcccagctactcgggaggctgaggcagagaactacttgaactcgggaggcggaggttgcagtgagccgagattgcgccactgcactccagcctgggtgacagagtgagactcccatctcaaaaaaaaaaaaaaaatagagcagtttacagaattgggtatgaatgggaggtgggagtgcttccttttcttggtacccacctattagcatacagtggttatgctaagacagaatcctgcccataatgatgagacacctgccctatttcatgatctcattcaatagtatcatgtgaaagggttgaaggatgcagaattgggccagtagtgctcagaaccttgaaagagttggaaattctctctggagtggggcaaatctacagcttataaagaaagcgagttgtcctggaaagcgcagcacataggtcaccagggatggccagcaggaggtaaagaaagtctcctagaaggtggttgggccggggaggtgagcagcctgcctggtagagaagcatgttggaaagtgctccacctgggagctggggcccagggacagaatgccacttatgaggcatgagtgagggcaggagaaaggaggaagtgacaagatgccccaggcctaggggaacctgtgtcctagtaggtcaccaggccctatgttaaagaaacgggaacctgaagaccagaaggcaacttggtgtcaggaacaaggtaacgttatgattggttatcataactggggcacgagatcagagctagatggacttgctccttattcctcttacagagagtaataatgattttcatcctgggggtacttaataagggctaagcacttatgtatattaatttgtttaatctacacaacaatcctgggaaatagattctgttactgttcctgtgttacaggaactgggaaactgaggcacagagaggggagtggcagagccaggatttgaacccagatactctggctccagagtgcaagctcccttcccatggtactgcacttcttctggaaaaagcatggtttagggagtcaaacaggcttggtttctaatcttcatttcaacctcttactatctttcttttatgaccttaggcaagtcaacgaaattttctgtgacccacagtttccttatttataaaataagaagcatgagattcagatcacacatggaagtgcctcaccccttgcctggccctcggtagggacttagtaaatagccattaatactactcctacaaataaacctttccaaactgagcacaggacttggcctggagcccggggcagggtttaatgtgtgctgaggatggggtaatttatctaggagggatgagaaacatgggggtcaaaattccaagtagatactgacaaaactaggtgctgatggcacaagctccaggagccttggaattagccaagttctccaactcgactggagactaggttaaaatctcaaagacctcatccctcatccctgtaattagcctcttgattgcctgtgaccttaccttaaataagccctgatttaacctaaaagagaagaaatcagaacatgacaagatctgctgtttcatcttcttacatatttctctttcatttatttattttttttgagacggagtttcgctcttgttgtccatgctggagtgcagtggtgtgatctccgctcactgcaacctccacctcccgggttcaagtgattctcctgcctcagcctcccgagaagctgggattacaggcgcccaccaccacgcctggctaatttagtatttttattagaggcggggtttctccatgttgtccaagctgatcttgagctcctgagctcaggtgatcctcccgctttggcctcccaaagtgttgggattacaggcgtgagccaccgcgcccggccttcatatttctctttatacttaacttcctttttccttatctttcccatttgcaagttactttctagttcttatcgatcatttccttattactgttttttcctccttaatgagttggttgctagataataccttcggtgtttttgagaatctgagaatgatggaggagaaatggaaagataggaatagaaagagattacattaggaattaaatttcttgttcctctttttctgatatgaaaccaaattggaggttagatcatccagaaagagaattcagtgttttccagttttccaacctgcttgctcataagaatgacttggagtggtagatcttgattcagtcgttctgaggatagcacaaagaatttgtatttttagcaaacactctccatgattatagtattatatgggaattaaacttaaaccttctttaaataaagcccccaagtttgacccattagctcagctatagaattactgaatatttttagtatggcaatactgtcaagaaaaagcactttataatgtgcttaattttctttctttctttctttctttctttctttttggaaaagtttaaggctatataaaaaatagagagaatggggcttctcgctatgctcagcctgtgtgtcatcattactgtcatgctggccattgttctctgctgctgtgcccgggccctgaggcctccttcacctctatccccaccaccactatccagtcagtttgctgctgcttccgtggttcacatgaggcagatgaggagtttgatgcatgctgggtgacatgcttcaacaagccagagatagatgcctgggaattgcataaagaattgaacacacttgctggctatgacctggttccagaaccccaaatcattgatgttgcttcgcaggcatgcagacagttcgatgcttttcctagggcagtttgcatcctagaggttgttaaggacaaggcaggacctcataagaaaatgtcatccaagaactcagaccaactttaaatgaattgggaatccccactccagaggacctaggcttagacaaagtgtgaaccccagggacaagcgttccagggatttattggtattgctacttgattgtaaacactcccctggaaatgctgatgataacatgttaccttatttgaacacctttttctttattgaataccaaaccatgttatggtaacttggactttaataaaagggaaatgagtttgaactgaaaaaaaaaaaaatagagagaatggtgtgttggactcccatgtaccctcaacccagccttatcagttttcaaaccatggccaagtaagaggcacttttgaaagagaacataggaggagttaccaaacagtaaaggcagaaattaaaagcaactgtgcctgctttgtttagaatacccaaaacctggaaacaatccagatgcccaccaataggtgaatgcatcaaccaattgtggtatatcttttcactggaatactattcagcagtgaaaaggaaatgaactatttatacatacaacatgcaagaagttaaaaataattatgccgaatgaaaaaagccccacccccccatatatactgtatgcatctatgcatataaaattctggaaaactatacatatgtaaaattctaaaggtctgcaacctgcattccaagggccaattccagcccatcacctcttcttgtaaataaggttttattggaacacgggcacactcaaggtattgcctatggatgcttttgtgttacaatggcagagttgagtagtggccatatggtgtgcaaagccaaaaatatttgtcaacccgcaggggttgaaacagacagtaaacaacacaaaataaatacaaacagataggaataatgacaaatcacagtcaatgccatgtcaatagagaatatctggggcaaaggggaaggtccagttgaattgaaatactcatcagtttctgagtgtgttctatagagtttttctgtctctgtgtctttgcacattctctcttttttatttttattttttgagacagggtcttgctctgtcacccaggctatatagtgcagtggtatgatcttggctcactgcaacctctgcctcctgggttcaagcgattctccatctcagcctcctgagtagctggaactacaggtgtgtgccacgaggcctggctaatttttgtattttttgtggagacagggtttcatcatgttcaccaggctggtctcgaactcctgaactcaagccatccaccctcctcagcttctcaaagtgctgggattacaggcatgagctatcatgcctgacctctttgcacattctcttgatctgttatgctgtttgttgccatctactgttgtcaaattctacctacccttcagggtccaactgaaatgccacattaccaggaaaggtttttctcattgtccctgccatacttcatttctcttctgcccttctgtagctcaggaccctctttaggtgtcactcccattagattgtaagtttcctaacaagacgcacgtcatcgtctccaaatcctttgggtcagcacagcctcttttatattaccagtctaagcccctttgtgtgacatttaaagtccgcctggactgactgttcagcctcatcctctgcccttcccttgtgtcctgggctctggccaaatcaaaccaccgttccccaaatgtactatgtagttaacttttaatattgcttctttttattgccttggttctctcaaaaatcagaattaatggaatgttggctattacaattacgtggacatggttatataatggccttggcgatgcccttaataaatgaaatctaaaatgttacattttttttggaacccagaaactcattctaattttattctgcctgaggctttatagcattttctgaagatcatgttgtactcttctttcgtctagatgatttggtcaacagtgataaagttccaacttagacttgataaatatgcaagagtcatgaaatatgaatgaaaacagtgacttttgaaaatcacgcttacctaaaaaaaaaaaaatcctgagtatggtttatatttactatgtgtgtaaaaatgtactgccattcttcattcttctttgttcgttaggttgaagaacaattgtaaaaattgaaggcatggcactaccgccgttatgtatagattaatgtggaaaatagcacgtggcgggtggctaatgactggagtcttacggacccaggtacttactgaaaaattcacttaattttggacataagacttggtcctttttttgtacataaatttaaatctccctttccttgtttacatgtattgctttttttttttttttttttttttttagacagagtctcgctctgttgtccatgctggagtgcagtggtgcaatctcggctcactgcaaccacaacctccacctcccaggttcaagccgttctcctgcttcaacctcctgagtagctgggattataggtgccagccaccacgcttggctaatttttttgtttttagtagagatgggattccaccattttgtccaggctggtctcgaacacctgacctcaaatgatcctcccgcctcagcctcccaaagtgctaggattataagcgtgagccaccgtgtccagcccatgtattgctattttatttacaatggagcattgtatattttacccactgtcagatggcagatgcagcgtatttctgcctgcatcccttggcccccacctcttatcctggttcccaggtgcagggatgctgttgcactggcataggttcctggcatatttgagaagtacaatttttgctgaaccacgttcctcttttatgcaacttggcacctatgtcaccattcaagaacaacttatatcaacaatcagtgcccttaaaaggaaatgctcacaacattcagcattctctctgtctctctttttttctttttttgagatggagtttctctcttgttgcccaggctggagtgcaatggcacaatctcggctcaccgcaacctctgcctcccaggttcaagcaattctcctgcctcagcctcccgagtagctgggattacaggcatgcaccaccatgcccggctaattttgtatttttagtagagacggggtttctccatgttgatcagactggtctcaaaaactcccgacctcaggtgatccgaccgcctcagcctcccaaagtgctgggattacaagtgtgagccaccacgcccggccaacattcagcattctcttaaaaaaaatttttttttgagacatggttttgctcttgtcacccaggctggagtgcagtggcatgatcatagctcactgaagacttgaactcctgggcttgagtgatcctcctgcctcagcctagtagctaggactacagggacatgccaccatgcttggctaattttttacattgttttgtagagacaggtcttgctatgtttgcccaggctggtctcgaactcctggcctcaagcgatcctcctgcctcggcctcccaaagtgctgagattacaggtgtgagcagccacaccaggtccacattcagcaccctcttgattcttgagcccaccatggtgtcagcaaggaaagagaggcagaggtaatttaacctacatataatttcttggttgccagcctccctgagtcttctccattgtccttcagatctgtagtgtttaaaggcctgaattgaatctcttgtattttctgtaaaattctgatattctctgctgtgcatcatatttatatttgcacagctcttaagttatttctcaatcagctgcctcccagtagcacacctttgcagctggcaccattgaaaaggtttccctcagacatgggagctctgactgcttgaagtcaatgggggctgggtgcggtggctcctgtctgtaatcccagcactttgggaggctgaggcaggaggttctcttgagcccaggagtttgagaccagcatggacaacatggtgagaccctgtctctacaaaaaataaaaaaaattagctgggagtggtggcacacatctgtagtcccacctacttgggaggctgagatgggaggatcacttgagcccaggaggtccaggctgcagtggacgtccagccactgtactctagcctgggtgacagagcaagaccctgtctggaagaaaaaaagtcaatggaacaaggcagcgtattgaaatattctttccttgggaaatgtatgtcataaatccttttaccaacagatgatttggatctttaaggctcccaggcacatgactttattctcaggagatggttaggcagtagattaagatctgcttattgccttgagactatataaagctcccaatacctatttttattggagaccaaatttctaacttgttcaattggtctgcttatggcagtgctgctctcccagtcatgggagaagacagttttacatttaaatggaatattctaactttgcttagtaagtaaatactgacccaaagataaacaatgggagaaaatggaatttcagtgtttcatgcaaaaagttcctatcacaagggaatcgcagttttcattctttgggtaggtaggtagatttctccatgttctgtgaaactgtgttgttgcggggaaggaagcaaaagaacaaatcaatagctgaggatgggggcatattaggaatttttttttttctttttgagatggagttttgctctgtcacccaggctggagtgcagtggtatgtcttgtctcggctcactgcaacctccacctcctgggttctagctattctcctgcctcagcctcccgagtagctggaattacaggcccccaccatcacgccaggctaatttttgtatttttagtagggatggggtttcaccatgttggccaggctggtctcgaactcctgacctcaggtgattcacctgcctcggcctcccaaactgccgggattacaggcgtgagccactctgcctggccgtgagccaccccaccgggcctgaattttgcttaatagaatcatgatgaaaatgaatgcgcttgaccagagaaaatggacacttgtgatgacttgggtagtgttcagaaatcactcagcctgtgagaactttgtgcttcttaggtttggcttgatattacaaagctaccactggttacttttatgaaagctccccaggtaaggggcagaggacagcaacctgttggtccagattaacattcagtggtattaagcagagactgtggctttcaactataagtaaaagcatgcttgggggagaaggaggaagggagaaaaaaaaaaatgagaaagcagaaagatgcaacaggggttggcaaagagtcaggagcagggagtgagggggaaagtaggtacatgtggtggagaaatggaagctctcccaatggttccatcagttccaccacactggcacagattctagaagtttcctatttctggagtaggacgcagacatgatgcatttcctactaagacagatttctatccaggaaacatcatttcaagttgcagtgccaggctcgaggatccttctccgtcattgcttcaagtgtggtgggttcagtacctcctttaatgtaagagctggcccgtcttccctacctacttgggacactttctagttttgaccttaagtagggtatcaggaaaattccgagaaagggaagacactctttttcctgaattacagaatagaccaactcattagaaaaaataaattaaagaggccaggcgcagtggctcaagcgtatgatcccagcactttgggaggccgacgcaggcggataacttgaggtcaggagttcgagaccagcttggccaacatggcgaaaccccgtctctactaaaaatacaaaaattagtcgggtatggtggcaagcacctgtaatcctagctactcgggaggctgaggcagaagaattgcttaaacccgggaggtggaagttgcagtgagccgagactgtgccgctgcactccagcctgagtgaggctggagacccagagcaagaccctgtctcaaaaaaaaaaagagagagagagagaaaaccagaacccctttgtttcaaaaccatccacatctgtctatccatccgtaaagcacaaagttatcagagacaaatcatggtctcattttgcttcatgcattttggacctgacatgagtccgtctttgatccctgaggggtggtagaaacaagcaatgcttttcagagtgaagctaaaaaaggcactctgtggaagagaatatattttatagatcagtgattagtgagtcttttcatgacaagttttgtattaattatgatttgaaaacctccagtgcagggttctcaggaattactaagtgcccctgggtacagcaagaagcactggaataaagaatctcaatgtgtgaccaaatttctaaattcttgggggtgtacagaaattagccacttctattttctctctctctttctctctctccttccttccttcctccctcccctccctccctccctcccttccttccttccttcctcttctcttctcttttcttttctttctttttttctttcttgagtctttctctgttgccaggctggagctcggtggcgctatctcggctcactgcaacctccacctccttgggtcaagcgagcctctcactcaccctcctaagcagctgggattacagtcatccaccaccacgcctggctgatttttatatttttagtagagacggggttttgctatgttggccaggctggtcttgaactcctggcctcaagtaaactgcccgcctcagcctcccaaagtgctgggattacaggcgtgagccactgcgcccggcctcacttctgttttctacttgtgtttttatttccattgcatttcctgacttgtgtatattttctcgttgtagaagcacttagtgttttggcactcagacttactttccagtgtttcttctgatcaatcaatagccctttactcatactaactatatgtgatggaagcaaagtcaggaatgtctaatgtgggggcagaattcactatgaagctacttagaatttcaccagccatgaatgatacattatccatcatgttagctagaatatactgggctccagtctcttttgggggatctttagggtccttctgggtgcagaagggaagatgacatttcaggagatctctgcgcattccaccctggcttccttccttccaggtaggctgagagaaagctttcttcttgatggtgctagtgagaacttggcaggtggagcaggaactgttagtttttcactccctgttggagtcattcacacatacagctcatatagaagacggatgtcttttgtcttggtgccaaagacttgaaaacagagaacggtaacttttatttatttatttatttttgagatggtgtttcgctcttgtcacccaggctggagtgcaatggtgtgatctcagctcactgcaacctctgcctcctgggttcaagcgattctcctgcctcagcctcctgagtagctgggattacaggcactcatcaccacgcctggctaatttgtgtatttttactagagatggggttttaccatgttgcccaggctggtcttgaactcctgacctcaggtgatccacctgcctcggcctcccaaagtgctgggattgcaggtgtgagccactgtaccaggctagaatggtaacttttgaaacccatttttgttattctaaagtcttcacggtgtggtgttgggaaggctgggttgctgtgtcagatgggtaccctcaccccagttatggctgttctcacatccaattccaggaagcctcattcttgtgtggtcatagaaaagcaaccttaattttcctgtgtcttagtttccttacctcctagaaatgtggcaaagatgcagaatctgtttatttagtaaatatttatcaagttctgggaatacagcggcgaataagccaccaaatccttccttgatgggactcaccctctaacacagccaaggcaatgagagaccttccaggaataacattgagaggcaaattatgcatgtaggtgacacatgaggccaacaggaaatgacctcgaattgaagttgaaatttacagtgcgagatgagccaagaatctgtgaacccttagaactcaggcaaggtgagctggtgtgacttgcaggaagtatgactcaattgtgactgtacccaagaaggcttaaaccacatcatctgaaagaaggatgtgccaacatacgcttccaatgactaaaaggaggggcagagggaaaaacaaaacagcatgttcccaggcccatcctaggaggaaggaaggctattaatacattcctttgacattgtctacttaccattgcatagagttggaggtgagtggcatatggagagacagagatttggagacagactgagtttgaatcccaattttgtcttattaggccgtggacaagtcatttcaactctctaagcttcaatttcctcattatttattttttaaaatagagatgaggtcttgctatgttgcctaggctggtcttgagctcctgggctcaagccatcctcttgccttggcctcctgagtacatacaggtgtgagccaccacacccacctgcccagccctagcttgctcactgtctttctttttttcttttttttgagacagagtcttgctctgtcacccaggctggagcacggtggtgtgatctcggctcactgcaacctctacctcccaggttcaagagattctcctgcctcagcctcctgcgtagctgggattagactactacactcggctaatttttgtatttttagtagggatgggtttcaccatgttggccaggctggtctcgaactcctgacctcacgtgatctgcccacctcagcctcccaaagtgctgggaataaaagtcgtgagctaccacgccggtctagcttactcaaacaatgtctagtttgcagggtagtgtatgtacgtgcctcagtgtctttggtgtgatatacacttagtaaatgttagttcagctctaacagactcatctgagattttgattctgtaactcccaagagttcagtatgctagcatttttttttttttaacatgaggaagagttgggtaaggaagagctgtgttttaattgcattacggctcaactgctaactgttttgatatgttgaacaaagtccattgattcttcatggaggagtgcttgctggggagtgtgagtcagcacgtctgcgttattaacttgttcggaagctttttgtggcagattgattttaaaagcccccaaggaaacagaggattttatttaatagaaatattgtcagaatgacattgagatttgggtttagctttcaaatcactggatacaagttgaatcaggtcttttctctgacagatattggaaacatggtgtgttggagaaatactctccattgcctggcagggcccttaccttgggagagggggatgatatttgcctggagcaccccggtgaccccacctagcaggcctgactttctaaaggcaaggatgtgggcttggtacagagaggtggcgaaacctgaatattagtattttcaaatctgattactagtattttcaaccgacctgactaggcgcaaatccatgctcatttaaatgaaagtctacctgaaatcatgcctcactgcaaccatgcacttctgggcttaagcgatcctcctgcctcagcctccctgaaggtccacctgcatttgaataaggatggatgtgcgcccaggtatgtctttgtgggtttccatcctatagttctggagcaaaggacaaatggaagaaagttgctaaagaaaagaagagcgtttctgtggctccttcaagagcagttacagatttctgtcctgaagccaggagggaatatgtggcccaggtcccacagtggagagttgcaatgctccctcttgggcatctctgtcctcatttggattcagggctgaaacttcgggatcagtttcacagaagaggtttcaagtagatttcttgcagtcctgaaagtcacacttctctgaaattggtttaacaccaatccaaaacctattggtgttcctgttacattttacaactcttcatatgccacttaagaaatgacctctctagaattgtgactccagcctaggcaacagtgggagactgtctcaaaaaaaaaaaaaaaaaaaaaatagagttgaggatgaggagctcaagaataaaagtgagatgggatggacagagaaaaagcaggaaaactagcgaatggtatggtagaagccaatagagaaaggactttcaaggtggagggagagaatttaagagttgggacttctcttccagcaagaagaggaagaatggcataagagggactgtgatgtaggcactatgtcaccatcgtatttaatccaaactataactatgcaagattaccacttgaccttcaagaaaactgggctggctgggcgcagtggctcactcctgtaatcccagcactttgggatgccgaggcaggaagataacctgaggccaggagttcgagaccagcctggccaacatggtgaaaccttgtctcttctaaaaattcaagaattagctgggcgtggtggtgggcgcctgtaatcccagctactcaggaggctgaggcagaggaatcgcctgaacctgggaggcgaaggttgcagtgatccgggatcgcactactgtgctcctgcttgggcgacagaggaagactccgtctcacaaaaacaaacaaacaagcaaatatacaaaactgagctgaggagacaattcgacaattcatgcagtcaataagtaggttgcagaggttggagtacagtggcgtgatcggctcgctgcaacctccgcctcctaggttcaggcgattctcttgcctcagtgtcaggcctctcagcccaagctaagcatgtgaccttcgtgtatacatccagatggcctgaagcaactgaagatccacaaaagaagtgaaaatagccttaactgatgacattccatcattgtgatttgtttctgccccaccctaactgatcaatgtactttgtaatcttccccacccttaagaagtttctttataattctccccacccttaagaatgtactttgtgagatccaccccctgcctgcaaaacattcctccaaattccaccgcctatcccaaaacctgtaagaactaatgataatccaccacacttcgctgactcttttcggactcagcccgcctgcacccaggtgaaataaacagccatgttgtgcgcgcgcacgcacacgcacacacacacacacacacacacacacacacacacacacacacacacacacacacacacagagggagagagagagagaaatgacctctctagagaaagaagaatcaccatggtatgggagaatgaacccctcagaaatggtcacagcttattcaagtcctaaacccttgctatgggcaagggttgacaaactttttttttcttttctttcttcttcctgtcttctttcttttcctctctctttctctcactctttctctcccttcccctccctccctccctccttccttccttctctctcattcgctatttcttttctttctttcttttttttttagagacagggtcttgctctgtcacccgggctggagtgcagtggcgcaatcatgcctcattgcaactttgcactcctgggctcaagcgatcttcctgcctccacctcccaagtagctgggaccagaggcacacaccaccacgcttggctaattaaaaaaaaattttttttttaaagagatggggtctcactgtgttgcccaggctggtctcaaactcctagccttacgtgatcctttcacctcagcctcccagagtgctgggattacaggtgcaagccaccatgccaggcagcaaagtttttcttaaaaggccagaaagtaaatatttttgcctttgccgatcataaggtctatgtcacaaccactcaactctgccattgtagctcaaaagcaaccatagacaatagggtcaaggagtgagtgtgactgtgtttcaataaaactttatttaacacataggcctccctcctgcaatcccttttgctgatcacttcatagaccatcatacacttcctgtgctctttggagcttgaaaatcatactttggagtaagaaattcttttgaatataaattacatatgtttggctgtggagaaataggaatgcttttacactgttggtgggaaggtaaattcgttccaccattgtggaagacagtatggggattcctcaagactctagaaccagaaataccatttgacccagcaatcccattactgggtatatgccctaagaaatataaatcattctactataaagacacatgcacatgtatgtttattgtggcacgatttacaagagcaaacacatggaatcaacccaaatgcccatcaacgatagactggataaagaaaatgtggtacatatacaccatggaatactatacagccataaaaaggaatgagatcatgtcctttgcaggaacatggatgaagctggaagccatcatcctcaacaaactaacagaggaacagaaaaccaaacaccacgtgttctcactcataagtgggagttgaacaatgagaacacatggacacagggaggggaacaacacacaccggggcctgttggagggtggggggcgaggggagggatttagaggatggatcaataggtgcagcaaaccaccatggcacacatatacctatgtaacaaaactgctcattctgcacatgtatcccagaacttaaaataaaaataaaaaataaattacatatgtttagagaaaggaagcttccatatttatgtatcatcatgatttttttaaaaacttatttaatttgcatacaaatttgttccacatttgtttcctgtaaaatggattcctcataaatgcttggtaagagtatccatgtttgatgtgaaacaaactgatgatgcttgaattcctgtttactctgaagttcttttcacatgctggtgagttctgagcaccatgcttacatgcacctctcctttgcagcaaacataagttttgaggtccctgtgagtcctaatggcaccgaggtgctgtctcaggtgaccttctcctaatcctgaaaaagtctccatgattggccctggaggagttctcctggttgtctggaatgagttcatactaatagtcagggctctgggcattgtgagaccctggctactttctttctttcccacaatgtatactttctcactatttatttatttatttttttgagacagagtctcgctctgctgcccaggctggagtgcagtggtgtgatcttggctcactgcaacctccacctcccaggttcaagcaattctcctgcttcagcctcccgagtagctgggaccacaggcgcccgcaaccacgcccggctaattttttttgtatttttagtagagatggggtttcactgtgttagccaggatggtcttgatctcctgaccttgtgatcctcctgcctcggcctcccaaagtgttggtattacaggcatgagccactgcacccagccatgctttctcactatgaaaacctcctcggactcctcggactcctcacaagagtgagtgagctggatttgctgtattttcaaagtcatccttcattacacatgaacattggctgcacccgagcttggctgtgaactgattattctcaccagggcctgttaacacaaattccatcactcctacagctaaaaataaaccatatttaacaagtagaaacaaaactccaggcaaatacatcatctgatttgatggaatctttgttgaaaatgttaatggtggaatcagatgcttacctttaagatgggagattgcattccttcgtgagcaaggtgcctagaaatcaattccaactcttgatatgatcagagagattgatggatacctaagtgtctgaaatgataatagttcatcttgtctaagggcattcccccatttgtggcacattgtccttgacgatcagtcttctatttattttattattttattttttacagatggggttctcgatgtgttgcccacgctagagtgcagtgactgttcacaggcaacatcattgcacactgcaggcttgaactcctgggctcaagcaatcctcctgcctcagcttcttgagtggctggcactacaggcatccaccactgtgccaggctcagtcttctatttaaataatgctgctactttagagggtttaggaatatttagtgtttacagctagtgtctctgtaatatgaaaacatactgtgccttggctgggtgtggtggctcatgtctgtaatcccaggaatttgggaggccgaggtgagaggatcacttgagcccaggagttcgagaccaacttgggcaacataatgcccatctttttaaaaaataaaaaacaaaaattagcagggcatcatggtgcacacctatagtcctagctaatcgagaggctaaggtgggaggattccttgagcccaggaggatgaggctgcagaaatcgcactactgcacttcagcctgggcaacagagtgagaccctatctcaaaaagaaaaaaaaaaaaaagaaagaaagaaaacatactgcgcctagcaatacaaatagtgacctgcgggtaatgagattatagatgattttaaacattcttcttgataattttcctgtgttttacaaatatttaataatgaatatgtactactctaagaaaaacagtacaaaggttttcaaagttttttgacagtcatttacctgcagtaagtacgttatacatcccaaccccatataaactagcatttatgtatttataaacttaaaacaaacattagttaaccatttttttctacttgtcttgctttttttttttttttttttgagacggagtctcgctctgtcacccaggctaaagtgcagtggtgtgatctcggctcactgcaacctctgcctcccgggttcaagcgattctcctgcctcagcctcccgagtagctgggattacaggcatagtgccaccacgcctggctaattttgtatttttagtagagacggggtttctccatgttggtcaggctggtctcgaactcccgacctcaggtgatccacctgccttggcctcccaaagtgctgggattacaggcatgagccaccacgcccggcttttttacctacttgtctttacctcctgatgttttctgtttttctattctattttatcaaagaaggaagaaagaaaaaaagaaagaagaatattcatgtattgaccaggtaaaatgatttcatgaaccactgatgggtaaattgaaagctagtgattataggacagtggttgccagtcttgtatttcatgggtcagtaaaatttaaaagaaattttggggattgatgtaagatcatctgtttttcatgttgcaaagtaaggatgttttaaaacaaggtagctgggcgcagtggctcatacccgtaaccccagcactttgggaggccaaggcaggtggatcatctgaggtcaggaattgagaccaacctggccatcatggtgaaaccccatctctactaaaattacaaaattagctgggcgtggtggcgattgcctataatcgtagctactcaggaggctgaggcaggagaatcacttgaacctgggaggcggaggttgcagtgagctgagatcgtgccactgcactccagcctggatgaaagagcaaaactctgtttcaaaaaaaaaaaaacttacaaagtaattatttctaccaccattattcttttattcatttgtcatttaaaatcttgtttttatgaattttatgatttgagagaattttcatgtcaaaatatcctttcttttctgaaagaatattttagcattaaatattagaaggaatacaatttcagtagttatgtgatgaataaatttagctttctgaaaacagaccgcacttgctttgttttttccatttggcaatgaacctgtgcactagcatttaggaatcatttaggaattatcagtgtagtggaaacagccttgctttgaaacaacacaattttacttccagttctgaatcatttaatttttctgaacttctttttacccatctgcaaaagaggaatctcagaggtatagcaataaggtttataaagggtttaagacagttctgaatgcgcaggagtttatagatggtaacgtcttttctctggatcattaattctccttactactctgtgattttaaaaacttagaatgttggctagtgtggtggctcatgccagtaatcccagcactttgggaggctgaggtgggagggtcacttgaggtcaggagttcaagaccagcctggccaacgtggtgaatccctgtctctactaagacacaaaaaaattagtctataatcccagctacttgggaggctgaggcaggaggatcgcttgaactcgggaggtggaggttgcagtgagctgagatcatgccactgcactcgagcctctgtgacagaacaagactctgtctcaaaaacaaaaacaaaaacaaacttagaatgttggccagtgtggtggctcatgcctataatcccagtgctctaggaggcagaatgctctagagggtggaagcgggaggattgcttgaggtcaggagtttgaaaccagcctaggcaaggtagtgagacctctgtctctaaacaacaacaacaaaacagctgggcgtggtggtgcacacctgtcgtcccagctacttgggaggctgaggtgggaggatcagttgaggccgggagttcaagatcagcctgggcaacatagtgagaccctgtctctaccaaaaaaaaaaaaattagacatatgcagtggcatgtgtctgtagtcccagctgctcaggaggctgaggtgggaggatcccttgggcccaggaaggttgcagtgagaaatgatcacaccactgcactccagcctgtgtgacaaagcaagaccccatctcttaaaaacaaaaccaaaccacacaacaacttggaatgttgaaagaagttcattatgtgtttccattttatgatgaactatttctttaatttttactctttttagttactgtttcttttttttttttttgcgatggaatattgctctgtcgcccaggccggagtgcagtggcgtgatcttggctcactgcaagctccacctcccgggttcaagcgattctcatgcttcagcctcccgagtagctgggactataggcgcccaccaccacacccagctaatttttgtatttttagtagagacgggatttcaccatgttgaccaggctggtctcaaactcctgaccttaagtgatccatccgcctcagcatcccaaagtgctgggattacagagtgagccaccgcacctggcctcatgtcttgtcttacctacggctttccccctctttctgcgttttctccaccctttaccgctgagtcagcctctgtataccattattcatgatgggaactcagcttgtctgacagttggttttaaggcacaattagaaaatattccttgatagtacaatgagtttgcagtttttaagttgtggttttggccagagatattaataagggtttggacgttgagtggaatactaagaataagaaaggggatgtgcttaaaatacatctcatgtgccttctgtttaattacacggtaatttgtaaaagagactggtttctgtggccttgaatactaatatagactttccctcaccacagcttatcttcgagtcataaacacagaggcatgcatagttcacacatctccatgtattttctgtttccaaggaagatatgatcactctgaagaaccaaaagatgagtcactctgaaaacttttcttcctttgtcttaatgtcatgactgtcttaacaattgactgtgtttatttcagcaacatttatctttagtctcttctctttggctcagtcagatgttttcagtttcacccagcacggaccacagccatattacctcctatatcccagtggataacttctgcaggaaaacttcagctacttgacactcttgggaaacgagctgggtgttcctgataagaaaggtttaccagaatcttgtaaagatggtttctctaataatagctaacatatttataagcgtgctatgttttagaacatgggtgtccaaacttttggcttccttgggccacattggaagaattgtcttggaccacatataaaatacactaacactggccgggtgcggtggctcacgcctgtaatcccagcactttgggaggccaaggcaggtggatcacgaggtcaggagatggagaccatcctggctaacacggtgaaaccccgtctctactaaaaatacaaaaattagccgggcgtggtggtgggcacctgtagtcccagctactcgggaggctgaggcaggagaatggcgtgaacctgggaggtggagcttgcagtgagccgagcttgcagtgagccgagattgcaccactgcactccagcatgagcgagagagtgagactccgtctcaaaataaataaatacataaataaataataaaataaaataaaactaatgataactgatgagctaaaataaataaataaaggtccgtgtataatttttgtgatatctgccaccacagataagccaaaaagtcctcttattcaaagggttggacatggctgtttcagtaacttcattacaggctttgtgaacattatctcatgtaatcctaaaacaaaacaaaacagaacaaaatgactttccctgtctcgatttcctgagtgatctttgtaaacatcagctattacagtgtgctcttttgtgtagatttcaggtgtatgtgactcttgtaagcattcagcttaccactgtttattgagtgattattatgtgccagatacagctctggacacaggtgtgactaaaacaaactccctgccctcaaggtgcttatattctggaggtgggaggaggaccctgacaacagcatggaaatatacaaatataatataatgtcaggtagccacaaatatagcaggatatagggacagcgagtgggggtggggagagtggtggcggaagacccttgaggaggcgacagttgagcagagacctggatgaatcgtgggagcaaggcttgtagatatttggcaaaagagccatttgattgtgacttacgtggttctccctcttctgctttctatagttttcctgtctcctggcagtcagtgccaggaaagaatttagttgggccagaccaagggaagccagacctagaaaggaggcaaagctacaggtgcagagcagagattgctaaggtcttagccgcgggctgcgggagcgagcctgggcgggcgggtaaggctgtggaaccggagtctggagagtctgctggctgcgcacaaacacggctgtgcttctgggcagatgaatggagggcaagccagccccgggcagaagatagaacagagaggaagctggggagccgggtgcagtaactcgaaatcccagcactttaggaggccgaggagggcggatcccttgaggctaggaattccagagcagcctgggcaacatagggagagtctgggtgtggtggcctgcgcctgtaaacccagctactcgggaggctgaggcagaaggatcgcttgagcataggagtttgaggctgcagtgagctatgattgtgccactgtgctacagcctggatagtagagtgagactccatctctaaaaaatagaaataagaaaaagaggaagccaggtgcaggctcaggaggctgacgcaggaggatcacttgaacccaggaggctgacgcaggaggatcactggaacccagcagtctgagactagcgtgcaaggatcacccctgtgaatagccactgcactctagcctgggtgacatagcgagactctgtctcctcctccccataataataataataataataaagaggaatctggtgctggcatagaggtacaggctggatgggagggtggtcaggatggggcaaggggccgagaccacaaatggtcctgctcctggggcttagaacgggacctggttctccagggaggtgaagaggagcaaggccagagctcagcagcagaagctgtggtttaagagagaggcttgattatagatgttaggaagtcaagagcccagtgcctagaacctgggctgcagacggggaatgaggcttatggctccgtaatggtgatgtaatgctgacacctcagctgtggcaccacagagtcctgtgttacccctccctgtgcccacacaagattaccagaaactactttgcatcccattgaatgcaatctgctctgtgcctcttttgtaaaatctgcccatttacacatggtgttgccaccccagcctgggaactgagcagcaagaggaagcctcccacccgccccactcccaagtagcgtttccttttccggctcccacaggcccattacataacctttcttagggccctctgcacagagctgtaatctttggtagaggggcaggctgtgctttagaagcccggagctcaggctgggcgcggtggctcacacctgtaatcccagcactttgggaggccgaggcaggtggatctcttgaggccaggagttcaagaccagcctggccaacatggcaaaaccccgtctgtactaaaaatacaaaaaaatttgccaggtgtggtggtgcatgcctgtgatcccagctactcaggaggctgaggtgggaggattgcttgagcccaggaggtggaggttgcagtgagctgttgcaacagggaacaacagagtgagactctgcctcaaaaaaaaaaaaaaaataaaaaaataaaaggccaggctaggtggctcacgcctgtaatcccaacactttgggaggctgaggtgggtggatcgcctgaggtcaggagttcgagaccagcctggccaacatggagaaaccccgtctatactaaaaatacaaaaattagctgggcatggtggcgggcacctgtagtcccagctactcaggaggctgaggcaggagaatgacgtgaacccgggagatggagcttgcagtgagctgagatcacgccactgcactccagcctgggtgacagagcgagactccatctcaaaaaaaaaaaaaaaaaaaaaagaagcccagagctcaagatctggtcagactccctggtttgaaccttggctcctcttgggcaaattacgcaacctcagttacttcatctgtaaaacggaaattataatagtacttacctctgcaggattcttgtgaagataaaagccacagaacagtggctgggccccagaagtgttagtgcttttgacgtttctgtaaccttcactaaacgtgacaccctccggggccattgtaggcatttttgtaccctcagtgtctaacatgttacccagcaggcacatggattcattcaacaagtatttattgaatgccttcttccaggccctgggatgcagggacatagccaccaatgagacaaactcctgcccccatggggctgacattgtgctgggggagacagactgtaagcaagtgaacaaggacacaaataatacagtttcaggccaggtgcggtggcctacacctgtaatctcagcactttggtaggccaaggtgggcagatcacgaggtcaggagttcgagatcagcttgaccaacatggtgaaaccccatctctactaaaaataccaaaattaggcaggtgtggtggtgcacatctgtaatcccagctactcaggaggctgaggcaggagaatcgcttgaacctgggaggaggaggttgcagtgggccgagatcatgccactgtactccagcctggacaacagagcgggactttgtctaccaccgcaccctccccgccaagaagaacaatttcagctagtgataagtggtataaaaaaataagttggggtcctgtaatcgagtgacctaagatgtgtgagatacatggttggtggtttttttgtttgttcctttgttttactttttatttttttgagatacaatcttgctgctctgttgccccaggctgcagtgttgtggtgtgatcatagctcactgcagcctccaattcctgggctcaagggatcctcctgcttcagcctcccaagtagctgggactacagatgtgtgccaccacacccagccacccagctaatttttaaattttttgtagagacagggtctcactttcttgcccaggctggtcttaaattcctggcctcaaaggatcctcctgcctcagctgcctcccagagtgttgggattacaggcctgagccaccgtgtctggctgggggtgctattttaaaaagaatggacagaaaatttctgcgaggatttgacgtttgaacaatggtcttatctaagcgacaatctgagagacagctgtccagacacagggagcagcaagtactagcatggcctctttgtgtttgagccaggagaggaataaaggtgagggtgagggaggcaagaggtaagcagaaggtagggaggccagggaggggaaggagggtgatggaacgaacgtaccggacagggcgtggaaagcgttcggggcctggctgggagtttgggatatgtcctttttgcaatgggagccactgagagttctaaaaccagaagtgacataatctgattcatgtttcttggctgtgtgcagagctttgcaagaatggcaacagggataaaagtcctgagaccagggaaaacccaagggtcttggatttgtgtggatggctgaggtaaaggagactcattccatggccttttctggaaagctgggtcatctgttaccagttttattgattgtcttctgtagcaggttgaatagtgtcccctcaaaatctgtgtctgcctggaacctcagaatctgattgtatttgaaaataggggtgttttttttttttttttttttttttttttgagacaggatctcactctgcttgcccaggctggagtacagtggtgcgatcacagttcactgcagccttgacttcccaggctcaggtgatcctcccacctcagcctcccgagtaactaagactacaggcttgcaccaccatggctggctaatttttgcatttttagtggagacagggtttcgccatgttgcccagactggtctcaaactcctagactcaagtaatccacctgcctcggcctcctaaagtgctgggattacaggtgtgagccactgcacctagccggcagtagggtttttgcagatgtaattagtgaagggcctcaagatgaaataatcccgaaattagagtgggacctgtatccaatgactgatgtccttataggaaggggagcggacatagagagacacagggagaagatagccccttgaacatggaggcagaagttggggtgttgcagccacgagccagggaacgcctggggccaccagaagctggaagaggcaaggacagatttcctccagagcatggccctgctgataccttgattttgggcttctaccctgcagaactgcgggagaacacatttctgttgctttaggcacttggtgatactgtgtttctgcagccctaggaaactaatgcacctcctaagcatcactggtttcttaggaatatttgcattggggtgcaggcatgagagaggcctcatcaggaagactggccattctatagaccttccttaagccctggagaggtgggtggtcttaccaggaactcaaaggagctctaagatcccagaggaggtccctgagaacgaatgaacaaatgaatgaatgaaagggcccaaggccgagtgcggaggctcgggcctgtaatcccagcactttgggaggccgaggcgggcggatcacttgaggtcaggagttggagaccagcctggctagcatggcgaaaccccatctctactaaaaattacaaaatttagctgggcgtggtggcacacatctgtaatcccagctgctggggaggccaaggcagagaattgcctgaacctgggaggcggaggttgcagtgagcggagatctcgacactgcactccatcctgggcggcagagcgagactctgtctcaaaaaaagaaaaaaagaaaaaaaaagaagagaaaagaaaaaagaaaaacaaagatcctaagacagggctgtgtctgaccttcaggtcactcaatagccctagccatgaacgttgtaattgaccctctgcagcacatagacctctagtcagtgcagccaccatcattccgctgtgtgccttctaagctgttctgggttgtaagatctttgttagaatttggataaagagaacagagttctaagtgactttttttttttttttttttctgagacagagtctcgctctatcgcccaggctggagtgcagtggtgtgatctccgctactgcaacctctgcctcctgggttcaagagattctcctgcctcagcctccccagtagctgggattacaggcacctgtcaccatgcctggctaatttttgtatttttagtacagacagggtttcaccatgttggccaagctggtcttgaactcctggcctcaagtaatctgcctgcctcggcctcctaaagtgttgggattacaggcgtgagccaccgtgcccagctgggcctaagtgactttctaatgcacagaatgtgtgaattttagaatatgatcttttaccatccagttttctggactcagaagtaacttttccttcctctcttttaaatgttcattaggtcaaattagaactgaagaagcaaccctgaggtataatactctgccccagcaacaaaaagcagtactgctgctgacttacggctactattctgagttgaaagtgctgaaaagaaaactccaggccatgcgcatttaatttgattgtaatcctgccagagatccacctgctttgctcccatccgtttcccttggcctgtcctgtagaaagggactgcaattgagcacttttttaaattaaaaaaatgacctgcactctccacaaaatacaggtccaaatggcagtagcttattggtcatcagtttctcctaggaaacctgggccacaagtttctggttggtttcggacacacagtaggtgctgaattaattaaaggtgtttctttaattcagcccagaagcatctgatttgcttaggaaattgattaggcatatattacctggatgatgtcaatttctatgtaaccatttctctcctgtgtaattgatgagcctcctaatgttgattttattttattttaccaagcactgtatttagttaataaaaaatacagaataggattcaaaacagctgtgtttgctattggcatggccgtcaccctcctaatacctgtgcatgtcataatagactacatttgcagaaacaaaaggttaggaataaaaagatgacttttgtccctccagctgccagtgacaacccacagcctcagcttatggtatttatttaatcttgtatctgtgatagggctctgagacacttctgtgaagcagatgtttgaagatctgacaattatggaagaaaatttctcatagaaaaagatatgttctccagccttgggcgggggcctgacattactcttccacatttcactcattcatttattgaaaaatgaaaaattatatatatttataatataccaggtgatattttgatatgtgaatacattgttgaattattatgttaagctaattaacatatctctcaccttacatacttattttttgttgatgagatggacatttcttttttaagtatgcttaaatgtgttcacggattgtgtgaaatttttggcatcccgtttcttgatataccaccttttgccacatttcttgtttatatagtatgtatctcagccggtgatgaatcaaggaaaaagataaagaaaaacaaacaaacaaacaaaaaagcaaacaaacaagttaaaacaaacccaaaaccttctttcccagtaggcagtaatttgggatgtaaaatgtatgaggtaggcaggaggaagatgaaaagtctgtctgaaatgagaactgtctgttggcttaattcaggtgatcacagattgtctgtagccttgagcaaagcctagagaatagtgaggctagtaaaacactagcccttgggctcaaaatttaagatggcaccaaaaaactaaaaatcagggtaaataatattttgatgcaatatttttaaaaaataaaaattaatgcacaatactctacaatgaacaaaatatcaaaatgctaaagacaggctctaaccccgcactggcaaacgcaacctcacttgtctccttctaatcctggccttgacccctaataacaaaaagtaagatcatctagacctcaaaaggaaaagttgctagtccctctaagccttcgtttgctctgggtttgaatccaaactctgttatgaccaacttagtgaaatcaggcaaattactcaacctctgtaacttccttttgaaaaatggagatgttttctcttgcaagactttttatttatttatttatttatttatttatttatttatttatttatttatttgagacagggtctcactccattgcccaggctggagtgcagtggtgccatcatggctcactgcagtctctacctctccaagcttgggtaatcctcccaccttagtctcccaagtagctgggactacaggcatgcaccgtcatgcctggctgattttttttttgaaaaaaaattttttttatagggataggggtcttgccatgttacccaggctggtctcttaactcctgggctcaagaaatctgcccacctcagcctcccaaagtgctaggattacagacgtgagccatcacgcctaacctcttgcaggacttttggggtggtttaaaaattacgcctgtgtagcactgggaacattatgacacccaataaataccaaataaacaacagctttaaatattataattcataatgattcacagagtattaagatccccaggcgatgcaaccaggtagtacctaagtgtatcagtcttgggtgcatctgtcagggttaacctggctttgtttttaactttacaggacatatcagagtatagctattgtgcctgtgctttgaacactcaaacatccgctcaactgctaagtaactgatttcctgtttagtcacagctccttgtctgggaccagccactggcagcaaattgtcatcttctgtatctccctctcaaagcaactcagccttctgaagacgtgtagaagttaggtctcgcaggcttgtatttattaagcccccccccgccacccatcagtccccagttattttgagtgtctcaaacgcatttcccacacctgatgattcatctgaggacgactcacccttgttgtcactgacactgtccacagcccagagctcagcctctgatttgctcggcagagatggggctatgtacatatcgtgtgagacggaagctaacataagcagaggagaaatcacggaagcaaagtgaagtgggaatccagttaatacttggaacagaaaactggaaagcagctcattcattctctccgattgtaaaaggcggatggaaacaacacttttgtcagcctttcttctaatccgatcacagctgtaaagaccataaagccaagccccgacgtcaattattcttctccctgttcctaagaatgtgaaattagatggggaaaagtgacagaagagtgtcactaaaataacttattacactttgagggtcttagtcgtcattaatagttgttactttttgaatattcatcagtgcgccctgctgttcggcaagagaggctgtatgaagtaggaactgcacacgcctggcttcagtcatgtatgccttggatttaagctcttcttttccacttaattagttaacaggaacttactgagctgggtgcaaaatgatacagaagaataggagaatgggattgtaacccctgaagcgtttgtgatttagttgagtagaataaactctgctgagcccaagctgagcctcagcctcatgcacctgctgtatttccacattctttcatttctgccccagaaatgttgcttgaatctggtttctcctctttaaccatctaaacttttactattgctttaggactgcctctcctcatttattgctatgttgattgcactgccctgccaaaccatattggagctggatcaggggaaaataagcatatatatatatatatatatatatatatatatatatatatatatgcatgaaaatatcctcccatattgtggaccaagtggaaaagttaatgaagctctacaatgaaaaaaaaagttgactatgagtaaagtctcatgttgtccaatctgtaatcctattattgtcaaccctcgtaagcccgcccagtggatgaggtggtgggagatgacgagggtgggatgggcattctgcagccagtggggaagaaggcagggccctaaaacaaacaagaacaagcatatctttatttagaatttggatgtattttcatcgtgaatttcctttgcattcattttgattaaaaaaaaatgcattatggctgggcgtggtggctcacgcctgtaatcccagcatattgggaggctgaggcaagtggatcacttgagcccaggagtttgagaccagcctggccaacgtggcaaaaccctgtctctaccaaaaatacaaaaatatatatatatattagctaggcatggtggtgtgcacctgtagtcccagctactttggaggatgaggcaggagaattgcttgaaccaggagacgaagggttgcagtgagctgggattgcatcactgcactacagcctgggcaacagagcaagactctgtcccagaaaaactaaaaaaaatgcattaaaataatatttatctgtattgctgaggtttgaggcaccctcttaaattttacacctaggcaatacctccagctctcacactaatccaggctctggtctattacaaaagtccccgcgggctctgacctacacagctgccagttaccttcctaacagacgaccagtgatcatgtcactttcttgttaatccagactgctgggagcgaaaattcagccccctcggtttggcgttgaagcccctttacaatctggcccccacctaacccaccagggcgcctgccctgtctggccctgttcccacctctcttgcctcatcaaacttctgccagactgcacctttgtccatgctctgctgtctgcctgaattgtgcccctgtctcctgaattgtgtctccaagccccttcacctaaaatattcctgttagctctcaagtttcacctcagatatccctgactggctgggcagacttcttagactctcgcaagcaggcttctttgttctgttttcccataggaaattgttcgtttccactcaattcatatcttggtggttgcattcatttttcgactgtgatttatctgtttaccggtgtccctagttccactgccagctccttgaggcgagcaaccggggcttttcatgtctaatgaataaatgaatacaatttgacacagtgaaaaaggcaggaacagcaaccataaaaaatccatgaaaaacaaaagcacagaggacaataggcagagaggacactggtcttttttttttttttttttgagggggaattctcactcttttgaccaggctggagtgaagtggtgtgatcttggctcactgcaacctctgcccccagggttcaagcgattctcctgcctcagcctcctgagtagttggaattacaggcgtctgccaccacgcctggctaatttttgtatttctagtagagacggggttttgccatgttggccaggctggtctcgaactcctgacctcaggtgatctgcctgcctcagcctcccaaagtgctgggattacaggcgtgagtcactgcgcccggccgacactggtcttaaaatcaggagaacctggatttggcttttggtcttgtcattagccagctttacaactctgtcattattttcagattttttactatggaaactttaaaattgtagcaaaaatagaacagcctgatgaacccacatgtacccatcatccaactagaacaatgtgggttcatcaggtttcttgtcatactgccccgctctgctacccccatccctggattgtttggaagcaaatcctagaccttactgtcacttcacatataattattaaaggaagaacatgaacattgtaattgattgcaaactcaccatgaacctggtggaaagaagagatcacaataggccgagatcacggggaagctcttggaagcaagttatgaaggaggaatacggattttggcagagaaagtctgtaagtaggaagctgtaaatcatgtgtccaacatgtggtgagcagattgttttatctggagtggggactgggtggcggaggggggtgagcagaggaaaatctaggcctgggacagagaggcagcctttgggcaatgggacagactggagactcttttagttttatgtaatgcaagggctaaggaaaaaactttgcctttgtcccctgaaggtttgctgaaaaatcaactgacaaaaagcagattaatagaagagaaggctggccaggcgcggtggcccacgcctgtaatcccagcactttgggaagttgaggcaggaggatcgcccaaggtcaggagttcgagatcagcctggccaacatggtgaaaccctgtctctactaaaaatacaaaaattagccgagcgtggtggcatgtgcctgtaatcccagctactcgggaggctgaggcaggagaatctcttgaacccaggaggcggaggttgcagtgagccaagatcgcaccactgcactccagcctgggcgacagagcgagactcggtctcaaaaaaaaagaaggcaaggtatataagtgtattagtgtgcgctgtgggaggagggaggaacacagagtgattacccatatcctagtggggtacagatgtttatatgtcttgttttttttaggggaaaaggagatggggaagtgtggatgattttagggaggtaacagatgatttttaggggaattcaatgagcttgaagaacatacaatggcttgggacaaagtctgtttgggcagacaatggtttgtgacaaaaatctttccaggtgtgttgaccgacttcagtgttttgccctgtgatatgggttcagttaatgaaaactcagggagggaatggatcagaggtgattgttttcttttttgccaggtctagacgttaggcagataagggaactccagagaataacttttattctgtgttttgggaggacagaaatgatgggaaagggaggaagatcagagatacattgaggcttcttcctcaattcagcatgtcaaagcgccatattttgggataccgctttctgagccccaacagtaactaggtattattttgaagggttgcattcacacttgtgacatggagtaaaggccagtggtaatatttctgtagagcgctttagttctgtctctcaatgtactttccttgttaactaatttctcctttagtagcaaaaggaattgtgacaggtgcatttaaagaaactgttacctgcaccaactaccaggcattcgttagttggggagaaatgagaactcatgttttccatactcagccctaccccaagatgacctggcaactgtacattttatcccactgggtttaatccttattatgaataacagagcgaaactttgttattcatgggagtggatttctcctgctgagagaattagcggcaatctcattcaggaagctgccttctgatgcaatgaggtcttttgaactgtgcataaatagaggccattctttaggcatttggagcatagggcttaaattgctccagaagttccaatcagactctaggtatctttggctgttttttttgtattttttttggttttttttgagacagaatctcactctgtcgcccaggctggagtgcagtggcacaatctcggctcactgcaacctctgcctcccgggttcaggcaattctcctgcctcagcctcccaagtagctgggattacaggcgtgcgccaccatgcccagctaatttttgtatttttggtacagacggggtttcaccatgttggccaggatggtctcgatctcttgacttcatgatccacccgcctcggcctcccaaagtgctaggattacaggcgtgagccaccacacccagccttctttgactgattcttctctgtgtgcgcatgtcctgaggtcacaagtggtagtgtgctccgtattggtttcttgacctgcctcttcaggactttctaaaattaaggtacaaccgattcttttgctgcagtcctttctgcctaaagaaggaagaaattcttctgttttcagaaaaaaaaaaaggaaaataaaagaatatgccagcttcaccaggataacccacagacattgagcattaggagtatggtacaaaaataatttctttcctcattaaggtttttttttttttaatttatgctacgagaaatagaacagagtgagcctattgttgtcttgccatcccagaatctcttaggaggacaaagagagatactttagtgtttgtaaagggagggttgactatttgtgcaggtttcaaaactcctgcaccccaagtccccagcagaataagcctctctgggtccattgaatggtgggtttttgaatggtggatctggggccttgtatggcagatgcacctgacagccataaccgaagcacatcctaagaatgaccctaaggttggccaggcgtggtggctcacgcctgtaatcccagcactttgggaggccgaggtgggtggattacttgaggtcaggactttgagaccagcttgggcaacatggtgaaaccccatctctactaaaaatacaaaaattagccaagtatggtggcgggcacctgtaatcgcagctactggggaggctgaggcaggagaatcgcttgaacccaggaggtggaggttgcagtaagccaagattgtgccactgcactccagcctgggccatagagtgagactctgtctcaaaaaaaaaaaaaaaaaaaaaaaaaaagaatgaccctaggatctaagaagaatgtgtgtttggacttccaagctaaggaatcggagagtggccaacctggagattcactccttatctatgacagacatccgaacccctagctcgttccttggaatgcaggccacctaggggatggaggccctttgctttgggttaaatggaggttgctaggtgggagggtgctaagtgaaaaacacaatataaactgcatgcttagtacaaacagcagtggttctcctgtccagcctgctgcccctggaatgccccttatgtaagtcctcaataaaccctgtctccctcactagctccgggtctctctctcttttttaatggagtctcccaggctggagtgcagtggtacaattatagctgactacaggcatgtaccaccacgcccagataattttaaaatttttttgtagaggcaggggtctcaccatcttgcccaggctgttctcaaactcctgggcccaagtgatcctcccacctcagactcccaaagtgctgggatttcaggcctgagccaccacgcccatcctgggtctcttttttggtgcctcggacatggtgccatccctgcttggagtcagcagaggtcttacgcgacagtccttggaatggtggaagcctgttttgttgtctttgatactatgaagggacaaacccctgctttgaaggtgtttatttcctgaaatttttacctgggatcccagctatctctttctttctttctttctctctctgtctctgggatcccagctatctctttctttctttctttctctctctgtctctctctttctttctccttccttccttccttctttctttctttcagatggggtcttgctctgtcgcccaggctggagtgcagtggtgcgatctcagcttactgcaacctccacctcccaggttccagcgattctcctgcttcagcctccggagtagctgggattaaaggcgcacaccaccacaccaggctaatgttggtatttttagtagagacaggggtttctccatgctggtcaggctggtgtcgaacttctgacctcaggtgatccgcccgccttggcctcccaaagtgctgggattacaggcatgagccactgcgcccggctgcatgacttttctataaagccttattttaaatgattttgggggcttaatttaggtgttttcatttgcttttggtcacagtctttatgtgtcactgagtgtgtggatgtgggggttcttctacccagaggaaagtgatttgatcacctggaaccaggtgctctgagaactggggcagcttccctgacttgcaggagagggtgcagagacttcttcgctggcatgtagctgcagcctagaaaaccgcttggtggtcctcgttcatgaacctgccgttgggggtgcttcatgctttatcttggtctctaccttgattaatctcacctccgtttctccgctccactggaccattctctagaacccctctagaaccactggaccattctcttctgtcagagtccagtgcttccagtctttcctgtgggctcttatcttctggtgcaaagttctttctcaccttccacagtcaaaatcaccatacttacctaggccatacttactaggctggagaggcaggtacatcaatctttcttgtttatttgtttgtttgtttgagatggggtcttgctctgtcacccaggctggagtgcagtggcacgatctcctccgcctcccgggttcaagtggttctcctgcctcagcctccccagtagctgggataacagttgcatgcaaccatgcctggctaatttttgtatttttaatagagacggggttttgccatgttggccgaactgctctcgaactcctgacctcaggcaatcctcccgcctcggcctcccaaaatgctgggattataggcatgagccagcatgctcagccaggtacattgatcttctaagtatttattgttctgctccttattcagtgctaacatttttattttcttattctttttccctgtcacttgaagatcgtcacccaagcaataaatccatttggttgtacttatttaattttctctgactttctaaggagtgacacagcaaagtgccttatcttgcatttctttccttttccgtgttctagttggaaaggctcagagtttgggagaagttaaacgtgactcagagaattgcttttgatggtggtgccgatacacacatcttttgaagcttagattgggtattgtcaatttaatttggagtctatcagcctgtagtgttctaatcacctattttgaagccttgctgacgacccgagattccttgttaaactgccactggaataagcataacacttttcattaaaggaaaaagaaaatgttacttaaagtaataggcacacccttttattttcttgacagatagcaaagaaaaaaatcttctgtctttaccttgacaagacatgtaccattgctgggaggttttgcttgtatgagaacttcaacgttagaatctagacatctcggagaattgaaactcaacaagtttctctgttttggggtggagaaaaaggacaaaaagttgtcatatacagctagctgtccaaacagtcaaatacgaaagctaatttatcttttaaaaggttaattctttgatgcctctatcacagttagtgttaaaatgaaagcattggaaacaaactctttttctgttagctcagattttaaaaaaattctttttgcagagatgggggtctcactatgttgctcaggctggtcttgaactcttggcctcaagcgatccttctgccttggcctcccaaaatgttggaattacaggggtgagccactgagccagattttgaatattttaattacttaactgcttgtctgtctggcaatgagataagcgcagtagccagtgattaccaacagttaaacagaagaacaagtcacataaacaacacttatacttcctgtaaacccaattaaaaccacatttcaggtttgctcttatgatttagaagtaaatttagaatcagtttcatgaatcttgcagtatttttcaaattaatgtctttaggcatttggacaatgggctgtgtgaatgcaaactgcgttttcttcaattgctatcaattagagacagttaagaactcaactgatgaagaaatagccacctgaaagtgagcccacaggcaagtcacaggcccctcttcctcctgaaggtgcacgggagacttcgttaaaaaaaaaaaagctgtagtaaaatacgtataagataaaaatttaccattttaagtttcttttttttgaagacgaagccttgctctgtcacccaggctggagtgcagtggtgtgatcacaattcactgcagcctcaccctctccggctcaagcgatcctcccacctcagcctctcgagtagctgggactacaggcgcacaccaccgtgcccactaatttgttgtagttttagtagagacgagattttcgctgtgttgcccaggctggtctcaaattcctgggctcaagtgatccacccgcatcagactcccagagtgctgggaaggtgtgagccaccatgctcggcccattttaagcattgtaaattgtacaatttagtggcattaagtattttcacaatgctgggcaaccatcatcactgttcactttcagaactttttcatcattccaaatagaaattccacccattaaacactaactccccaatgtccccttcccccaccctctggtaacctttatcctatgttctgcctctatgaattggcctattctaggtacctcataaaagtagaatcaatattatgtgttcttctgtatctggcgtctttttcttagcatgttttcaaggttcagctgtagcccatatcagaatctaatttcttttcctttttttgagacagagtttcactcttgtcactcaggctggagtgcagtggcacgatcttggctcactgcaacttccgcctcctgggttcaagcaattctcctgcctcagcctcctgagtagctgggactacacgcgcgcgccatcacacccagctaatatttgtatttttagtagagacggggttttgccatgttgaccaggctggtctcgatctcctgacctcaggtgatccacccaccttggcctcccagactgctaagattacaggtgtgagccaccgtgcctggctaaaaattcttttttgcacatgataaactcacctatcttaagtgtaaaatgaataagtttcagtaaaacaacaaaagctcttaagttttagtaaatccatacatctgtgcagccatcaccgcagtccagttttagaactttccattcccccctaaacatcctccttgcctgtttgtggtcagttcttgctcttaccctgatccccggcaactagtgatgtgatttacgtctctatagttttgtcttttctagtaatttcgtataaaaattatacaacatgtagtcctttgagactgaccttttttttttttgttttgtttttttttgagacagagtctcgctctgtcgcccaggctggagtgcagtggcgcgatctcggctcactgcaatctccgcctcccgggttcatgccattctcctgcctcagcctccagggtagcgggcactacaggtgcccacatcacgcctggctaatttttgtatttttagtagagatggagtttcaccatgctagccaggatggtctcaatctcctgacctcgtgatccgcacacctcggcctcccaaagtgctgggattacaggcctgagccaccacgcctggccgagactggcttcttttactcaacataaagtttttgagttcattcgtgttgttgaatgcatcagtggttgggttttttttttgttgttgttttttgagatagggtctcactgtgatcacccaggctagagtgcaatcacagttcactgcagcctccacctcctgggctcaagtgatcctcccaacgtcatcctcctgagtagctgggactacaggcacatgccaccacacctggctaatttttgtatttttgttttgtatagacgggggtctcactatgtttcccaggctagtctcgaactcctgagctcaagcagtctgcctgcctcagcctcccaaagtgctgggactacaggcgggagccatcatgcctggccaatagctggttcttgttttactgctaatagcattccattatagggatgtaccacattttgtttattcatcaccagttgatagagatttgtttctaattcggggctactgtgaatattgctgctgtgatcatttgtatacaattcttggatggacatgtgctttcgttcctcttgggaagatactttaaggagtggaattgctggggtttttttttttttttgagatggagtctcactctgtcgccaggctggagtcactgcaacctcctcctcctgggttcaagtgattcacctgcctcagcctcccaagtagctgggactacaggcgtgcgccaccacgcccagctaatttttgtatttttagtagagacagggtttcaccatgttggccaggatggtcacgaactcctcatgatccacccacctcggcctcccaaagtgttgtgattacaggcgtgagccactgggcctggccactgggtcttatattaaacttatgtttaacttataaagaaattgccaggctgttttccaaagtagttcttgcatttttttactctcactagcaacatatgagcgttttgggtttgccacatccttgtcagtacttggtattatccgtcttttgtttgtagcgattctaatgagtgtgtggtggtatctcactgtggttttactttgcatttcctgtactcttttaaaactgctttccattatagaacatgttgtgttgtgctgttatatatataaagcttctgctcacctgtgagctactctgtctagctgattgatccagtattgtgtccgggggcagggtacatggaaaatgcttagggtttgttgagtgaatgagcaaactgatactttgtaggagtggccaattttcaaatattttaggtaacagaaaacagtggtgaatcaactcaaaagatgaggtaccagtcaaatctcttcccttttgtcagtttctaagtagtattaaacttgagtgaactaagttttacttttttttcctttgctttgcttaccccttggtgagaggtaatggagaaaatatagacagagcaggaggaggaaagaaactcaatctcgaaatgactaagagcttgtggagcagcttgggagagaaccagctgggttattggctactctgtagttccaggtgtggggaattattctcatcaataccgtgaccgcctgccactcccctctgccctctttctttgtgttaattagagcaggggtctgcaaacattttctgtaaagagagtaaacaaatatgtcaggctttgtgggccaagagaaaacatcagcgacgttgtggaggtgcttacataacgacagacaaaacaaatttccatgaatttttatcgatgaaactccaaacatagtaatggggtacgattttctgtaacacaagtctgctaatgagaagaattgaattatttgagggaggaaaacattttgcttaattggaagttcagagttaatgtttcctatcatcatggtagaaatgtggcctcattcttctacaaagcttctctgatatgcagtggtcttccctcctgagaattcaccagaatgtactggcttgatttgcccttgatttgttggggaacttttcacatgggggaagcacattaagagtacaggctcgggctgggcgtggtggctcacgtcggtaatcgccagcattttgggaggccaaggcgggcagatcgcctgaggtcaggagttggagaccaccctggccaacatggtgaaaccccgtctctactaaaaatacaaaaattacctgggcctggtggcgggcacctgtaatcccagctacttgggaggctgaggcaggagaatcgcttgaacacgggaggcagaggttgcagtgagccaagattgtgccactgcactatagcctgggacacagagcaagactccgttctcaaaaaaaaaaaaacaaaacccaaaagaggacaggctctagggtaagactctggggtctgaattccagctcaacaacttattaactatgtgatctttcactacttacataacccatctaaaagctttggtttcctgatctataaaatgaataatagtacctatttcacagagttgctgtatagattaaacacaaagatttagaatgacatattatactttttattcttcttttgattttttttcaaccatttaaaaatgtaaaaccattcttaagtcatgggcagtatgaaaacgggtggcagggcctgcaggatatagtttgtggaccctgcattggagtatgaacttgaattattgccgtttactttagaaacgatgattgcttttttcctaattgcaaagcaccatatgttcactgcagaaaacttggaaaacacaaaaaagcacaataaaacaaaagccattcagaatctccaccatccagagacgtttcatgagtagtatgttgccccatagccttccagacaattgtgtacataatacacatatttcattattttttattttcctttttttttttttttttgagtcagggtctcactgtgtcacccaggctggagtgcactggtgcaatcacagctcactgcagcctccacctccagggctcaagcaatcctcccacttcagccccctgagtagctgggactacagctgcatgccaccaggcctggctaatttttattattttttgtagagatggggtcttgctatgttgcccaggctggtcttgaactcctgagctcaagtgatcctcctgctttggctttccaaagtgctgggttaacaggtgtgagcctctgtacccagcctacacatatttcaaagtaaaacccaagcccatactatgcatactgctttgtatctttttcacctattaatatgcaatgcttgtcattaatattcttctataacctgaattttaatggccacatactattctgttatactgtgttaaaatttactaaagcaatttccaacaacattaatgctgttttgaatttttcaccattagactgaactcagcaataacctggtacatacatgcttatacacatctcttgattcattccttgggataaattacaaaatttaatcactgggtgacagggtatctacatttttatttatttatttattttgagacagactctcgctctggagtgcagtgatgcaatcccggctcactgcaacttccgactcctgggttcaagcgattctcctgcctcagcgccagagtagctgaggttacaggtgcgcaccaccatgcccagctagttttttttgtttttttttgttttttttgtatttttagtagagatggggtttcaccatgttggccagactggtctcgaactgctgacctcaagtgatccacctgcctcggccttccaaaatgctgggattacagacgtgagccaccgctcccagctgggtatctacatttttaaagctttggtgtatcttgcaaagttgtctcctaggaaagttgtatagttagtcattcccagatgatgtatggagcactgttgtttcaatgcccctcttatatttttacttggttactgggtttgtgaacttaaaaaattaaaacattcttattttaaaaacaattcaaatatataaaacatgtacagataataatgaaacgtacacttatgtacccagcagaaagattaaatcggtgttaacattttgctgtatttgcatttgttacttttaaaaaacacattccagattcaaaaacaagtctattattatcatcccattttacaagtgaggaaactggctcaaaaactttaagtaacttgtctaattcttaagaaccagtaagtgggctgtaaagaaccagttgatcctaatgatgcttttaccttaggcttttactgatattaatatagcccttccagtcttcttcccctttttggtcagtttctgtctggtacatgttttctaatgtctctacttttaagttttgtatgttgttgtattttagatgggcctcttgtaaatagcttatagctaaattaagaaaaaaatctcgagtctgggtttttaaaccagctattaataacctgttttttaaccagctatttcagtctgtttgcatttatagcaattgttgatgttttttgaattatttgtcttatttcatgctttctatttcccatactttttctgttttttctccatttcctgtctcctactgaattgagttttaccaggttttctctttttctctctactagctttgttatcctaaaaatattcaatgtgtatacttaaatagcagtcagaaattaccctatcacctcccccacccagtttttttcttatttagtgttttaatttctccttttttggtattttattgtattttgtattttattcactgttatttttgttgttttgtgcagcccaaactgtatatatttttatttactagggtctttactcgtctttctaagtactcttttatgtacacattttattttctgaaaatatatactttagtgcattttagtaagagcctgtgaatgtacttagttcttgtttaaaaacagcttctttgtcctcatctttcaatgactctcttttagcttagtatagaatctcccctcaaccctctgaagatagtatttctttgtcttctcaacttttcttttcctcatttgttttctcaacttctcaaccctcttttttcttatttatttggaaatggggtctcactatgttggccaggctggagtgcagtggccactactgatcagcacaggagttttgacttgggctatcacttcacccctccttaggcagcctggtggtcccctgatcctgggagatcaccatattgatgccaaacctagtgtggatacctgtttggaatagtgcactacagcccagacctcctgagctgaaacgatcctccctcctcagcctctgaagttgctgggactatagtctcgtgccgccaaaccctgctcagctctcatttgttactgagaagtcttctgtctgattgctcttcctttgtaggtaatctgccatatctctctggctgttttttgttttttgttttttgttttttgttttttgagacggagtctcgctcattcggcccatgctggagtgcagtggtgcaatcttggctcactgcaagctccgcctcccaggttcaagccattcttctgcctcagcctcccgtgtagctgggactacaggcgcctgccaccaggcccagctaattttttttgtatttttagtagagacggggtttcaccgtgttagccaggatggtcttgatctcctgacctcatgatccgcccgcctgggcctcctaaagtgctgcgattacaggcaggagccaccacgctggctatctggctgttctttaggcttcctctttgtctttgaaattctggagcctcagtcctgtgtgcatggattcatttttatttattctgcttagaacttggtattctttacacggagaattcatgacttttacaattctggtaagtccttaactattatcttttaaaatgttgcttctccttcactggggcagccataaaatcatgctgctcggttgtcttgctggaggaagcatagttgactgagccccagaggccatgtctcagattcactcacgcttctcctgggctgctcccagctgatggcagaatatgacaggggtaccagtgctggcccactgctgcaggaggtaggatcctttcatggatgacattggctcctggactccccatcagtgtgaccaaactttcttacatctgcgtctcactctgagtctcttcctacccagtactcctttcttctctctccatcatacctacaccatggtctgaaggctctccctgcctcctcctgcttcctcctctttttccttcacaggtgtttttcccaacatctcgtctcagcatctgcttcttggaggacccaaactaacaccgtatctctgttttcatcatctgaatcttgtattagatgcatatggaccttctcattgtgctctctatgcccttagttattcttttatgcctcattgacctctctaatgctctttgggtaatttcctcagatctgtcttccattttactgaattctctcttcatttctgtctaatctactatttaatctatctattgcattttaaaattataatatttatttctaaaagtaccatttggcttgttttcacatctgactcttacttttttcccagtatattcttctcagggttttagtttctcattttttgtctttaacagtctaaagcacacttacattgtactccctctttcaaattgtagttttatcattccaagttccctggagctctaataatcttgtttgttgtatttgctgttttctgcttatggtgtattctaatttttaattttcctctaaactaacctttagtgggggttattttttttccgtgggaatcttacatggtctgatagtgaggctccttcagaacaattagcattgctcagaacaatttgcattgcttcttctagagatctcaggagtgtcactgccttggggccaatatttctgttaatttcttagtttagaacggcctggatcaccccgcttaaggctcaggtttgggatatccatttttcaggggagaggtttttttcacttagaacccaagaacacaaaattgttctcctagacccctgtaccaggggatgatttttccccctagtctttcttttcactgggaagtatttctttgaagatcctaactctctttggggcttttttttttctttttctttttttttttttttttttttgagactgagttttgctcttgtcgcccaggctggagtgcaatggcttgatcttggctcactgcatcctccgcctgccaggttcaagcgattctcctgcctcagcctcccgagtagctgggattacaggtgtgggccaccacatccagctaattttgtatttttagtagagaaggggtttcaccatgttggccaggctggtcttgaactcctgacctcaggtgatccgccccgcctaggcctcccaaagtgttgggattacaggcgtgagccaccgtgcccagcctctttggggttttagttccaactctctgcttcatggtgactcatggtttcacctcctttgtccacttgggttttaaattgtaagtctggaagttactagaacaatcccagaattagctcacacactttcactctgtttttccctttcttcctggggttatattttacccagcattcctaggtgtttgtggtgggagattccgcccctacgttatcttaatttgttgccatatttctgaaccaggaatcccatttaccacattgagttctggacatcaaggttctccgggcatcactttctatgctgtgtcatcagtgaagcccataaacttacccgttatcagaaaagcgaagatttcgagatcttgttgagacggtaggtatatagtatgtcctgaggggtttagaaaaaatagctacctttatttccaacccatggtaacttcattggtaaatccagacagacctgtaagatttttacaaatggaaccagcagcttagaaaacaaaaaataataattactttatcatcacaagtattccttttactgcctcagcccagtaacagagctcttctatctctctcgtttctttctcccagctttcccaccatccttctcaatttgtcctttgtcaacagggcagaaaaggggttgaagtgatgtatgggtgtaatccactgtgcactgctgaaaagataaacttaaatgaagtgatttataacctgtggcaggtattctgcacccagaattgtttgtcaaagtgagtgctcattgattttccatgccttccgtgtcagcccctggattgccattgttccttagaggtggctaagcagtttaaggcatcagggtgttctcccagcgcgggcactcactccgctgcagggtttagccttcaactgtgttccagggctcggaactccctagttgaccccttgctgcaggaggcaggattctttcgtggatggcattagctcccagactccccatcagtgtgaccaaaattttcttgttttttttttttgaaacagagtctcactctgtcagccaggctggagagcagtggcccgatctcaggtcactgcaacctctgtctctcgggctcaagcaattctcctgcctcagcctcccgagtagctgggatgtgccaccacgcctggctaatttttgtatttttagtagagacagggtttcaccatgttggccaggctggtgtcaaactcctgacctcaggtgatccactcacctcggcctcccaaagtgttgggattacaggcatgagccaccgtgcccggccctttcttttttctttttctttctttcttttttttttttttttttttttgagacggagcctggctctgtcacccaggctggaatgcagcggcgcgacggtggctcactgcaacctccacctctcagattcaagtgattctcctgcctcagcctcagtagctgggattataggcgcgcgccaccatgcctggctaatttttatatttttagtagagatgaggtttcaccatgttggccaggctggtcttgaactcctgacctcaggtgatccacctgcctcagctcccagagtgctgggattgtacaggcgtgagccactgcgcccggccagtgtgaccaaaactttcttacagctgtgttgcactctgagtctcttcctacccggtactcctttcttttctctccatcatacctaggccatggtctgaaggttctccctgcctcctcctgcttcttctctgctaccatccacactcactgtgtccatgaaaagaccagattccactggtacttcagatttctcaaatgagaagtaaaacatattctataagttttgaaaatgcttctataaaatgcttctggaatcttcctactggaagtcaaatagataataggtccccatagaatagcacgggacaatagtacagcttcgggggcggtgcccagggaaatctgggctgagttagatgaaggatactaagcatcctatgggaactcatgcagcagggagtctccttcgcttaaggggaccacatacatatcacacaggatgtgtctttcttgtttttctccaaacccatcccgttgtgttggagggtgatgaagtttttccagcaaccacagtgcagtctggtgaatcagaatcagtgtcattgagcctcagcaacacccagatatccaagagattgtcttaaagaatcttagaactgtaggctgggtgtggtggctcacacctgtaattccaaaactttgggaggccaagaggatcgcttgagagcaggagttcaagaggatggcttgagggcagaagtctgaggctgcagtgagctgtgactgcaccattgcactccagcctgggtgactgagggagaccctgtctctaaacaaaaacaaaaacaaaaaacttagatttttggaccttagatcatttaatctagagttctaactcgataggcaaggaatctgaagcctggactatttgatgacttgctcagggtcacagaactatggagctccacagccagcattacgacctgggtttctggacttcctgctcatccctgtttctggaagggcttctgctccaggtctctctgggtaatgtcccatttgctttcacaacatgcctcttgaatctaaagaaagcagtgctgttggtggttgtcttagttgcagtttatttgcttggtcctttgaacaggaagagagttatgtttattatgggttgggaggaatgaacttgcctacacctttttttttttcttttcttttctttttctctttctttctttcttttttttttttttttttttttctgagacagggtcttgctctgtcgtccaggctggagtgcggtggtgggatctcagctcactacaacctctgcctcctgggttcaagcaattctcctgcttcagcctcctgagtagccaggattataggcgcccaccaccatgtccagctaattgttgtattttcattagaaatggggtttcactatgttggccaggctggtttcaaactcctgacctcaggtgatccatccacctcagcctcccaaagtgctaggaatacaggcgtgagccaccgtgcctggctgcactttttcttttttctgttgtgtgcctaagacatggttatctagacaaaaataccacttagtaggcactttaccaatacatatcatgctagaaaacagattgctttcatgcaaatgaggtggagctaggaaagttatttatgtaatgattatttcacaattggaatttttttttttttttttttttgagatggagtttcactcttgttgcccaggctggagtgcaatggcgtgatatcggctcaccgcaacctccgcctcctgggttcaagcgattctcctgcctcagcctcccaagtagctgggattacaggcatgggccgctacgcccggctaattttgtatttttagtagaggcggggtttctgcatgttggttaggttggtctcgaactcccgacgtcagttgatccacccacttcagcctcccaaagtgctaggattacaggcgtgagccgccgcccccggcaacaattggaaattttttaaaaacaaagactatttagcttgagctcaactaaagactttggtttgcatattatagacaaatacataaattgtgtttatatagactgtgtacatatataattatatactgatgagatatagcatttgtatttttcaaaccacaaacatcctgtagtaattcagacttataaatacttctgcatagcaagtaacaatttataatagctaaacaggaatgaatatggatggtgtttctttgtgcctctgattggtgggtaggggggattgaaagcttgattttgatcagtttttttttaaacttatgtgcattattgattaatcacttaattgaattggtgggatatattttcatacatgcagttgtggcaatattgattgagctttctctgagcccaaactaccaattcttacaagtgaaacaggatgtcatctccgtgttgtaatcattttatacttcacatagtacattggaagtctgaggtagcaaattcggcttccggaagtccttgacttggggtcaaagagcatcgctgatatcaggagaagctgcctgaatgtgaattcggtagtaaaaatggaaagatattttatgtgtttggctaggcgcagtgcctcacacctgtaatcccagcaccttgggaggctgaggtgggcagatagcttgagctcaggagtttgagactggcgctgtgggcaacatggcaaaaacctatctctacaaaaaaatacaaaaattagctgggcatggtggtgcacacctgtggttccggcggctacttgggaggctgaggtgggaggatcgtttaagcccgaaaggcagagcttgcagcaccactgcactccagtgtgagtgacagagtgagaccccatttcaaaaaagaaaaaaaaaagagccaggtgtggtggctcatgcctgtaaccccagcactttgggaggccaaggtgggcagatcacttgaggtcaagagttcgagaccagtctggccaacacagtgaaacctcatctgtactaaaaatacaaaattggccaggtacagtggctcgtgcctgtaatcccagctattctggaggctgaggcaggagaatcgcttgaacccgggaggcagaggttgcagtgagcagagatcacgccactgcactccagcctgggcgacagaacgagactccatctcaattaaaaaaaaaaaaatgatattttctgtgttcatctaagtagagaaataagtatagactgccttatgttcatttgcttcccagtgttccttggtggctggattattcatctaagtgagatgtaagatcttttgagcatctaacataatagttattcataaagacatttaggctgatggctttctcagaacgtcctgctgttcatgatggacttcatctatatttcaatgaatttctaaatggaggaaacagaacatttttcctttgattaattcattggttttcagtcctcaaggacccataggctggcgaactctaagaggaagtcacaaaaggaagaatggtaaattggaattggaactgtggaactcaccccgtaaaaatctttcaacactgtcctgagttcaacatctgaaatacagtggaccaggagaagattgatggaagctaatttaaaaagctaatttaaaattgcaccaaaaaaagcacagcgttatgaatttaataaagttcgtagggtgttttggaccacgattttacaactctctcactttttttttttttgagacagagtctcactctgtcacccaggctggagtgcagtggtgcaatctcctctcaccgcaatgtctgcctctcgggtccaagcaattctcctgtctcagcctcctgagtagctgggactacaggcatgcaccaccaggcctgattgatttttgaattttattagagatggggtttcactatgttggccaggcaggtctcaaactcctgacctcaggtgatccacccgccttggtctcccaaagtgctgggattacaggcgtgagccaccacacccggccacaactctcacttttaattgactgtgccccagaatcaagcactttggctagcaaatgatggctagttagatcacagaggtgtgtgttgcattctgtgtctgttcactgtgaaatcgggattttaagagtgtatgttgttgaacatacacctgtctttgagtgatcggtccccagaggccacctctaaggtgaagatttggggaggtaattgtgggaagccccaggaggagcagaggaaaatgagaaaggggacgaagggaatgtaatagaatgtgtgttgggagagggtttccttatgagccagtgcagaggaaagtcttgaaatgcactaaggaaatacagtctgtgccgtgatggtagcaccgatgtggaatcccataagcagctgcttgaaaaagacttggtggcagacataactctttttgccttttaagtgctccgggagatttcacatgccaatgttgaattgtccccaacttgggttcagggtgcccaggaactagcaaaatcagcttttttgtggtaggatcttcataggatccaggagctgtcacccacgaatgacagagcccctgcactggatagcctttctccaatctgtataaggtggaatagggaaatgaggctcctctctgatgttcggggctttagctgggctgggttctgagtcctctgtgcctagttccccttgggaagcactggagaccttgaactggaaattctcttcctgggatcaaccaaatactcccaaaacttcgtggaagcttagctccttgtgccttttgtcaggtttccctagaagtcaagggattctcatggagatgatgtatgggatgggggctagagggctgggaggatggtagggcgggggtaaatctaaacttcaggtgtcttgggagtccatgacttgcatcacagagctggtttcccccccgtcaggcaaggtcggcctttatttatttatttatttatttattttagagacagagtctccctctgtcacccaggctagagtgcagtggtgccatcatagttcactgcagccttgaacttctgggctccagcgatccccctaccttagcctcctgagtagctgggactacaggcacacgcccaaatgcataactaatttttaaagtttctgtagagatggtggggtgggggggtgggggggggcgcgtctcacgatgttgtccagtctggtctcaaactcctggcctcaattgatcctactgtcttgacctcccaaagcactggaatttacaggtgtgagccactgggctggccaaagtcagccttttgtacccctctcaatgtcagccattgattggttgtgggcctcccacaggtggagaggttcccatttgttcaaacgcaatttacaaacaagggggcagatgggacccattagtagctgaaactcacagcaaccagtgcctagtaaaggattcatgcagggccctcccacacgacccaaaacagcaaagagaaagggccaggtgttggcctttttctaactcatcccttttaacacagtaagttcagcagtcctctaagagtcccacttcaaagtacccctcttgccttccgaattcagtgttgttagcccttttgcttgaaaaacccccactcttggacacagaggaaataggagtcagatgtctgcaccttctgcacctgtggtttgaacaggaccctctgggagtcgcaggaggagtgcttggccctggtgcttggcaggaggttgggctgggagatgatgattgccttgatcctctctttcaactacttcattccaactgttggaatacctcagtagtgagtattaattttcttcccccccaaatccagcaagcaatctagctccttaagagaagactatgttcctgctattaacagggctttgactgtttttgcaaaataataactgggcattcttgtgttaaggaccatttgtttccttcacctgcttttcttcccaatttagctgaaaagggacctgagccagttaggagatttttttttttttttttttttttgagatgaatcttgctctgtcacccaggctggagtgcagtgacatgatctcggctcactctcaggttcaagtgattctcctgcctcagcctcccaagtagctgggattacaggtgtgcaccaccattcttggctattttttgtgtgtgtgtgtttttagtagagatggggtttcaccatgttggccaggctggtctcgaactcctgacctcaggtgatccacccgcctcagcctcccaatgtgttgggattacaggcatgagccactgtgccccgctggagactttttttttctgaactaaaatatcttttcagatacaaggttcagggagggtggtgtggaccagtgagagaagtttcatttgcacctttttcatttttattctgatccagagtgactggagtattaatggatgttgtcataggcttttgaagtggccttgcttggtgattgagtggctctcgcaaaattctgaattttggaaccaggtattgctttctagctatactaacatgtccctttaggagtctaatgagatctgctttgcctctgccccaaacagatttgctttacaagttactgtcactcagggcaagctccaagctctgtatctaaaaagcaaagccacctgccagccacaaccaggtgcatgttgcctttgggccttgtgtcaaaatatcttcatcatctaagaataaaacccccaaagaggtcagcctgatcttgtagaaagccgtccctgggaaaatgattaaatgtcagtaaacaagagcatttcagaaactgacatggtccctaatgtttgtgtttagagactcctaatgtgtcagaattgagttggagacttacgatgtaattgcatgtcttgtatttcatgccagcctctcggcttggtgctggggcagagtgggaagcagaccacagagcagagagggcctctgcccttttattgtcctgtgagagagatggatattcacaaataatcctgtccctaattaattgcagctgagataaccattataaaagaaactagagagtgtgacaaggggtgactatctcttggtcttggttgtcaggcaatgctatggaagggttatttagagtcgtagaagtgtctagtacaaccaccagctgatgaagatagtacaggaggaagcaggcatgtttgagacatggtgagtttcaggctcaattaaggagctggagatagctaccagctgttagcaacactgggggcgtgcaggagcagcatcagggacagatttgggagtcccttggggaagccgtggtgaagccacaggaatgaacaggtggctttctttcctttttttttttttttttttgagatggagtctcactctgccgcccaggctggagtgcagtggcatgatctcggctcactgcaagctctgcctcccaggttctggccattctcctgcctcagcctcccgagtagctgggactactggtgcccaccaccacgcccagctaaatttttttgtagttttagtagagacggggtttcaccgtgttagccaggagggtctcgatctcctgacctcgtgatccgcccacctcagcctcccaaagtgctgggattacaggtgtgaaccaccgtgcctggccgcttttttttttgagacggagtcttgttctgttgcccaggctggagtgcagtggcactatctcggctcactgcaacctctgcctcccaggttcaagcgattctcctgcctccacctcccaggttcaagcgattctcctgcctcagcctcccaagtagctgggatcacaggcacccaccaccacgcctggctaatttttgtatttttagtagagacgaggtttcgccatgttggccaggctggtctcaaactcctgacctcaggtgattcgcctgcctcggcctcccaaagtgttgcaattacaggagtcagccactgcgcctggcccaggtgactttcttgagagagtatggagagggatctgggagaatgtctggatgaaaccttctttaagggcctgtcacctacatgcaataaagaccatactaattgtaataagaccattgtttactttttgttccccaactggtgcaattttcccagtccctgtagtagccccaggatggctcagaaactgtctgggttcctgctgtagacactgtgagaacttcctttccaagtgtagccaagcacccgccccactgctgcagcctgtgccatcctcccccttctctgcacacattgcatatccctgtggtctccgttttgagctcagagtgtgggcctccaaccctcagcaccgtatcactccgtagcttattagaaatgcagaatctgcagcccccgcccagcttgctgaatcagcctctgtgttttaacaagatccccgggatctgtctgcctgttgacaagggagaagcctggtctcggttacctcctcctcagcgtcctgagcctggctggatcgccagcacactcagaccagcggccccaggctcttgtgacagcagccgtcagacccgtgggagttcaggtgcgggtcatcagggccctgctggctactccacctctctgggtccctcagctcagagattccacttgagtgtagagagaattgttcccctctgctctggtgccctctttgcactaatgtttagggacctagaaagggcatcaggaaataagacagaacaaaagccaccaagaggaagaaggaaattcaagtgccatagctatagagaggctcaggaggataaaaacaaagcaatagcaggggctgagagattttttaaaaatcagctttactgtgatatataatatatatatgtgtgtgtatatgtatatatataatttttttttgagacagaatcttgttttgtcatccaggctggagtgcagttgtgcaatctcagctcactgtaacctccgcctcctgggttcaagcgattctcctgcctcagcctcccaagtagccaggattataggcacacaccaccacacttggctaatttatgtatttttagtagagatggggtttcaccatgtcggccaggctgttttcaagctcctgacctcgagtgatctgcccactttggcctcccaaaatgctgggattacaggcatgagccaccacacctggccatattgtgatatagctaacatagaatagaactcactttaagtgtacagcttgatgagttttaacatatatatacacacactgtagtcatgtaaccactgccccatcaagatacagaacatttcatcacccctagaacttcccttgtgacttttagctgtcaattacttctctctaccccccacattccccactcctgttcctaacaagcactgatctgcttttgcactaaagtcttgcctttcttaaagtttcctatagatgcagtcatacagatgtagtctcttgtgtctcacttcttttgctcaacacaatgtttttgaaattcatccatattccccgtccgggagggaggtggggggggtcagcccccctgcccggccagccgccccgtccgggaggtgaggggcacctctgcccggccgcccctactgggaagtgaggagcccctctgcccggccaccaccccgtctgggaggtgtacccaacagctcattgagaacaggccaggatgacaatggcggctttgtggaatagaaaggcgggaaaggtggggaaaagattgagaaatcggatggttgccgtgtctgtgtagaaagaagtagacatgggagacttttcattttgttctgcactaagaaaaattcctctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaattaaaaaaaaaatgtaaaaaaaaaaaatgtaaaaaaaaaaaaaaaagaaattcatccatattattggatgtatcaatagtttgttcctttttattgcatagtagcattcccctgaatggatataccacagtctgtttattcatttaccagttgatggacatttgggttacttccagttttggatgattttgagtaaagttgcaatgaacattcacatacaagtccttgtgtggacctacgtcttcatttgagagatttttttccttttaaactttttattttattaggttggtgcaaaagaaactgtggtttttgccattactttcaatggcaaaaaccacaattacttttgcaccaacctaaatcttccctctctctggatttgcaattattctgtaaatctaaagttaactttagctaaatcaggttgacatcatataccccctaaagttaactttagatttacagaagagttgcaaatccagagaaccccccgtagtcttcatccaccttcccccaatgttaatatcgtactaattatgatacatttatcaaaactcaaaaattaacatgggcacagttgtattaactaaactcccgactttcttcagatttcaccagttttttccactaatgtcctttttctgttccaggatttaatcaggatataatgttgcacttaattattatatcataatagtcactttcaatctatgtcaatttctctgtctctccttgtttttttatgactttgacatttatgaagtgggctggtcaagtattttgtaggatgtccctcaatctggatttgtctgatgttttctgatcattagactgcagttggggtttggggaaagaataccccagaggtgaaatggccttctcatcacataatattagggggcacatgatatctacctgattgctcactggtgaagttaaccttgatcacttggttaaggcgttgtctaccagagttacccaccgtaagctgctaatttccctttccatactctgttccaggggtgtccaatcttttggctgccctgggacacattggaagaagaattgtcttgggcaacacataaaatacatcattaacactatgacagctgttgagctaaaaaaaaaaaaaaaaaaaaaaaaaaaaaaaaggaccgggtgcggtggctcacacctgtaatcccaacactttgggaggccgaggcgggtgggtcacgaggtcaggagatcgagaccatcctggctaacacagtgaaaccccatctctactaaaaatagaaaaaattagccgggcgtggtggtgggcgcctgtagtcccagctactcaggaggctgaggcaggagaatggtgtgaatccaggaggaggagtttgcagtaagccgagattgcaccactgcactccagcctgggtgacagagggaaactctgtctcaaaagaaaaaaaaaaaaaaaggtctgtgcataaatatcataatgttttaagaaagtttatgaatttgtgttgggccacattcaaagctgtcctgggccacgggttggacaagcttaccgtctattcattagaagtgagtcactcaggggagggagattaggccctgcctcctacagggaggggtttcaaagaatttgtggacatatgctaaaaccagcaccataattaatgtggtatttttttttttttgacggagtcttgctctgtagcccaggctggagtgcagtggcctgatctcggctcactgcaagctctgcctctcaggttcatgccattctcctgcctcagcctcctgagtagctgggactacaggtgcgcaccaccatgcccaactaatttttttgtatttttagtagagaaggggtttcaccatgttagccaggatggtcgcgatctcctgacctcgtgatccacccgccttggcctcccaaaatgctgggaatacaggtgtgagccaccgtgcccggccaattaatgtatttttattattttaaaagttattcttatttttagagatagagtctcactatgttgcccatgctggtcttgaactcctgggctcaagctgtctacccacctcggcctcctaagtgctgggattataggcgtgagccactttacctggcctgcttgtttttttgagacagagtctcgctctgtcgcccaggctggagttcagtggcacaatctcggctcactgcaagctccacctcctgggttcacgccattctcctgcctcagcctcccgagtagctgggactacaggcgcccgccactacatccggctaatttttttgtatttttttagtagagacggggtttcaccgacctcgtgatctgcacgcctcagcctcccaaagtgctgggattacaggtgtgagccaccgcccccggccctggtgtgctttttaatattttttggagatggggtcttgttatgtttcccaggctggccttgaactcctgagctcaagtgatgctcatgcctcagccttcagagtagcaggcattacaggtgcatgccacctcacctggctaataaatgtttttggagggatgtgttgagcctatgcaggtatcctgtttccccttaaagtttgcccatgaacttaacattcctcagtggaccctgcctgcagctattattactgtaatgttctcctggtgattttctattctcccatgccttctgcctttattacatggaattcttctgtaagggaaatttgtttcttctccaggtatttgtttatctatcctctcatttatttatatcagtgtggactcacaagtacttattttattctctgggtgagagatgtttttaagatgggaaaatggactactttaagttaacctaactgtgagccaggtagcaggaggtgtggggaggaggagcatagatgctgggggaggaatgggcggtggatggagcgaagttcctaggaaggtcagtgagaaggagatccggaggtgggggtcttggcaaaaacaagggacaccctgttcccacaaatgggtaagaggaaagtttgggagggtcgatttccatgtcaggaaggagaacttgaaggagttccaactaattagcttttgtcttctccgtcaagatgttttctgtgacgacaatgggaagttgacttttggaattttaattgtcttggccaaaattcctggcctctagagtaacgtttctcaacctcagccctgccgacatttggagcagataattcattgttgtgggagccgtcttgtgcattgcaggctgtgtcgcagcatccctggcctctaccctctagatgctttagtgccctctcctgtttccccagcagtgaccaccaaaatgtctccaggcagtgtcaaatgtgccctggggagcaaaatcgccccatgctgagaaccacagatctaaaattaacacacacaattctggcaatccgtaggattcttcttctctttatttttatttttttgtctccctctgttgccaaggctggagtgcagtggcatgatccatagctcattgcagccttgacctcccgggctcaaacaatcctcccacctcagcctcctgagaagctaggactgcaggtgcacaccaccatgcccggcggcttttttttttttcttgaagagggggactcactgtgttgctcaggctggtctcaaactcttgggctcaagcagtcctcctacctcagcctcccaaagtgttgggattataggcatgagccactgcatccagcccacgggattcttgaccattactttgaaagactaagatgatggcattcacctattaattttctgcagaaagagctaagctgctctagtgtgaacactcaacgttgacgctatggatgagggagggccctgctttcttgggaatagcggatggtcctttcagcacacagcacagatgaatgaagaggaaatgaagttctggttcgcagagggtctttggttctgaaaagcgttgccgtggttctagccttcctcgcggtggagggtgttttgctttctgcgcggtttctgtgtgggccgtgggaagcaacttgattgttatcacagttggggacacagcagctcttctcataggttaatttctgaaagcccatttgttctaaatccaacgtgacgcctaccgagctgggtacaacattggtttgtttcataaaacagcccggggtgtttgggactcttactcctttacaactctcatttgactgtccaaagatgcttgcactggggcctaattttctgtcaccttccctacgtttttaacaagacactgccatttcaaacatagcgaacacgacagattgaggaacaaggccaaggcagaggctgcgacgacctcgtacagccgctgatgccatctgttggtggctggcagaactgatgccctttgctgcgagggagctttgtttattgcacagaaagttgaaagttggcagcagagaaccttgttaccacctgggaggataggattggcaggattagggaggactggaaggggagggaatgcgtgtttgctttgtaggttgtgcatcagtaagcacaatcaggattcagtgccaggaatccatagttgaaacaattttaggaggatttttcaaggttctggctgggatgccatggggacctccaatccatttctcagtcgactgtcagttaaggcattgggctgtgggaagttaacagagcaacagagcggtctctaacgtaaaaaaaccccagtgtctcccatagagctagcatgcagtccttatttgtggaatttgatattgagggacagtattaactcctcactctaatcaaagaagctatgataatatgatgcaaaacaactattatattctatccccttccaaagtgctttcaaagactaaatttgtcttgataccaatccatttataccaacacatccccacatttctgatgatgaaacagattcctagagactaaatttctttcttttctttttttttttttttgagatggagtctcgctttgtcacccaggctggagtgcagtggcacgatcttgggtcactgcagcctctgtccccccaggttcaagtgattgccctgcctcagcctcctgaggagctgggattacaggcatgcaccaccatgcccggctaatttttgtatttttagtggagacggggtttccccatgttggccaggctggtcttgaactcctgacctcaggtaattcacccgccttggcctcccaaagtgctgggattaaggtgttacccaccacgcccggcctagagactaaatttcttaggtccatatgtctgcttgatagcaagagctggaattagttcagccagtgggttcttaactctggatgcatataagaatcacctgggaaacaaaaaaaaatcttagtggttggcttcactctcagatatacagatttattttttaatttttgtttatttttttgtagagatggggtctcactatgttgcccaggctggtcttgaattcctgggctcaagcaatactcccacctccacctcccaaagttctggcattacaggtgtgagccactgtgcctggccagatatatggattaacggggccgggccagggctgggtcctgggctgtgattctaacctgctgcctggggttgaagcgcttctcctccaggtgtggtccatgaaccagtcgcatcagcatcacctgcgagcttgttagaaatgcagagtctcaggccccaccccagaccctctgaatcagaacctgcattgcaacaaggttctcagatgattcctgtgcatggcgaagtttggaaactctgagtgttgcttttgagatcagacatacagtgctatccattggtgtctgtggaggatgtcttatttgtttatttatgagacaggtctctgtcaccagggctggagtgcaatggcatgatcgcagcacactgcagcctctaccttctgggctcaagggaccctcctgcctcagccccccaagtacctgagactacaggtgtgtgccaacacacccagctcttttttttttttttttttttttgagatggagtttcactcttattgcccaggctggagtgcaatggcacagtcttcactcactgcaacctctgcctcccgggttcaagcgattctcctgcctcagcctcccaagtagctgggattacaggcatatgccactacaccagctgattttgtatttttagtagagatggggtttcactatgttggttaaactggtctcgaactcctgacctcagctgatccacccatcttggcctcccaaaatgctgggattacagacgtgagccaccgtgtccagcctgcccagctcatttttatttatttatttattttttggtagagacagggtcttgctatgttgcccaggctggtcttgaactcctggccttaagtgatcctccacctcagccccccaaagtacttggattacagattacaggcataagccaccgcatcaggtctgtttaatttttaccattcagacagcactcaaggcctagtgtgagtggcctccatcgagggccctgggcttccctctaccctgagggttccatgtgcctcccaggttgaagccatgagagagtccagaactacccccaccccaaaaaaagtcttgctcatggccagctgagtgttccacagcccttgatttctgggtgtgtcataatgtagtcaccaagtcaggcctgtgggctgcctctgggtccttcctgttgagagtgatggcatgtcactgctggcttccccgaggatgagaggttcaacttgtttggttcggcccctaagattctcttacattacctctagctcagacactctgcttgtattggaaaactgggaggcagtgccttttcctctttcttcctttctgaaatagaaggtactcagtagatgttggatttggaatattggaatgaaatgaaggctgtgtgggcctctgggcagcctttggtgttagaaacaggcttcatccctgctggacttgagtttcagttgaggagctcctatctgggcagcactcttcaccagcaaaggctgtccgtggtcttttgaaaagagatcttttttagttcatttcttaaaatccagtgctatatgagagccagtctgatcttttctaaatctgtactttcattttgggtagcgcctaaaagagacacagcagtccctgttcaacctcttttcgggaaaccaagagccttggctgcttattcatcccttctctgccgttttcaacaacaaaccccctttgatgaaagaccattctgagacaggctagagctggttccccttttatttctcctcttttccaagctcccctctgccacctcctgtatctcttccaaccttcctcccccaaagaaaaacaacaacaaaccaaactttgaaaaaacaagggaggcttgtccccattggtgaaatcccttgaaaggatgtcactgagaaagggtctctgtggccctctttttccgcaagcgttgggaggtctctgaggatctgacctggggagactggagcgctaattatacgcacagaagccattcattagttgccactagcaagaagacttggccaatgctcactcctctgaattcagaggttttgaaagaaccccaaactgagcctgcgactttcttcaatctttttttttttttaatatatatatatttctttcttctccagcctctctgttctcctctgttgcccacagcaacctcagcagttggtaccagcacagagtggagagggcaggccaggttacctcggtgtcaagcaatcattactgagcaattcaccagagcctcacaaagaaacagatttctctgaaaatctcccgatccaaaccacccccaatatttaaccagcaactccccaaccctacctttcctgagaggtccgtgttttctagtacctgagcagacagttatgagccactgcctccctgcctttttgaggcctttctttaccaacaatgctttgttaactctttaacacactttcctgatgttcacactttctgcctaccacacacacgtccagtagagacagacaagggggagaattaaatgattagccagcagctgcccatgaggaacaggcagtcaggccataggtttttcccttttccgctttaccatgagacagtgctttgtcaaaaggaagtgccaaagttgtcatggaaataaatcattagctagattgagctatctttaatttgggcgggagtctgccattaatatgtctaaatctcagtttacaaatgagcacttgatgacttgattcctgacacttattcttgtgattcttttgaatctcaattagtaagactttctttctcatagaatgccatacggcttcttggaacaaaggacaaacgggtagaatgcttgaaacagaccaaatcaaagattatgatttttttttctgaagggaagaaaaaaataaaattggaaaaataaaaataaggcttatcatgatatcctgccgtctgatttctaaaagtacagttcctttaggttctaaggactggcatgttctttgtgatatttgtcaatgacatgtgaaatgtgctctgagtaaaggcattttcttctgcaatgttcatttctatttcaatggtctgcctcagtacttttctttaattaatactgtttatgctcactgatgaataattcagagttgtacaagcaacagatgtcagcggattcaaaatgactttccctgaattatttattatttccaaaaaagtaacaggtttgttgaacaagtaattggcaacacagatgtagatcaaggtttgtcagcaggcaacaagtttcactactgtttccccttttgtgcatgttgataaccaggatggcattgtctaggagcgggggtctgcctgataccactgcttagggagtcattgacccatcctgttgctgacttggagagctggaaccttagttggtttccaggttgtctaacgatgaaacatgaatggaaattcatccaaaaatgtaattaatgaatgtaggcttgtaaatatctcgcagacagaatgacttaatacaggtgcccagaaagagggaacatctttgtttgcagggatatgttaagaatagagacctagaagaaaaataatttgacagatatgtaaaggtttatgtataagaatgttctctgcagtgctgtttatgacagaatttttgcaaggagacaactcaacgtccaacaatgaaagactggttagataaattctggtagatccaagcagtgaaatattatatcaccactgtaatgatatatatgtatttttgatctggaaaaatgtcaacatattaaataaaagatgatattaagtgagagagtctataaaccgatatggcttatttctgtaggaaaatacatgtatgtatttttttttgtaggcatagggaaaagtctagaaggaactaccccaaaatattaatagtggttatttaggggtagtaggatccagcatgacttttcttctgtctcacatattttgccatcattttcactgtaagtatgcttatgttatgaatctcagttaatacgactttctttctcatagaatgccatacctcttcttggaacaaagcacacatgggtagaaggctaagctgctgtaacaagagatccaacaacattgtgacttaaagaaataaatctcaggctgggtactgtggctcatgcctgtaatcccagcaatttgggaggctgaggtgggcggagcacctgacatcaggagttcgagaccagcctggccagcatggcaaaaccccatctctacaaaaaatacaaaaattagctgggcgcagtggtgcacgcctgtaaccccagctacttaggaggctgaggcaggagaatcccttgaacccaggaggcggaggttgcagtgcgctgagatcgtgccactgcacctccagcctaggcgacagagcgagacctggcctgccttgttatcttctaaagagccaagtctgggtgctgtcgtgagaaggaaacatgggtatggaagaggcacaacttgccgtctcaaggccctggtccaaaagtggcccatatcactcctgctcccagcccttagcagggacataggcacatggccatactccactgccagctgcaaagcaggctgggaacaaaatccttacaggcatttatgtgaccagcaatagctctgtgctatggagaaaagagaaaaggaattttgctgggacagctttcggtctctgctaaatttattgattgattttcaaattttttttagatatgaggtcttgctttgttgcccaggtaggtcttgaactcctgggctcaagcgattcccccaccttggcctcccaaagtgggattacaggcatgagctaccatgcccagctgctactaaatttattacccgtaaaataaaaataaaaataaatttaaaaaggaagttgagttttgattcgatgtcttcagagggcatttccttttggaattaatcatacagaagatgtatactctgaagcaatttgaagatttaaaaaaaaaaaaaggaaaggtataaaatgtggacactgccttccagggatttacagtctgattgagaaaccggaccaataacaattcgaagtagtatatgcaaaaggccagagagtgttcagataagtgcagaggagcaaattggctagggtcatggaataaggcttagataaattgaaaggcttgcaattctgctttgttgagctaccaggattacttgtacttttggaagaaataaaactatttgtgttttgtgacattttagggtagcgtgacctccccttacaacacagaggaactgaatcatattttcctactgactgactaacagtaatttaagactctaattggtcttccgttagctgtcatttattgtaattctttgtgaaatgcacatgatctttaacataaaatatcttggaagagctacaacttaaaggaaacttgacttgataatgtaaaaattatcttttaaataattttttaaatatatggttttaaagctttttaatatggttatcttgagtagggtatttctaggcttatttggaaggcaaaccaaaaagcatagagagttttttttcctcccttggatagaaatttttctgtctttaatagattaatggtaatcatataacacattacctccttcacaataagatcaaattttgcaaatcttttgccttgaatcagattcttcaactctggagtttaggttagtagaacccaaaaatatgttgttttatgcacaaagcctcgcaaagtcaagtggtagattttgacctcttctttaacctaccctgaatgtagtcccttaaaacatgatggaatccacatttggtatttccctgctatttcatgagatgcaacaaaatgtttcaagggagacagtaggaaccatttggtgctttggtgatcttttcaggaaaatctggtttcggaagccccataaggcgagaattattgcaaataaggcccagatttgaaaattgctgttttgcaaattgtgcttattctaggaataatgatttctacagctgggaagaactttaaaaattgggtgaaccagttgcctgctttgacagatgaggtactgcaatgcagagaggtcaagctagttgctggggtcacctagctcatttgtgacaaaactaggaaccgtgggtctgactcagtcctctgccctgccgccctgtaccacagtaggcctctctatattatgccgcttggtagtcacccaccttgcttcctaccatcaaaaggaacttctggtagaaactcctttcacagcctcctgatctgcaggagtgatgaatttagcctgggatgaactgggagtggcagagccatctttaaaccccaggtcctttctggatgctttgtttgcagaagagctgcagagatcatgagggacatttcttgattcatattaatcagaaactcatttggggcagaatttgaacttgtagccaattttataaggaagtttcacagctaaaacctctctgtgttgtaaaaggaggtcatactaccctaaaatgtcacaaaacattttacttcttccaaaagtacaagtaatcctggtatccagataaagaagttttaatttgtttttattggtttaccttgcctcagagttctgagtgttggattttcactgtgacaacaaaaataaaatatttcctgcttattgtaaagcggtcaaagagctgaaaagcaataccatcttttagaatgcatttcttacccttctttgatcaacattaagatgcgttgccactctggggtatgattctggtttgatcgttgcagtgttttggaaaatgtttgatggcctataggtttattgatttcaaagactgtaaatccatctgcccatctatccatcattcaccctcctatctgagagcagtgtgggaagcttctactgaagtaccaataacttggattggtagccttcaagccctggggggacttggtaattccacacttaagtttttctacctgaaaaacatatagctcttaaatttcaaaatacagcttcgtttatgcctgaagaggagaagtttcataacgcagccagcactgttggttgtcatgcaataaccattctcccttcacccttgctaacgttttctttctttttttttttttttttgaggtggagttttgctcttgttgcccaggctggagtgccgtggcatgatcttggctcactgcaacctccacctcccaggttcaagcgattctcctgcctcagcctcccaagtagctggcattacaggcatgtaccaccatgcctggcttattttgtatttttagtagagacggggtttctccatgttggttaggctggtctcgaactccccacctcagatgatccgcctgccttggcctcccaaattactgggattacaggggcgagcctccacacccagcctgttaataacgcttttcttcattccattttcttgcctgtgagatgtgcataagacccagctcagagagttgttgttggttcctactctctaactttgcctaattagatttctgttaagcttgagatcatttatagccaactttttccatattaaaatcataagcctctgttgaaaggttttgttagtccaaattggaaccgtcttgacttcgcatcaaatcattcatctctagctcagtcgccacataagcttgtataattctctcagggcttctgtcattgttaatttacatctgaccttgttctgaaaactatttaaggcagtggagccctaacttagaacttgctggcttttaactttgccagttggtctggacctgtgaaaatatttatccaatcccctaagaaatcagagtaaagattttcatgaaaacttctagccgggcacagtggctcatgcctgtaatctcagcactttgggaggccgaggtgggcggatcacttgaggtcaggagttcgagaccagcctggtcaacatggtgaaacctagactctactaaaaatacaaaaattagccaggtgtgatggtgtgtgcctgtaatatcagctactttggaggctgaggtaggggaatcgcttgaacccgggacatggaggttgcagtgagctgagatcatgctactgcactccagcctgggtgacagagcgagactccatctcaaaaaaaaaacttccaaaaccatttttacatattggtttattttgactcttgatcgttgtgccaagaaagttgattatgactagcgtttccatcttacaaatagggaaatggaaaactcagaaaggtcaagtgacttccctgaggttggtaaggagtggtagagccaggatttgaacctgggcagtgtagccacagggtcctcactcttaaccacttggctaaactgtcttcatatacgtatgtatgcatgtgtttggttcccggtggtgatgccatggggagcatttaccatgagcgcagtgggaaaagcatggagcatgctggaaggcatggatgcttacattttcattccggatttgtggattttgcactagggtatctgctaggccatgaactagaattgtgtactgagagtcatcattagttgggtgatttttttttttttttttttttgacataggcactgctctgtcgcccaggcagtggtgtgatcttggctcacagcaacctccgcctcctggattcaggcgattctcctacctcagcctcctgagtagctgggattacaggcactcaccaccacccctggctaatttttgtatttttagtagagatggggtctcaccatgttggccaagctggtctctatccacccacctcagcctcccaaagtgctgggattactggtctcagccgccgcacccggccaattagttagatctttctacggaagaacaactgacttgccaatttagtctgtaagatcaggagttgagggacattggaactacagaaaaacattattaaagatgactcttaagatgtcaagaggaaagaaaaatgacttcttcggtcaaaaaaagagcaaaagctatcacgctgtatgagccacaagctgaaggctgtcttctgggggcggcttaaatgcattagattagtctgcaatgtggattaagggaccgtgggatttaataacttgcgtattaaagaatggctctgcaaatgttaccctaacataaaaatgtaagcattctaattgaatttagaagcaatagtattaaaatttcttctggtgatgctccttagacgcattaaataaaatatcaaaagtcacaattgattaaactgaaactttagcatgagagttattaagcattaaattctgctgctagaggtttttattttattttttcctgacatgtactcagaaaattctccctttacataatttatggtcattctgctgtttaaatgtgccaaaaaatgttctcggagttttggcagtgttttgaaatagagtatattatcttagtcttgggctatatatatataatgaacactcaatatatattgatggtggtgttttcatgagttgaagtctcgctgtgggcaaaggaaggaataggctattctattacatctgatgcttagcctgcctttaatgagtaatgtagaaaaatagacctcttcttcctcctatggcaagtctgtatgtagtcttgctaagcttgtgtctgcccacaaatcctaatgagaagatggcattgatcggagatggtagcaaagtacagctgggatactgctgtccatatgttccatggttccagaattccaaggactacagacagccttgtagaaatcacaaagcatgagtgatagttataagcaaagaggtcttctcctttttatccaaggacaagcaaatggcagggaggcagaaaggtgacgttttgaatctgtagacacataacgaggaatgtggttgactgaaaagtgtctatgcatttagggcggtgagagcagacagttaggggcatccaggaaacctcctcctctcttgcctttcagggtgtctcctggagtcccgagtgtggcatgttctgcattcaagagtattgtggaggccagacgtggtgaaaccccatctctactaaaaatacaaaaattagctgagcgtggtggtgcatgtctgtaatcccagctacttgggaggctgaggcaggagaatcacttgaacctgggaggcggaggttgcagtgagctgagactgcaccaccgcactccagcctgggcaacagagcaagactctgtctaaaaaaaaaagagtactgtggaattcattcttatgtagctgtatgaaaaagaaaaccaacatcataaaatatgagtactagtttgaagtccattacagacaaatcacaccatttttatgttagaccaccccaaccacttcccttttttgtttttgtttattttgacaggttctcgctttgtcacccaggcggaagtgtagtggcacgatctcagctcactgcaacctctgcctcccaggttcaagcaattctcttgccacagcctcctgattagctgggattataggcactcaccaccacaccagggtaatttttgtatttttagtagaggtggggcttcaccatgttgaccaggctgatctcgaactcctggcctcaaacgatccacccacctcggcctcccaaagtgctgggattacaggcatgagccaccacacccagcctcctttttgttattgctcagatttacagaaatttattttgcaaaattttacctcgaagaaacaagcgagtgtttctctgtatccatctgagctcaggaggatgcccaagtgaaaggtgtttaatccaacttctgttgaatgattgacttctcagggactgttaatttgtaaactctaagaaagggggaaagtttaagtttttccggctgccaaactttgggcttcatggtgaatcatcaggacaggctttctaggccaagtgtaagcgctgttctgggggccactggtctgagggtgggggagcaggatgtgtttatttagatgcacggccagagttcacacacttggggtttgggatcagcctccagggcctaagtaatttctcccaggagatgtcttcgcatcttataccctgtataggatcatcacggactgctgattgaagaaaagggttaggaccactgatcagagagaagctacgattttttcttttctgtctgtcacagaggtgtcagtaaaggagaaagcttacttgaaaggtttggattaccgagcagctcaaaagagctgttgctggcgggattttctccttgctgaagtttttctttgcccctagaatactaagcaaaaaggaaagaaaagatgaaaggtaagtccctctttaaaaatacattgagtcaacccatcgcagaaaaatacagatttctcaactgacaaataagcggcatcactgcatttgggaatcagaaaaagtccccacgataaagttatttgggaattaatcaacacttggctcatcctaggcgtggagcgcttcggaattcacctcgtgttgcttggaagctggcagcccggttgttatataatgtgaacccagaggcctgccagacggccctccctgtgccccgggggagttacaaggctctgtaactcttggagtcagtcaatcctgcagaacagagtccaggggcctggtgtgtgctgtgttttacagatgacacattaacctttgaaattctgtcctcagtcaccttcatcaatgcctgagcgaacgaaggaagggccacatgtgggctctttttttgttcacttttccaaatggagataagacatgtaacaaaatttaccatcttaaccatttttaaatgtacagttctgtgttattaagtgcattcctatcgttgtaccagtatcaccactatccatctgcagaactctgcatcttgaaactctgtgcctgttcagtggtaactgcctgttcccctcctggcagcccctggcagccgcccgtctctgaatttcagagccactttctgtccctgagtttgactactctaggtactcacataagtagaatcacactgtatttgtccttgtgtatctatctggcttatttctcttagcgtaatatcctcaaggtgcatctgtgtggtagtgtgtatcagaatttccttccttttcaggagtgaataatattccattgtacggatataccatgttttgttcatccatccatccctccgtggatggacatgggttgtttccaccttttgactattgtgaatagtactgccatgaacacagttatacaaatacctgtttgagcctctgctttctgttctttggggtactttcccagaattggaattgatgggtcatacggtaacagactccttttttaaaaaagaaaagtatcttgagaacttgggagagccaccctaggagtacttactgggctggattgtttgctccgtctccttttgcctccaggtacagcccataggcctctgtcctcacagatgtggtatggaagagtggccctgttccagggtgagatcaccagtgtagaccttctcagtttgaccctacatctgatgaacccccaaaagcacagagaggatctcagaatgaactaaagatcatgggctataaatgactccttccttctccttttcttccttggatgacaaagattgtggtcactatacagttatggtggcctcaagtctggtaaatcaatgatgtttcatgttagctgctcacgggattcaccttgtggcttattgatgtccagaccccgcctctgatcccgcctctagagattctgatttcattggtttgagtcctggcctcagcatggggacttttgaaagcttccaggcgagtctaatatgcagccagggttctgtagcacccaagtgaattactgaacccgaaccttttctcaatccctttcatgctgtctgttgtctttttggttatttcttttttctttttcttttttaatttgagatggagtctcgctctgtcccaggctagagtgcagtgataggatcttggctcactgaaacctcttcctgccaggttctagcaatcctcccaccttagcctcccgagtagctggtattacaggtgtgcaccaccacgcccggctaatttttgtatttttagtagagacggggtttcaccatgttggccaggctggtctcgaacctcaagtgatccatccccctcggtctcccaaaatgctgggattgcaggcgtgagccaccacacccagccaggttatttctttggagcatatcttcagatttgtacatctcagcccaaggtttaaagatttggaaacaggcttttctgtgtgtgtgtgtgtgtgtgtgtgtgtgtgtgtgtgtgtgtgtgtgtgttttaattaacgaggatgcattatgtaactttggagctaagaatgaggaatgaggatgcattatgtaactttggagctaagaatgaggagacctgggtcatacttgtgtgtgtgtgtgtgttattatctaaccagggataatgaattatttaacttggcaggatctcagtttgttgttgttggttttttgttttttgttttgtttttttttaaatcttggctttaaaattagggcatagattggcaaaccagataaaagaatgaaattaatgatttttttaaaaatgtcccctctagctctgacataccacgactctgaatgaacaggtggaattgatggggagtgaggaggcttggagagagagcccccgggtgtgaacccatcctgttctaacaataatgagctttgggatgaagagcctccccgcaggcaggggactgctgggagtttctggtgtcccagaagaagccttcagggcagctctgatcagtaaataaaaggatacgaaataaaaatctcaaaggatccgtaatgaataagaaagcaggaatgtcgtccccagggagaaatgagttgggggctttgtcagtcacgagagaacatagcacaggactctgggtccaatggagctgaacgtcagcgcctctgtccccacgaaaatagtaacttccctgacaccatccacctgatgccaagagctgtttatatcaacatttcttctcgggattctttcaaactttatacttacttctctcctcctctgattctattcaaggaatgtgaatggctgaggttttgttttgttttgttttcctctctagattagcacagctaatacagtggaattgtgatgccagggtctattagtgtagagaaacaaagaatgcagtcctgccctgggcaccagggtttacttccatggtgacttcttcttaagcccatgggaaagtgagagggaggtgacctcctcacagtcggctcagcctctggagcccggagccggagccagccccatagtgtgtggccatcaggatgacgcagagaggcgtgtgaacgcagccggccactgcagctggtgcacttgactctgggcagcgcgttcccaggaacccgcaggacactgaggaccgtgcgtgatgtaacccagatctgccagatgtgggagccagcatgagtcacaatgccgggccgttcattaagaaatgctttctgggtcatctgggtgcagggcactgctgcttccctgctgtccagggttggaggcatcaagtctgcccaccaggaatccccaagttcatgaacatctgtctaaaattatagcctggttttctgagctgatgtggcacagagcacacgcacgctgatggtctctggcttgtaatttgttaaaggatctcaccactttggttagtggtgggaaatcagataataaaaacatacgcccaggtgggagggtcacttgaggccaggagtctaagaccagctccagcaacatagtaagactccgtttctgcaaaaagataaaattacctgggcatggcatgcctgtagtcctagctacttgggaggttgaggtgggaagatggcctgagcccaggaattcaaggctgcggtgagctgtgatcacactactgcctccagcctgggtgacagagtgagaccctgcctcaaaacaacgacaaaaccaaaaaccaaaaaccccaaaagtgtaagttgctgtgaggtttctgcacattttagtaagatcagaaatgaggtggggtgttgggagaagccaaaaactgtgctggcattgtgccagtgaaatgccagcaatcacgagcggtcttcctttttttttcttttttttttaaaaaaaaaaagatgtgcaagatgccttatggtgaataacaagtatatttctgagaagttgtaaactaactccttaaaaaaaatccttatggatataagacatacagtcagaaaagttcatgcatgcatccctgggtaaaatctgacacccaagtaactgtagcaagttgaagggtggccccttaaatatcccccagagcctgtgaatatgatcttatttggaaggagacctttgcagacataattcaatcaaggatcttgagatgagatcattctggattacctaagtggaccctaaatccaatgacaagtgtccttacaagagacagaagaggagaagacacagacacacaggaaggaaacatatgaagcaggaggcagggattagagcactggagctgcaaggaacagctgagccaccagaaaccaaaagaggcaacaaacgggtggtcccctcgtgcctttggagggagcctggccctgctgacaccttgatttcttttttctggcatccagaactgtgagccagtaaactctgttgtgtgaagccaccaagtttgtggtgatttgataaggaaactaataaaatcatcacacctagatgaagaagcagaatgtttccaaaaccctggaaactccccctcaagcctagtttctgttttcacaccgccccaggacagctactgtcctgatttctaacgccggggataggttttatgccatttgaacataataaatggaatcttacggtgcatcgtcttctgtgtcagatttcttcccctccacgctttgtgagatgtgtttatcctgttgtgtgtttgatgattctcactgctgcttagttgtagtgttccacggtgtgaatataccacgatttatttactcttctcctgttgggggcatttgagtttggggctacgacaaagagtgctgttacaaattctgtttcgttcctttctgatgaatatacgtgggcgcttttgtgagttacattctcaggagctgaattgttgggtcataggctatctgtgtgttcagcttcagtagctattgccagttttcctattaattttttaaacaccccatccgatttggaatctctgtgtgaaatggagaatccaatggtagattcagtaaccactctttaatgtggctattttataaggtccaaatgttgaacgcagggttttcttggagcaagttccttccttagatcacaatcaggaatattccatgtctcagaagagcccattacagggctgggcaggcgtgaaagcacaccagtttctgggaatcggagaggctgggctactgactgtgaattttaaatattcttaacccatcgctggagtgatgaatagcacagctgtcgtatcctccatctcgagactcagaaataaatttgcagtcttttaggagctccagttttaattctcctttccagcttttaagctctatgctccataacttaggatgcaaccaaatgatatgcagcatttctaaatattctgctttgataagtgagtggaaatagtgctggtacagcggataagactagattaaaacccagggtccccagctgtctaaagaagatgtgctgctttggatttgcctgatgccccaagatctttctggaaatgggggagggtggctttgaccttggaaatactggaaaggggaggaaagtgtggtgatggtacctcagaggactgttttccctccagacgtgagatgggtgggatggtagcaacctagctatcattatgactgataagccttctttttcccaatacaaaagcaatttgtcttccttgcagaatgagaaaaattcaggtccaccagaaaataaccacaaacctgacacccacagttaaccactgttgaatatatttgcatatatacatttcatatacaaacctttcttcccatacaaacattttatttctgcagtcaacgagtatgtattgaatgcctgccatgtgccagtccccagggatagagcatgaataaaacagacaaaccatcccctgtccttgcggagctgaccttccagtgggagcttattatacgatacatatggtactaaaatgagatcttatggtacatgtttcttatcggttgcttttttccactaacaatatgtgtaacctctttctttctttctttctttctttttctttctttctttctttctttctttctttttgagacgtagtcttgctctgttactcagactggagtgcagtggcgcaatcttgactcactgcaacctctacctcctgggttcaagcaattctctgcctcagcctcccgagtacctgtgattccaggcacctgctaccacgtctggctaatttttgtttttttaatagagacagggtttcaccatcttggccaggctggtcttgaactcctgtcctcgtgatccacccgcctcggcctcccaaagtgctgggattacaggcatgagccaccgtgcccagccctgtaacctctttcaatggcaacagatattcagatataacttttatagatttatcaatgaactaaatccccagtggttttgcttgctggtggtggccagcacattcggagatggtgactgctctgatagtacaggtcccagagtgccaaaaggaccagggtgctgccattgacttgcagaagcaagaagtaggctgggtgcagtggctcacgcctgtaatccccaggaatttgggaggctgaggtgagcagattgcttgagtccaggagttcaagaccagcctgggcaacatggcaaaacaccatctctacaaaaaatacaaaaattagtcggacgtggtgctgcatgcccgtggtcccagctactcagggaagctgaggcaggaggatcatttgagcccagggggtcaaggctgcagtgagctgtgactgtgtcactgaacttcagcctgggtgacggggagacctcgtctcaaactggcaaaaaaaaacagcaacaacaacaagtagaagtaaactttggcaatattgagccatggagttgtttttttttttgttttttttttttttttttttttgagacggagtctggctctgtcgcccaggctggagtgcagtggcgctatctcggctcactgcaagctccgcctcccgggttcacgccattctcctgcctcagcctcccgagtagctggggctacaggcgctcgccaccaggcccggctaatttttttgtattttttagtagagatggggtttcatcatgttagccaggatggtctagatctccttacctcatgatccgtccgcctcagcctcccaaagcgttgggattacaggcatgagccaccgcgcccggcctctgagccacggagatcttttttaaaaaaacttttattttaggttcaggggtacatgtgcaggtttgttatacaggtaaactcatgtcatgggggtttgttgtacagattatttcatcacccacttactaggcctagtagccagtagatacgttttctgatcctctccttcctcccactctccaccatcaagcaggcccccaatgtctgttgttcccctctttgtgtccgtgtgttctcatcatttagctcccacttgtaagtgagaatatgcagtatttggttttctgttcctgcattagtttgctaaggataatggcctacagctccatccatgttcttgcaaaggacgtgatctcaattcctttttgtggctgtatagtattccatgagctgtggagatgttgaggttctttgttaccaagcattaactggccagtcctgaccaatacagctatggtcataacatataaagcaccttaagggaagaggacgtttagctaactctatgatgttgtcacgctgacatgaatagagagggttttgttttttaagccaaagacgttaatccattaattggcatttaaaaggtagaaatgccattggatgtaggaaagttcatctgtatttgaccattttttatttatttttgactctttatgcttataattttggaaattccaaaatacaaaggagtttttggtgatgctgggaattgaattctgaggagaaaatgttgttggaattatagagagtgcttttggaatactaccaagcatagtacttgaccttagaggaaaaaatgctggggagcacaacttaagatgggaaaaaagaacaagtttttaaaatatcatccctctaacgaatgcttccgtgatggaaacactcccctttccctgttatcgttcttcatttcctcctactctttactttaactacaagttcttgtatgcggttattcccccatgtaaattacatgaaaaatagttttagtcttctaactacattatccaatatgcagctttttaactagttccaagaggcatttgaggcccatgcgtggctccctttgagttgagtcatctaaaggttattgctcgtcttagtaaaacctgtgctgtgttgagtgcaccggtgacgacaatgaccccagtcttgagtcccagcctccccgtgtttactatggaattatcacagttccactcttgagaaatatggaaagcactcactgttcactctggtttaaccctcctgagagcaggaggtatgattaatcctggaaataatgggttcactctgtgggagcgcttcagtgattttcaaccccagactcatacatggtgattgaaaagaactagtgtgatcacagaaggttagcagaattatttctacttagaatagaaatgagaaggttgagggtcgtaatttcaaaaatggaaaagtaggttttaaaaattcaaatgtaatacataaatattccaaatatatttagagcgagaagccttctttccgccctcccaattctgcccttctctgcagagcttaccatagtttaaaaaaaaaaaaaagtgctgttttatccttttggaccctatactgtgcatttataaatgtgagaaaaccaggcatggtggtgtgtgcctgtggtcccagctactcgggaggctgaggtgggaggatcgtttgaacccaggagttcaaggctgtttttagctatgactgttccggtgaatagccactgcactccagcctgggcaacacagtaagagcctgacgttaaaaataattaacatgagaataaaacttatctatgttttttgtttttacataagtagtcacacaagacatattattataaacctccttttttttttttttgagacggcgtctcattcagtcgcccaggctggagtgcaatggcgcaatcgtggctcactgcaacctccgattccccagcctcagcctcccgagtagctgggattaaagcttaatttataatggaagtcaccctgtgcaggcacacttataggtactgtattctttggagcagtagctcattaaattgataaataaaactttattttcttaatgatggacatttaggaagtcgtctttttttttttctattacaagtaagataaacctgtgtctccataaacttgttcgtgtcttttttttttttttttttttgagatggggtctctgttgcccaagctggagtgcagtgatgtcatcatggctcactgcagtctcgacctcctaggctcaagcgaacctcccatctcatcctcctgaataggtgggaccacacgtgtgagccaccacgcccagctaatttttgtattttttgtagagacatggtttcgctatgttttccaggctggtcttgaactcctgcactcaagcagtctgcctgcctcggcctcccaaagtgctgggattacaagcgtgagccaccatgcccagcctgtttaggtttttgtgcacttgtgtatttttctttcttttttttttttttcaagatggagtctcactctgttgcccaggctggagtgcagtggttcaatcttggctcactacaaccttcattttccaggctcaagtgatcctcccacctcagcctcctgagtagctgggaccacaggcatgcgccaccaggcctggctaattttttgtatttttggaagagacggggtttggagttttcaccatgttagccaggctggtcttgaactcctgagctcaagtgatccacccacctgagcctcccaaagtgctaggattacaggcgtgggccactgcgcttggcctctatcttatgtttattatccatgtgtatatcatcttcagaaactggctccctcatatctcttgcttattatttccttttgggttatctttttaattaatttaggaactctttatatattagcaatattaatctttaatattggccggacatggtggctcaggcctgtaatcccagcactttgggaggccgaggcgggcagatcatctgcagtcaggagttcaagaaaatactccattgtatgtatataccatattttctgtatgcattcacctattcatgaacatttaggttgtctccaacccttggctcttgtgaataatgctgcaatgaacttgggtgtgcaaatatctctttgaggtcttgttttcaactcttttgggtatataaccagtagtggtattgctggatcatgtggtagttccagttttaattttgttaggaagcttcgtattgttctccatagcggctgtgctacttgacaagctcatcaatggtgtgcaatgattccagtttctctacgtccttgccaacacttgttattttctgttattttgatagtggccttcctaacgagtgtgaggtgatatcccattgtggttttgatttgcatttccttgatgattagtggtgttgaatatcatttcatatactcatgtactcactagtcacttgtgtatcttctttgtttttttttttgtttgtttttgtttttttttttgagatggagtcttgctctgctgcccaggctggaatgcagtagcacgatcacggcttattgcaacctctgcctcccaggttcaagcgattctgttgcctcagcctccagagtagctgggcttacaggcacccgccaccatgcctggctaatttttttgtatttttaacagagacagagtttcaccatgttagccaggctggtctcgaactcctgacctccagtgatctgcctgcctcagcctctcaaagtgctgggattatgggcatgagccacgtgcccagcccgtatatcttctttgaagaaatatctattcaagtcctttgcccgtttttatttattttgagaagcagagtctcgctctgttgcccatgttggagtgcaatggtgtgatctcagctcactgcaaccttcacctcctgggctcaagtgatcctgccaccttagcctcctgagtaggtgggactacaggcaagtgccaccatgcccgtgtaatttttttatttttttgtagagacaggggtctcaccatgttgcccaggctggtcttgaactcctgggctcaagcaatccaccctccttggcctcccaaagtgctgggattataggcatgagccactgtgcccggccagcctgaggaatcttaggaaacaaagtaaagaccttggcctgaatagctggtctgctacctccctacttcctactgcccagaggcaattacagtcatgcaccatataacaatatttcagtcaaggaaagatcgcatatatgatggtggtcttatgagattataatgctgtatttttactgtaccttttctgtgtttagatacacatacacttatagttatgttacagttgcctacagcattcagtacaatagcatgcttttcaggtttgtagtgtagaagcaacataggtgcgtagtaggctacaccatctaggtttgtgtaagaacattctatgatgtttgcacgacagaatcatttcacacatttctcagaacatatccccatcgttaagcaatgcatgactgtacatctgttcttagttcttccattggtgagcctccatcgttttaaataaatgcatatactgtatgctctttctcaatgtatcagttttagaattatccatcttctccccttgaatatataagtaggctgcagaggatttagtttgcttgtactgcttctcagcttatcttcttctgatggttaatcattttaaacaattagttttagttctcttagctacctctagttattgcatttctgtctctgtttcttgttttgtcagttttcggcaatattctctttcctttctaaataaaacattaaggccttaccctttcatttttctcccttttacgttgtccaaattctggataaatgaatatggtatatccataaatgggctattatctggtaataaaaaggtatgaaattctgatatatgctacaacatggatggaccatgaaaacatcatacccaagtgaaagaagccagacacaacgagccacatattacatgattccatttatatgaaatatccaggataggcacagaaagttgatgagtcattgccaggggcctcgaggaataccattaactgcttatgggcaccaggtttctttttaggataaggaaaatgttctgaaattagatagtggtaatggttgtaacaacctcatgaatatactaaaacccactgtattctacactttaaaaggacaaattttatggtttgaattatatctcaatttttttttaagatttttttttttttttaattgagagaaggtctcactctgtcagccaggctggagtacagtggcacaatcacggatcatggcccatggctcacggctcactgaagcctcaaactcctgggctcaagtgatcctcccacctcagcctcccgagtagctgggaccgcaggcgcgcacaccaccacacttgacaaaattttttttttttttaagtggagacaggggtctctctatattgcccaggctggtctcaaactcctgggctcaagcagtcctcccatctctgcctcccaaagtgctggaattaaagacgtgagccactgcacctggccaaaagaaagattcttaactgttacattccatttattccattttctaatcttaatatctttagcttatttctgaatgttggacaccagtaaacaacatttattgtcgctgtgtaaacattgcccactgcaggtctaggtgctaatgtcatattattactttctctataggaccaatgccacaatccacaggccacctagaggatagcatttcatgcatcgcagttcgagtgaattctcttttcttatttaccatcgactattccttttgtgttatcctggaattccttcttgctttctttttcatatagaccccaaaaatacactttcatcacctagtgctgtagatgcactccgggttatatgacatctccttacttctcagccatcgtcatctggctccaatctaccagcctgtcctgtctccttcgctgccttgtctcaacattttattaaatttatttcttcctcttttttgttccattcccttattttgcaaccttttggatgttaccctttggaagttaccctcttgtaacttccacattaaaagtttgggggctggctgggtgcggtggctcacgcctgtaattccagcaatttgagaggccaaggcgggcagattgcctgaggtcaggagttcaagaccagcctggccaacatggtgaaatcctgtctctactaaaaatacaaaaatgagccgggatgtggtggtgggagcctgtaatcccagctacttgggaggctgaagcaggagaattgctcgaacgtgggaggtggaggttgcagtgagccaagactgtgccattgcactccagcctgggcaacaagagcaaaactctgtctcaaaaaaaaaaaaaagtttgagggaagtaagctttctaaattctagcatgcctgaaattctcgtcattttggtcttctgctttgtcggtgcctcagtttcctcatctgtacaagggaggtgatcataattacactgacctattagtgagtattaaattaacgaggattaaatgagctattgtgcagaaagtcttaagacaacttttggtacatcataaatttgtttgggaggcgttaaccattcacgttgtagttgaagcacattagatgtgtcttcgtgttctgcactctgaagacatcgtgtggactaacagcaaagtaataagatgaaagtttgtgtggtgaagtaaacgatcctattaccatagttgaaccatagcttatgaattattccttagtgctcttctctgctttcataaaatcataatccgtgttttaagatttacttgtactttttttttttttaggccactaggctgttctcagctctctagatactcagcaaagcacagtcatttccaggaaatggattgaaattgtaatgcagatttggtttagatgtatgcaagtggctttggagagtaacaatgcaatctacttaaggagattggaaaatttaggatattgaagatttaaggaacgggttggcccaagtaacaaaaccattgccctagtcaatctatagtggccacttggaacactggatggaagaggattgggggcagcattggggctgttgtcagtaagtgacatctgccatggggtagaagggtttgtcattcctggccttaccttgatcctttctcatgaaggaagtacaagatattattgagaggatctgacagggagaattggtctagttttgggtacttgaggaagtttgtgtgaagtaagattattgcattgcattgcattgtattgtattgtattgtattgtattgtattgtattgtattgtattgtattgtattgtattttagagatggagtcttgctctgtcacccaggctggagtatagtggcgcgatcttggctcctctgcaacctccgcctcctgggttcaagcgattctcctgcctcagcctcccgagtagctgggattacaggtgcatgccaccactacgcccagctaatttttgtatttcagtagagacggggtctcaccatgttggccaggctggtctcgaactcatgacctcaggtgatccacccaccttggcctcccaaagtgctgggattacaggggtgagccacctcgcccaggctctatttctttttaaaggaagtggagatgtcaaagaaaacatatttgttgtgtagagttttagaaaataaagttaccaaaaactcaaaataaaagaagtagatttattgagaagtaagtctacaggttgtactgggggttggggtgggagtgctccaaggattatggctcctgaatttcccattgtaggactgggtaaaaggtggtaggaactagaaaaaaaatgatatcacttaatgaccactttgtctcataaatgagatgactaaagcttaaaaggtaaggtgactcactctgggtcacagagctggcaatagaatccagtggcctggttccatcttgacggggagggagggggcattgtttgttgcccaggtaccatgtcacactctgagtaacttctctgcagcccttgtattttctctgtaggggacaagggaaaacttaccctttgtttcttgaaacaaaggcaaattaataggggaaaagccatacaaatgattagcgtgcatgggaggaaaatcacaaagcgattacccagtatcctaatggggtacagatgtttatatatcttattttttagaggaaagggagaggggaagtgtggatgattttagggaggtagtagatgatttttagggaatttgatgggcctgaagaacatacaatggattgggacaaagtctgttgggcagacaatggtttgtgacaaaattctgtccaggtgtgttgactgaattcaggctttctttacgcgatatgagttcagttaatgaaaacacaggggagtgaccagaagtgattgtttccttctttggcatttctgtcttcctctttttttgttctattcccttattttgcaaccttttggatgttaccctttggaagttaccctcttgtaacttccacattaaaagtttgggggctggcagatagaaggaactccagagaacaacttgattctgtgctttgggagagacagagaaatgaggggtgtggaggaaggtcagagagaccctgaggcttctgcctcacttcagcatgtcaaagcaccctattttggggtattgctttctgagccccaacatctccagccttccaggagtctgtggcatatccttccccaaaggagtaggatcacttgaccactctactgaacctaagttgtttttcattttcttttgcatctgccttgaagtctagagcaaatgaaaatacaacaacactgtgtaaacaaaacacacaaaaaagctgctctgatctttctgttttctcaggtgcaaaacaggtcttatctaaagcaactgaaaaggcatggaggtagcaattgctttgctattccaggaactagtagccaccacatgtgtaaaactattgaagaacaagttttcaaccttctgctgtgaaaaggtacacaggaatggctaaagtctctctagaacccgtaccttcctggagcaaagggaagacctgggaaacgttttgacaaagcaatgcttacgatatttttcaatatcaggggaattcagtcagtcttctttcttttttgtttggccagtttagctaaagttttgtcaattttgttgatcctttcaaagagccaacttttggttttgttcagtttctctgttatttttctattctctagttcattagttaattaatttaggttaattaattaatttaggtttgacttgctttttttgttccgctgtcttcaggtggaaggttaagttattgatgcgaaatctttttcttttttaatatatgcatttacagctatacacttctctttaggtagcacagccttagctgtgtcacttaagttttggtatgttgtatcttcatttctaatcatctcaaattattttctactctcccttgtgatttcctcttaaacccattggttatttgtgtgtgttgtttaatttccacatatttataaattgcctgaatttctaattctattccattgttgtcggagaacttgccttgtatgagttcagtccttttaaatttactgaagtttgttttatggtctagtatacggtctatcctggagacttccacatgcactgaaaagagagtgtattctgctgtgttgagtgatgtgttctgttgattttttaggtctaattggcttataatgttcaagtcttctgtttccatgttgatcttctgcctagttgttctatccattattcaaagtggggcactaaggtctccaactatagttgtgatagtttagtttaattgtgcatttctcttaccaattctgtcaatttttgctttatgtatttcagggctctgttaggcacatacctgtttatcattgtatcttcctaaggaattaccctttgatcattataaaatgtcccactttatctctggtaccattttttgttttaaagtctactttgtctgatattagtacagccactccagctttcttatggtttactgtttacatgacatatttttcctgtcctttaattccagtctatttgtaactttggatctaaactatctcctatagacagcatatagttgggtcttttttttagtagagatggggttttaccgtgttagccaggctggtctcgatctcctgacctcatgatccacccaccttggcctcccaaagtgttgggattacagacgtgagccaccgcgcccagcccaagttgtttttgagaacacctgtagggagtgtttcctagcctttgcatgtgttacgcttgcacacagatgacagattggccatatgtaaaattttggagtaactctcttttccctcgcaattcttttgatggtgtttcttcgtatttttggcctccccctctacctggattgcactggagcctgctatcaagccttgtgagacgtgccttttgtccagttgttgatcctccattgttactccaccctttcctgccctcctgggcactgggcaagccttagtcccactcagtccctttcccttttctctccctcctccctcaaatcatcatgcttgggctggcgagatattacctagggctactgaaaagtcactttactatgggcaagcatataaatcatatttgtaactggcttttacctactgaaaaaatttcaatatattttaatgtgaagagacactgctgaagaaaaggaaatgaagaaaaggtgaagtaagattttacacacattttcagattagatgatactaatgttcctgaatatacaatctccctttagatttaagatattgtttttagtttagtttagttttgctttgtttttcaaatcactgccctaatcatgaatttcagtctttgggagaaggaatggccctcatggggtggggaaagcagtagttttttcaggtgtaactgacttttaattgacacaaatttacaaatttatattacacaagctgaaaacaatttttttctgtttaaataatgtatttgctatctgaatgatcatgtaaattcaggacaggatttgcctatttttattttattatactaataataaaaccccaattcaaatgacttttcagtacttactatacgcgatgtactgcgggtaaacaagaaaatttcttaaattctcattcaataattggaaatcgattaaattacacctatactaggagagattttatgcaaccattgataatttttgaagaatatttaaagatatgggaaatgctgataatatattcagttagaaaaagcacatttcaaagtaatatattcagtataattttcatcgtatctaaaaaaaattcaaaaccagaattcaaaactaggaagaatatgtacccaaatgttaacattgtctatttctggatttgtttttttaaaaaagtttccttattctaatttttctagaatgaaaacaaatcgatgctataatcagttgatagtatggtggtggtggtggtttcttgtaatgacatagacccactcgttaggattgccaggaatggacacattcatcccacttcaacgagtcactgtgacctcttagaaaaggtgggatagaggcagggccttgatggaagagtaaaatattcatagatgaatacatagaaagaatgactgagtcactgagcagagaagccacgctgagaatgtgtgcagaacagagcaggcaagcagtcagtaaccggggtggatgatgctgagactagggtgggtatgagtcaaggccgagtccgagagctgcaaaaacttgggagaggagttcagatgttgctgtgtacgttggagaaaatcattaaaggtttcagatttgcagtgagatttagatctgtctgggcacgcatggtggctcacacctgtaatcctagcactttgggaggtagaggtaggcggatcactttaggtcacaagttcgagaccagcctggtcaacatggtgaaaccccatctccactaaaaatacaaaaattagccaggcgtggtggcatgcatttataatcccagctactcgggaggctgaggcaggggaatcacctgaaccaggagatggaggtttcagtgcgctgggatcgtactgctgcactccagcctgggtgacagggcaagacttggtctcaaaaaaaaaaaaaaaaaaaaaaaaagagtagaactgtgttattgaaggctgggagaccaggggcaggagagcatttaggaggtgtgctcctggtttgttctttctcttactggtccttctcagtgtccttcctgggtttttcttccttcccctaccccttcactgttgttgctcctgggtactgtttagtgcccatcgctccatggcttcactgaccatctgagtgctgtggtcttctgaccctgagctgcaacctggatcgctttcctgggctgcaaaccaggatgtgtttaaacatgtccaggccacctagttgtccccggaatccttaacctcacaggaagttattttttccaaagcctgctcctcctccttctatatttaattcccaagagtaatctccgttctcccatcctaccagttacgcagccagaaaattgaatgtcctcatgaaatttgcaaagctgttaccagaaaggggccctgatccagaccccaagagagggttcttggatctcaaggaagaaagaattcaggtcgagtctacaaagtgaaagcaagtttattaagaaagtagagaataaaagaatggctactccataaacagagcagcctggagggctgctggttgcccagttttacggttatttcttaatgatgtgctaaacaaggggtgggttattcatgcctactcttttacaccatatagggtaacttcctgatgttgccatggcatttgtaaactgtcgtggctctggtgggagtgtagcagtgaggacgaccagaggtcactcctgtcgccatcttggttttggtgggttttacctgggttctctactgcaaacctgtttttttatgacctgtatctcacgccgaccttctgtctcatcctgtgacttagaatgccttaactctctgggaatgcagcccagtagatctcagcctcattttactcagcccctattcaagatggagttgctctggttcaaatgcctctgacaaaaagacaaatacttagctgaggtaccttcaagaggcaaattcatagagtcagaaggtagaatggtggttgccaggggccagaggggagggaaacggggagctgttgtttaaagagtgtagagtttcagtttgtggtgacggaacgttctagtgatggctgcacaacattgtggttgtacttaatgcaccaaactgaatacttaaaaatggttaaaatggtaaatttcatgttatgtatgttttaccataatttaaaaataaaaacaggccgggcttggtggctcacgtctgtaatcccagcactttgggaggccaaggcgggtggatcacatgaggtcaggagttcgagaccagcctgaccaacatggtgaaactccgtctctactaaaaatacaaaaattaaccgggtgtggtggtgcacgcctgtaatcccagctactcaggagcctgaggcaggagaatcacttgaactggggagatggaggttgcagtgagccaagatcacgccactgcactccagcctgggagacagagtgagattccgtctcaaaataaataaataaataaaataggccgggcgtggtggctcatgcctgtgagtactttggaaggccaaggcgggcggatcacgaggtcaggagttcaagactagcctggccaatatggtgaaaccccatctctactaaaaataaaataaaataaatagctgggtgtggtggtgcacgcctgtaatcccagccacttgggaggctgaggcagaagaatcgcttgaacccaggaggtggaggttgcagtgagccgagattgcaccaccacactccagcctgggcaacagagtgaggctccatctctaaattaaattaaattgaattaaaaataaataaataaataaataaataaataaataaataaataaaacgtgttcaaccgggtttgacttagtttttcctcagacttatttgactgtggtcccctctgatcagaagaaaaaaatgctttaaagtgtgacatatatcacatcctttccatgttagaaaaacacactttggggaacattcccacatacttgggggtggggaggaagaatcaacttcctgagtgtattaactcagagaaatattattagaaatggtggctgagtttttatttgggggaattttgggtcaattcgtcttctctgagcaagcctaatgacgtcatttctatgaatggatttggagctttgaaacactttagcctgaaaagaaacgtctagaacacagccggctcaaatcggagaccaattgacttcaatgagtcttaagtacacaatctgctgcctttatgcagaggtttgggaattattttggaaagataggaggttcctcctattgggaggcttccagtcagtatcttagatctctaagtgctgaaacacttgaagctgagcacagggcattgggtgagtaaagggaaagtgaaatagacagccttgggcaacacatttgtccttccttcctctgccccaggtcctagactaatctgggtctaaagcaggagttgcttaagagactcagcccacacagtggcttcactgtctttcactctgtctgcagatctgggaatcagagccccctctggcttctttggccaccatgtggcccactttcaggacaccccgaacctgccttgtcactaatccctgcgtccagagctgatgtgcgcacccctttccttctctccaagacccccattcctaacagcattcctgcccctctttagacccctgggctggcttttgctttggttgcctttctcagttccttcttcagaagcctctctaatgcctcaagcccttcactactcaagagggcgcccttgaccgcctcggcctcccaaagtgctgggattacaggcgtgagccaccgcgcctggccattttttttctttttgagacagagtcttgctctatcactcaggctggagtgcagtggtgcgatctcagctcactgcaatctctgcctccggggttcaagtgattctcctgcctcagcctccctagtagctgggattacaggcactcaccaccatgcccagctaatttttgtatttttagtagagcaacctctgttaccgcccttgtggataaagactcccgggtcccatcctcattctctcttccccactactcagggattggaatgctgccttgaaatttcagcattaggcccccttttccatgccagcgtattgtttcttctacttgaaaagtacatgttccttataaaaacttcaaacctcatagaagtatctttcccacaattatctcttaggtaattgccattaacaatggacaatatatttttttagatttttctttttctattcatatatgagtacacgcgtttgcattttagcaaaactcctgctatacctactgttttgcagcttactttccttcccccacataattatgcaactggggcatctttccatcttggcaaggagagctctatttcatgatttaatagctgtattgtatttcattgtttggatgtaccatgatttatctaacggatcccattgatggacaactggagtttttccagctttgttattgcatataatgtagacatgaataatcttaagcacataaatctttgcacaattgcaaaagggtttctctaggataaattcctaggtagagtagctaggtaaaatggtaagaacatctttaattttaatagacgttgccaaatcatcttcctaaaggacttaaccattttgttcttccaccacattgtggaccgaggtcggttcccttcacctcgtcaatactggctagctgttctttttctttttgagacagagtcttactctgtcactcaggctggagtgcagtggtgcgatctcagctcactgcaacctctgcctcctgagttcaagtgattctcctgcttcagcctcccgagtagctgggattacaggcactcaccaccacgcccagctaatttttgtatttttagtagagatgaggtttcagcatgttggccaagctggtctcgaactcctgacctcagatgatccacccacctcagcctcccaaagtgctgggattacaggcatgagccattgcacccagcctggctagctttttaaatttttaatactttgatagatgggaaatgttttagtttacattttaaacatttgttttgcaggtcttcccattgcaaaactctagggtgatactgattacttgaggttgaacattttcatatgttaattggccatttgtatttcttctctaaatttctgcctggtctcctgctgatgatgcacttgaatttcgcattgctgttctctgcctgccaggatggaaaatctattccttctcttcagacctgcccttccctgccccaaggctagagagtgatgtccagctcagaacttggggtgagaaagatccacgttgactcccaactactccactagtatgtgaccttagacctctctaggtcccagtttcttcaaatgaaaaccggatttgggggccgggtgcagtggctcacgcctgtaatcccagcactttgggaggcccaggcgggcggatcatttgaggtcaggagtttgaggccagcctgatcaaacagggtgaaaccccgtctctactaaaatacaaaaaaattagtcaggcgtgatgatgggtgcctgtaatcccagctactcgggaggctgaggcaggagaatcgcttgaacctgggaggcggaggttgcagtgagccgagatcgtgccactgcactctagcctgggcgacagagtgagactgtgtctcaaaaaaaaaaaaaaaaaaaaaaacagctggacttggagccggaagatcagaactgttaggctctatcctgtgttctcaggtaccctgaacttgcttttagagtatttatattttattatcattttttgtttatatatcgatttctcttattagactctaaactccttgatcacaaggaccgtattatccatcctcacatctttggtgtccaggatataatggtgttcactcaatattttccaatacatttaatttttgagaattttattgactttttttttttaccataagaaaagctgcgttctaggtgccatgagaatacaaaaaatatttaaaatgtagttcatatcttagttggggagataagctcgatcactcattcattgagttattcaatatatccggagttatctaagctccagccagcttggcagtatctgaaaagataaagtcaagttgtgtaccccacacttaagtggcttccagtctagtaggggagacagatataaaataaacacaacataatgggatgcacacaatcatatagaaatcatataataattattaaaaatatatagtaaggctgggcacagtggctcacgcctataatcccagcacttagggaggccgaggcagatggatcatctgaggtcaggagttggagaccagcctggtcaacaaggcgaaaccccatctctactaaaaatacaaaaattagccaggcatggcggcgggcgactgtaatcccagctactcgggaggctaaggcaagagagtagcttgaacccaggaggcaaaagcgagctgagatcccaccactgcactccagcctgggtgacacaggaagagtctgtatctatatctatatctatatctatatctatatctatatctatatctatatctacatctacatatgtgtgtatatatatgtatatacatatatgtatatatacatatactatatttttactatatgtgtgtgtgtgtatatatatatatatatatatatagtaaaaaataaataagtaaaaacagtcacagaagaattatcacaaagcagtgcatgacttggtagttgccaagtgggagtaaagctcactttgcacttaatgtgttctaggagtcactaagggcataggaagaagagacggctggaagggggcttcccagtgcaatcaatgagtggtcacgtgtgtgtcagtacagcaaagaccaagaaggcttgcaggaaaaacttgttgaattctctttgacctaatgtcacccacattcatttaactgtgaagctcttttcctcccactgcttagcatcctatggatctatcattctttaaaatcgttatgggaaattctggtgtagataccatttgtaattagatagtgtctcttaacctctttggaacataggccttttgagaaatggatggtcggaggggattgtgcacaattctgtgctcttcgaagcccaccgaagacccgcctccatgatcagggaaagcaaagaagggaaaaaaaaaaatcccaggtagtgggagtatctgtgtaggtcgagatagaagagggtagaagatacggagcttgttcactgccgggcagttgactgtgagggagagactgtgtggggagggggacaccaactgtggaagacctcaaatacttggactacttggtgtagaattcacgggttttttgtttttgtttttgtttttgttttgagatggagtctcgctctgtcttcgaggctggattgcagtggtgtgatcttggttcactgcaaactctgcctcccgggttcaagcagttcttccagcctcaacctccgagtagctgagattaccggcacccaccagcacgcccagctaatttttgtattttttagtagagatggggttttaccatgttggccaggctggtcttgaacccctgacctcaggtgatccgcctgcctcggcctcccaaagtgctgttacaggcgtgagccatcatgcctggccaaattcacggttcttgataactgatcaactgtgaaagtcaagggaagccgggtgcggtggcttatgcctgtaatcccagcactttgggaggctgaggcagacagatcacccgaggtccggagttcaagaccagcctggccaacatggtgaaaccccatctctactaaaaaatacaaaaaatagcccagcatggtggcatgtgcctgtagtcccagctactctggtggctgaggcacgagaatcgcttgaacctgggaagtggaggttgcagtgagtcgagattgtgccactgcactccagcctgggtgacagagcaagactcagctcaattaaaaaagaaaaaaagtcaagggagatgccccagtcaaagataactctgccaacagacactggagtcatagttaggattatttacagaaagaaaatcatggagctaaaacttcaacacttcaaaacctatgttatgatcatgttgaaatgccccacgttgcctttattaactagtgctcagtctcccaactgaaaactcattgtaagaattgaatttgccatctaaccgggcatcctaccttgaatggttaaaaatcagatttgtctgatttctaattttagaaggaaccaggctgaccttcattccgctgttgctaactggagccctgttacctgggtgactagatttacaatatgtcagtatgcaaataccatctgcccaagaggagaaaggaagcaaggccttcttcctctaggggttgtcagcagttctggaaacgtcttcctctgggaatggggaggaaggcatgcccaatagaaggagaacagggaagaagatgtgctgattcgtttctggagcctctcccttgttctcttcccacagaggagtttgtggtctgccttgtggacagtcctgaatgtatatcattaggatatagacaggaacttagattgtacatttctcctggtagagtgagcaaaagaagtagtatatatcacttcagtggatcacaaaacacttagattcagataactggaatggcttaatgaagactatgaatatgcgattcctgcctccccaaatgccattaggaatctaatttccaactgataagagagtgtgggctgggcgtggagccggctgcctttactggacgaactctgaaggaggatgaagagaagtggatattccggctcattttcctacacttgaggttgactgggcaagcggaagggatttttctcccacagaatatctatattcagcacttgtcctgagtattgtttcaggcgagggcttggaatcacatttggaaacattcaaatccaaaggcagggacgttctgctttccttttcatgaaataactgtcacatcagctgtcagctgcaggaatctctcccacccacgcattttgtgagtccaaattaggtggactaattaattgtaatttttactttcaagtctcaaggactttgatgggcggctgtgcttcctttcatggttgtgtgcaggaatttatgtaggaggaagaccttctaggagcaggattgaggatctcaggctcttggcttctgattttgtacccctgggttacttcccctgtgacctctcctctctttgctctccttggctctgctctctcatctctttggtaaaaaagaactcttcttaccatcaacctgaaactgtcagcaacatgcaggagtgagcagtcactaaacttaactgtgacattttcatccacctagcctttttatctgcatgtcaaacaagtggccaaggagattaatgcctgagtgcatgctgcagctagacgggctgggttcaagtcccagctctactacttactacctgggtgacattgggcaagtgacttaacctctgtgtatcagtttcctcatttgtcaaatagggatttaaaacgctaccttcctcattgtgttgttgtgaggattaaatagtataaatattttagaactgtgctgaacctatagaagccagggctctgtatggcagcttttaagatgactctgtcatgcatctgcaggggtcctagtgaggtagtgaagttttgctgtgagcaagtagatttccagagcttgcttgcaggcagtgacctccccgttctttcttgccatgctagtttcttttttgagatggagtctagctcagtcgcccaggctggagtgcagtagcgccatcttcactgcaatcacctcccaggttcaagcgattctcccgcctcagcctcccaagtagctgagattacaggcgcccgccaccacgcctggttaatttttgtatttttagtagagatggggtttttgccatgttggccaggctggtctcaaactcctgacctcaggtgatctgtctgccaaagcgctgagattacaggcataagccaccacgcccagccatgctagtttctattcatgcacagatcaagcctaattttccatgtggcaccccccaccaacaacagtaccccatgctgctctgttcctaccccttgcaccctttctgtcaatgctgtgtaattagcacatttggacacgatgtcttagcttctcactctgattgtaatgtgaagttcagctcttcattgtccttgaggcataatgaaaagatgccatgtggctggagagctgcctgcgatcgttgttcaatggatgatgtggccaagtacataaaacagtgacttggacaaccacacttgtcctttagcttactcttgaagtcacttattgctttcttattgcttatggctttcttgttgctttcttattgcttatggctttcttgttgctgtacataacttaaaactatcaaaagaaaatatgagatgttgcagctgctatggaggaaagtctgacagttcctcaaatggtcaaacatgttgttaccatgtgacccagtaattccatatccaagggaaatgaaaacatacgtcctcaaaagactcacccacaaatactcatagcagcattattcataatagccacaaggtggaaaccacccaaatgtccatcaactgatgaagggataaacaaaatgtggtatatccatacaatggaatattattcagtaataaaaaggaagtactgatgcatgctaaacatgaatgaatcttaaaaacatgttaaatgaaaggagtcagtgacaaaaggccatgtattgtatgattccattgatatgaatgttcagaatggccacatccatagaaacagaaggtaacttagtggttgctgggactgggaggagaagagaatcagggatgactattagtgggtatggagtttcttttggagatgatgaaaatgtggaattggatagcggtgatgatttcacaaccttgcaaatatactaaaagccaccgaattgcatattttttttaaaaaagtatgggaaacatctatatgctcaactacagagcttaaagtcatctttaagattactttttccagcgtagctgtcacctaaaatagaataaaaagtgacttgatctgcaaggaaaacatgaaaaatgcaaatggtcaagaatggctttttcaccccaaattgttgaatataaattatatacatgcaattcgtaagtaaacgctgtaggactcggctgccttctatgttgtgattctgtaatttgctacattcctggatgggccatcaaaataatactgaaaacagcttctataacaaatagaagtgctgtttcaggtcatgcctaccaccactcctgggttccctaaggtactaattcatagctacctctttgtggtgcccttacaaagagtgatttaactgtttgtaaaggtgtctggacctttttgacattaaagagatttactgaattaaacttatgtttgcaaacagaatatttccaggggatgccttccagccccctaagaattaaccatcttagtttatcagtgtttaatcaggaccctactgattgactcttctggtttaaataaataatggggttgaaatctctaccagggctgtttcagtacttatttggaagaaggatgtgaaatacccaagctccacctaaaataggctttgcaagaataagtgatccaagagagaacctacagttgactttaaaacatcctgtaatcatgtcacacctgttaggatggtggttatcaaaaaaacaaacaaacaaacaaaaaaaggaaaatgatgggccagccatggtggctcacacctgtaatcccaatactttgggaggctgaggcaggaggatcagttgagactagcctgggcaacattgcaagacccatctctacaattttttaaattacccaggcatagtgccgtgtgcctgtagtcccggctactccagatgctgaagtgggaggatcacttgagcccaggagtttgaggctgcagtgagctatttcacaccactgcactgtagcctgggtgacagagcaagaccctttccctaaaagtatttttaaatgtaaaacaagtgttggtggagatgtggagaaatcagagccctcctgcattgctggtagggatgtaaaactgtggaaaacagtttggtggttactcaaaaagttcaacatagaattaccaaatgattgagcaattccacttctaggtctgtactcaaagtaattaaaagcagagactcagattcttgtatactcatgttcacagcagcattctgtttttttttttttttttttttttgagatgatgtcttgctctgtttcccaggctggagtgcagtggcacgatctcagctcgctgcaacttccgcctcctgggttcaagcaattctcctccttcagcctcccaagtagctgggactacaggcgtgcaccaccacacctggctaatttttgtatttttagtagagatggggtttcaccatgttggccaggctgttctcgaactcctgacctcaagtaatcctcttgccttggcctcccaaagtgctgggattacagatgtgagacaccatgcccaggcagaagatagattttttttaaatgtagcaatttctggaaatataccaaacttactgttttccctgtcttcactgacgacctcaggagagcaggagttgacacccatttgctttcctcaatctgctatctgcttctttttaccaaggaggaaacactcttaggccaactatggcctaagaatgaatggtgcctccctgcaaccagccatacaccctctctggctacaagtgccatccatgcctctggaacctggagcttctcctaagtagggtgagcaaagatgctggaactttccaagtctcaatctacatatacaatccacatatataaccctctcccagccttgctaggtagttaccagaaccccaaaaccacttgccaagccagtcagcatttaggtaagcaaaggagtccagtgaccctcaaatatcactgagatcttgtttgtctaggcatgaagtgccttgaataactctttcaagacattaagaactcccgctgttcaattgtacctgaagcagcaagtgcttctctttgcatttcctttaccctctgttctcagaaggtctcaaagatgctgaaactaattgctgtcattcctgaaagatttctgcttttaagtggtactgcggcttcccttgatgctaccagccgttttcattaaggatttcatgaagggttgatgggtgcattaggcttcacaaacaacggttcttttcatcctggaaaggccttgctaccttggtagtggatggacctctctgctgcgaacatctctgtttatggggctaaggttacagagatgacaaagaggtcacaagcggatggcgcaggatatgtgtcctgggaaagctctatcttgattttccctctttttggtcttgtgattgactgtgggtttatgttctgtagtaaacacaagagccttgattgcttactaaaggtcagacttgtcagcaaacctctccattaacttgagttgcgatcggtttcacatttcctggcaaatcgtttgagagctctgatgaatgcatcagtttccttcagtcttctgtcttcaaggcagaaacgctcaagaaatccccctctttgccagacaccaagtgtatcttgtttgcagctctgcctctagcatctacagggcttggcatacacgtgaaatgcatgttgagtgatgaacgggagcgcacaggactcttaagaaccgagaccgtccccacagccaacgtatgaagaaatcccatgttctgcttctagagccaactgcccttgtggtttcgagttgagttctggcagttcctgtctttgctctcttaatcattcttcatgggctcccactaatggctaatttgctcagcttgtcatttataaatacaaggacatgacacccactgccttagccagtgcttataaagtaacctgtaagtgctgcatgttatcatctcggcttttcaatttatgagtcaagtgaattctcggggctagaacatcacccctaaaagcgagtcagtgttggaagaagcagcaaaaatatacatgcactcttacttgcatagactatgaagactattgttactctcctgtactcagtcaagtagattatgctcctccatggtcaagtacccttgaggcgatttgcacagttttgcagcaacagcaggatagaggttgtgctggtaccagcaggaagcatagcctgagcccttcccttggatttcagttgctctatttctattcagttcagtccagaacttaggacaggttaagcatcagcgtccaatacagtttatattagtttgtcacaaaagggggattttttgaattaaatgttgataacccagcttcttaaatctttttatcagttttttcattcccataccctggcataatgacacaggtattacgtaaacaagacacctccgagggctgcttataaaaactcaagagaaaagataaatatgtgatgatgcactgatatcctgaaatatgagctgcaggtttgtattttctttgtgggatcggatattggttttcatggtttattgaccaggctgagagacatctgacaaaacacccaagaactttacaccttttttttttgttattattttttaaccttcctgtctacatggagaaatctacacattgaatcacagggcctggaagactggggcttagccagtcatgttcttagcttgggcagaacccaaatcagatccagctgttggaggtaaaaatacacgctgctttcccaaggaaaaagcaattggaattggtctcactgtagagttactctcgggcagaacttcgggataaggagcaactggagacggtcgactgtgaatgtgatgttcatgtgacattcatgttcattgaggaatgtgttctcattgagaccggatcagaactcatttgggttcagttaatgactctttcctttctgccgggtctttgtctgcaacattgggcacgcagtcagtacctcgttgtgtgggagcatcaccgacaggaatcctccagaatggtcatatattaaagacctctcgggctgggcatggtgattcatgcctgtaatcccagtactttggaaggccgaggcaggtgcatcacctgaggtcaggagttcaagaccagcctggccaacatggtgaaaccctgtctctactaaaaatacaaaaattagccgggcgtggtggcacacgcttgtaattccagctactcaggaggttgaagcagaggaattgcttgaacccaggaggtggagattgcagtgcgccgagatcacaccactgcattccagcctgggagagagagtgaaactccatcccccaccaccaaaaaaaaaagacatctaggcttagggcacggcaaacaaagaactcccctggcatggcaggaatcagggaatctcatgtaacattcattgtttctccggggagtcttttcatatttctcccgtcttctaggctcaatacctttcaggaagcttctaaaccaaaggttcatcaaatagaaataattttaaaaattatttcataataaactttaataattttttcataatcataaagtaattgttagatggtttccttgaggcatgagccatactcactgaaaaatgacaagttctgagcctttttaattgtgatcaaatatacatatcataaaatttaccattttaatcttttttttttttttggaaaatgaggtctcacttgcttgcccaggctggagcacagtggtatgatcatagctcactgcattgcaccctggacctcctgggctcaagcgatcatcccgcctcagcctcccgagtagctgggactacaggcgtgtgccaccatgcccagctgagtttttatttttttgttttttgtagagacaccatctccctatgttgtccagggtggtcaccaactcttgggctcaagctgtcctcccacctcagcctcccaaagcactgggattacaggcatagactaccatgcctggcccactgtaaccaattttaagtgtatatttcagtgacattcagtacattcacattgttgcaaaaccatcatcaccatctacctccagaagcttttttaccatcctaaactgaaacgctgtaccctaaacactccattacccactctttccagtccctggcagctaccattcgactttctgtctctacgaacttgacacttctagctgcctcgtctaagtggaaattctcaagctttttataatacttatgggaagtagtcaatctgactaccgtctaatgaaatttttacataaggaaaagatagttttgagcagatggtcagatttcctttggttttggcattgtacaagtatatggcagatgcctcattctcttatactttctggaacccgcagcataacagggatatgaatgaaacagatctgcaagtcacagtcagacatgtggccaactagaaggagcagtggtgagggcagttggtgtacaggtttattatacaatttatgaagcattttaatttttaagtttttttttttttctcacttgattctcaccatgtcttgcgaggtattctattagttccattttaatgataataaactgtggctcagagaagtaaatcgtctaaggttacaaagctagtcaatggtagaatcaggacgctggcttcacattttcatttttaaaaccccagtgctttccatcacagcccactgtgaacaattatcacgtctctggaggcccaggtaatagccagtcctcaggaagggagggcctctccaaatgcaaccctaattactagtgctccacctcaccagctcagaaatacatggaaaccgtttttttttttttttttttttttaattgagacagagtctctgtcaccaggctggagcacagtggtgcaatctctgctcactgcaacctccgcctcccgggttcaagtgattctcctgcctcagcctcctgagtacctgggattacaggtgcctgccaccacgcccggctaatttttgtatttttagtagagatggggtttcaccatcttggccaggctagtcttgaactcctgacctcgtgatccaccctcctcggcctcccaaagtgctgggattgcaggcgtgagccactgcgcccagcctaaattttctaatagccacattttaaaaagtgtgtagaaagaaacacataggctggctcatggtagcttacacctataatcccaaaactttgtgaggctgtggcgggaggatggcttgaggctaggaatttgaggccagcctgggcaacatagcaagataccatctctacagaaaaaatacaaaacttagctggacgtggtggtgcctgcctgtagtcccagtgactcaagaggctgaggtggaaggatcgcttgagcactgggggtcaaggctgcaatgagctacggtcatacctctgcactccagcctggatgacagagcgagaccctgtctctaaaaaaataagaaagaaaaggaaaaaaaaaggcaagtgaagttaattttaaaaatatattttagttaacccagtatacaaaaatatcatttcaatcaacataaaaattattaatgaactattttgcttttttttgtagtaagtcttccaaatctagtgtgcattttagacttaaacagcactcccaagtcagacgctaaattttcattggcagtacttgatctttatttagatttcataaaattcccagttgaaaaagtagattcacatacccaaagtgtttcaaacatatatgaaggttttcttttttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcatgagccaccgcgcccggccgaaggttttctaataactgaatcaagcaccagtcttaaatttaaatgaattaaaatgaaagaaaatttaaaattcaatccctctattccatgggccacacttcaaaggctcagtggccacacatagcaaatagctttggtcctgggcagaacagatctagatgaacagctgagggtggcccagactggacccagccgtggaatagaacaacggtctgcaaacttatttctataaagggccagataataaatattttcagccttgggggttacacagtctctcaaagtattcaactctgccattgtaaatgaaagcagccatagaatgaatgagcatcgctgtgttccaataaaactttatttacaaagcaggcatcagcctgcatgctttgccaaccattagactagaacatttgtcctagggccttagctgtgctgtgggattaccagaaaaagagacagctctcacctctagctttctgagatgaggttgtcaaaatctggactcactggatctcctttcctgtgtgtaattagaattttgacaccacttggcatgaagcaacggtgggccagagttctgcgtcatttatccttcaggtgctctctgcagtggatggtttgtgcctcctgaagcaattgcttccctgtgctttgaggtccagcagaggtaacagcggagaaagctggaagaaaggcttcaacaaaagcattaatggtgatgtgaagaatgcaggaaactcccaagaaagccaaatgatatcactctctgcttttccaacatagccagtgtgaggcaggaatcacacacgtttcacagctgggtaaatatgtgatttcacgtgaaatcagagggacaggtgtttctctgtgcttgttaggtgatatggcgtccgcccattttgatggtaaaggccaaagtaaatataaattctgtttcctgacctggggccttgaggtccccaggcggggattaccaccacccaatttgggaatctacgttgcaaagccatggttcccgctgttcacattgtgacgtttggaaatggtattgggactaatggagggaaagaaagaggacaggaagggagggcatagagattggttggtaggaagatgacccccactaggtgctttagggtagggggttatggaggctggctttgcagaaactctgggacgcagcagttggggaagggtgaagtgaaaatcagtgatagcttagagctctgctgaccctagaactttggatccagtatttcttcaggcatggatgatgttgaaggtattgttggcactcatttgataatcccttactgtactcagaagttttggcttggggttgcctttttaattcaaggttcaagattaaatgacttggctgggtgtggtggctcatgcctataatcccagcactttgggaggctgaggcgggaggatcacctgaggtcaggagttcgagatcagcctggccaacctggtgaaaccccgtttctactaaaaaaataacaaaacttagccaggcatggtggtgtgtgcctgtaatcccagctacttgggaggctgaggcaggagaattccttgaacctggggggcagaggttgcagtgagccaagattgcaccattgcactccacctgggcgacagagagcgagactccatctcaaaaaaaaaaaaaaagttaaatgactggatggtgccccatgtaagagtttgcaaaagttcaaactagtgaaactgctgagcttcttcagtacattatgcaactctgccttgcctccaattttgcagctctatcaagtgtacagcgtggtgtgtggggaaagatctgcatcccatgatgtttttgactatggaggtaattatttggagtagctgttctgatgataactcacggaggttcagtctgcagcatggaactgtctctagtcatgattgcctgtaatgatgattacccaaactctggaattataacaatagattttacaaagttagagcataattgctccaccattccttacatgtgcacagattaaacaactttgatctttcaatcagatttttgttactcatcttctgcaatagcaaaggtcagaggcagtagctttctgccacctccctcccctctttttaaatcatcacgaggcctagatttttaaagcatttaacttggtaaagaaataagggctgaagttgtgtggactagaatgagtacaggcctgtggggggtcagaatcccaattctgacatctagaaactctgtaacatacagtcttcaacctgtctgcaactcagcttcctcgtctgtcaatactcacttgtctgaatcattgagagattagaatgaacataggcggccgggtgtaatggctcatgcctgtaatcccagcactttgggaggccgaggcggatggatcatgaggtcaggagttcgagaccagcctggccaacatggcgaaaccccgtctctactaaaaatacaaaaattagctgggtgtggtggtgggcgcctgtaacctcagctactgaggaggctgagcagagaatttcttaaacccaggaggtggaggttgcagtgagctgatatctcgccactgcactccagcctgggagacagagcgagactccatctcaaaaacaaaaaaaaggaatataggctgggtgcagtggctcacgcctgtaatcccagcactttaggaggccaaagtgggagaattgcttaaggccaggagttggagactaacataatgagaccatgtctgtacaaaagtaaaaaaataaaaattaactgggtgtggtggcacacttctgtagtcccagctactcaaggggctgaggcaggaggattgcttgagcccaggaagtcgaggctgaggtgagccatgatcatgccactgaactctagcctgggtgacagagtaagaccctgctgcttttaattttttaaattatttattttatttacttagtttgtttttgtttttgtttttttgagacaaaggctccctctgtagcccaggctggagtgcagtggcgtgatgtcggctcactgcaacctccacttcctgggttcaagtgattctcctgtctctgcctcccgattagctgggattacaggcgtgcaccaccacatccggctaatttttgtatttttagtagagacggggttttgccatgttggccaggctggtcttgaacccctgacctcaggtgatccgcctgcctcggcctcccaaagtgctggaattacaggcatgagccgctgcgcccagccagaccctgtctcttttaaaagaaaggcaaaagaaatataaagcacttaatcagtgccttgcactaatgggcaatcaataaagtgatgctgtatcatcatcatcaattctacgatcaattctcaggctttggaggctttagaatctttctatgtctttggatgttgtggcctttattcaacatacaagtttgtttggagctggtggtcagggatatggtattttcactaagttagggatggagctttgtaagaaatcagtataaaggaggaaaaaagaaacaagcgtcctaaagacagaacatttacagctgagcaagtgctgatggctgccttcaccacgttctgctgcagcggttctcagcatttatgtgcatttctgaaagattcccactcttttctccccagagtctgaatggagaaggtctggaacaacctgagattcagcatttttaggagtgtctctggagattttgaaacacgtggttcaaggactctctgtctcttctccctcccccaaacgagaaactgctgcttgtgtctgagagtcaatacgagatttaaaaacagcaacaaaaccactgctcctggaatggcccagttcccatggccacgaccagcaaagtgggcctgatttccttaggaggggaagaagtgacggctgcagagcccttgaccatctcggtgtctgggctcgagtgtcccgccacccccagcgtctgcaggtcacccccacactgacgccgtctcagtgagctaatgccagtgtctgccccgcgccggctcattcagcagccactggaatgatcaatgaggccggccgcccagccctccaccggctgttggtgaatcagctgcctcggccattcccatctccactgagcaggaagcactcgagctgagcccagccagggctgactggcgtctggctaatggcttttctgtgtcatgcactgaccttgatcccatatgtttttcatacgtgagtgggttggagtgcctgaagatggtccagtggtggaaatagctcttctgccaagccccttaccgaggtcctgggcagtactttggtttagaggtgtctgcttctgaagcaggatcggtgcttttgtttaaattgaggtgaaattcacataacataaaatcaaccaggttaaagggaacaatcagtggcatctagtgcattctcaacgttgtgcaaaaccacctctatccaaaaacacttccatcgctccagaaggaacccctgcacctgttgcatgagttgactagggctgctgtaacaaagtgccacaaactgggtggcttcaacaacagaaatttggggccaggagcaagtggctcatgcctgtaatcccagcactttgggaggctgaggtgggtggatcatttgaggtcaggagttcaagaccagcctggccaacatggtgaaaccccgtctctactaaaaatataaaaattagtcgggtcgtagcggcgtgcgcctgtaatcccagctgcttgggaggctgaggcaggagaatcacttgagcctggtaggcggaggttgtggtgagccaagatcgcaccactgcactccagtctgggcgacagaatgataccctgtctcaaaacaaacaaacaaacagaaatttactgtctcacaattctggaggctagaagtttgaaatcaaagtgtcagcaggcttggttccttctggaggctgtggggtgagggaaggatccggttcggacctcaacccttggcttttttttttttttttttttttttgagatggggtctcgctctgtcatccagactagagagcagtggtgtgatctctgctcactgcaagctccgcctcctgggttcacgccattctcctgcctcagacttccaagtagctggaccacaggcacccgccaccacacctggctaatttttttgtattttcagtagaggtggggattcaccgtgatcgccaggatggtctctatctcctgaccttgtgatctgcccacctcagcctcccaaagtgctgggattgcaggcgtgagccactgtgcctgaccaacccttggctttatagatggccatttttctctccacatcatcttcctctatgcctgcctgtgtccctgtctaagtttccctttattataaggacaccaggcattttggataagggcctaccctaatgacctcattgtaacatgattacttctgtaaagaccctatctccaaataaggtcacattctgggttactaggggtcaggacttcacagtatgtattttgcggggacacaattcaacctttaacaacattaggcagtatcagtactttgttccattctatggctgaataatatcccattgcatgtaaacatttattttttgagccccaagtacaaagcaactgtcagtgaaatctccaccccctgggtagtgtgtgcccatctgtataaggtggcatattgatctcacaggtagagctcacaaatctgcaatgtgtaaactttttcttattgtcttcctccttgaaagagtgttagcctttacgagcaaaagtcaaagcagtactggactaagggaagagaagtcaagcttctgatcctaaaattaattttaaaaattgatttcaggctgggcactgtggctcatgcctgtaatcccagcactttgagaggctgaaatgggcaaattgcttgagcccaggagttcaagaccagcctgggcaacatggtgagaccctgtctctacaaaaaatacaaaaattagctgggcgtgctggtgcgcacctgtagtcccagctgctcaagaggctgaagtgggaggattgcttgagcctgggaggcggaggttgcaatgatctgagatcacaccactgtagtcccgcccgtgtgacagagtgagaccctgtctcaaacaaacaaaaaaaagaggatttcatctttaaattttatttttccttttcctggtcttatccccagtgctgcccacttcctgcaagcacaggtgcacacacacaggtacgtgcacacatacgctcacgttaaaagcgttttcatgtgaccgttctggagaggggcgtggcacagataggagacacagtccttcgagaagacccagacggcagcttgcttccattgtcatggttactgggctcggtccccagggctggctgcagaccagagcctttcagagcttcttcacactcccgtccctgctcctgcctcagaatgaaagagaaaccttcgggcacatgtgtcttctcagctgtgaaactaactgcactgttgacttgtgcatttcatctgcccccttaatttaaaatctatttctgtctcttatgcagacagacaggggacccgcatccctgcagattgttggggaataaccccgagtcctcattagtttgttgcagactcaggccccactcccccatcccagaggcgtcggtggtaatgacccagggtctgtctctaggaaggatggcagcagggtcgcatcgtcctgcgtcctgactctgagcagggttgtacctcatgcaaaagttgtttaatttcctccttcctctctccccctcccctctctcttttccatcaaattcgttttgccacttcgaaagtccactgggggaagaaatgcctgctggtcccagggttttcagagaggcaggaaggcagatggaacagctcatacatgaaaaaaggacagaaaatgttcatatagtatgttgctccacatgattattttagggtaagacaggtgacttttgggtccttggactggaaggctccacactcttcatggaattggatgaaaaggagttaaaagtactgtaggtggtcctcggagaggagcggccttcaggggctcagattatgagccttggctccactcatgggggagccggggcctctggagctttgaaaagctttcaggtgattctaatatccagccacctttgagaaccattgttctaggggacagaggcctccaggagagttgagcattttgagagagggaggatagaagaaatagatgatatctaatgctccctgttcagcaattttgctaattaggcagaaagcaggggcagaaatcacacaccctcggctgtcttgggccaaaccaagcaggactttagctccatttaaccctgtagaatgcaaagggagactccagtgtcccccttcccaaggtttggtcagctgccaaagcttacagactgccagccacccggccgagcatttgccaaggtgatgtaaaatattcacgggaacacgccgtctcgatgttctactcacaactggttctctccctagctcccgaggaaaagtaacatgaggcccatgtggctgccttctcttctcagcagaaggtgctgatgttattagtggcttgccaagctatggttggagggggatgtcaggggcacgctgtggggctgacctttctgtctctgactctgttttgtagtacaaaattggacagctgtacatgatcagcaaacacagccatgaacagagtgaccggggagaaggggtggaggtcgtccagaatgagccctttgaggaccctcaccatggcaatgggcagttcaccgagaagcgggtgtatctcaacaggtgagtcatggcagcctgcgttctgcacagaagccccctcccacctgaccccatggtgtgacagtggaggcagtgggtgtctgggatgaaaaggtcacttggaaagtaactacgtccaccgtctacgaccaccaatctcattgtttttgaaaacagaatctgcccgagcgaggtggctcatgcctgtaatcccaatgtttttaggaggccaaggtgggaggatggcttgaggccaggagtttgaggctacagtgagctatactcacagtactgcactccagcctggggtgacagagcaagaccctgactgtaaaaaatattactacataaaataaaataaacgaaatgaatctccccctccccaccttgcattctgcaaaatcgtcctcaactgcgtttccattaagaggagctttcggctcatctttcccacggctttgatgacgtgttacagcgaaatgtgatcttaagaattcaagagcctggaaggtggaggctgcagtgagccatgatcatgccactgctctccagcctggccaacagagtgaggcccttgaaaaaaagagaattaaaggactttgtctcatcccttggttcagtgttagctgtaggaaagagacggtgctgcctatatgctgtggacaagtaagtgctggaggtggcaatgcaccttttggtctcagtaagattttcatttactactggtgaccacttgggtgtccgaaaagggaatgacaaaacaaacagtcacctgtgaccaaagtggttaagatggcttccacttctcaagtggacccatccttcccaaggtggaggttgtcactctccttttggaagggaaacacatcaaggatgacaaaatagcactagtcaagcgtgccgtttctgctttgcaaaatatattctttaatctcttgcttttttctttttcttttcttttctttctttttttgttttttttaaagacagagtctcactctattgcccagacgggagtgtaatggcatgatctctgctcactgcaacctccgcctcctgggttcaagtgatactcctgcttcagcctcccgagtagctgggattacaggtatctaccaccactcctggctaatttttgtatttttagtagagacgggattccaccatgttggccaggctgatcttgaactcctgacctcaagtgatctgcctgcttcagcctctcaaagtgctgggattacgggcatgagccaccacacccggcctttcttgctattttcttactatgaatggcgtaatggattattagggcttgtctgatcttctccccatcctatactcctatccagcccatttcttcctttcagttcctttctgaaaccttcggaatatttgtggttagatgccatatgaaatatatcttattggcaaagtgtggtggctcacacctataatcccagcactttgggaggctgaaggtggtagatcactttaggtcaggagttcaaaaccagcctgggtaacatggcgaaaccccatctctactaaaaatgcaaaaattagctgggcatggtggtgcgcacctacagccccagctacttggaaggctgaggtgggaggatcgcttgagcctgggaggttgagggctgcagtgagctgagatcatgccactgtactccagcttgggtgacacagtgagaccttgtctcaaaaaaaaagaaaagaaaagaaaagaaaagaataaagaaaaaaaagaaatatattttattgaaattaactgtccattccagcaaacaagtcttacgtcagccatttcatgaatacttttacccctacctgtggcctctccgattggcccatatgtgattatccagaaagtatttccaacaccctagctgggcagtgccccagtttattcactgacaccagtgactgtccattctcagggcctcggacgtggttagacatctctgagaggaaccatatttagattcccattctcgccttgaccccactccccagcagcttgaattggactattccttcttgatgggagactttgcttcctgtcactagggtggatggaattctcccagacccgtgtcctgacagtgaagggcatgagctgattaaactgatgttttaatttgcccagagatgcagtaccagggaattcctgagtcatgatgaaatgcaaatgagattgatcccattcatctattagtagctgtgaattcccaggctttggaaccagttcagtgtccagccagctgttgatttgcaggggcagctgagctctgggtctgtcctgagcatggcttttttacagagacaggtttctcaacatgctgctttggcattcttagcgtggagggtgtaaatcaaatactgagcaagtttctcctcggggatcacctctgcagggcaaagagaagtgaggaagatgccagaaaatagaaacctatggaaaattccatttcttggcatacaattgcattctctcaagttattacctggagaatgttccttatatatgaaaatcaggaagaattttaggaactttgtaagttttgctgaaacacaataagaggcatccagctctccctgtcatgtctgttttgtcatatcatatttatatcatatttatttaaaagaagagtaataaacattagtaagagggaaatttgttataaatagatgtggacttccagtaatagtaaggaaaaagattaatggggaccctccaccacttcccatgacaaacacaggatgaaatataactatgtaaagaagctgagctcaaaacaaagaaagggaaatcctccgaggctagaaataaacaggcaaactgaaaccagagtggaaagcagacccgttaatgctaaggaagggcatcggggggacatcagaacagagtgtgggttctgacatctagggactgggcatgtcatgcccatggggaacaggaattagggcctcaggcccacataaatggaaagttggaactgagaataggatataaaaataatttttgacaatcaaggtctgagagagtttactaactctgagactcatattgaaagaactactaaaggatgtgctgtaagaaagaggaaactgagcccaggaaggagagggagttctagaagtaataataatgaagaaattgataaacaactaggtaaatctttgaatggatgtaggatgttttaaaaacagtaataataagacaacaatcaataacacagaagatgggagggtaataattacagtaaaaagcactttaaggtgctaatattgtttaggaattagaaaaaaatattgattaattttagattttctgtttttctttttttgagacagccagctccgtcacccaggctggagtgcagtggtgcaatctcgtgccttagcctcccgagtagctgggactacaagtgtgcaccaccacaatgcccgactaatttttgtatttttagtagagacagagtttcaccatgttggccaggctggtcttgaactcctgacctcaaatgatccaccagcctcggcctcccaaagtgccgggattacaggcatgagccaccgtgcccagcctaattttagattttctaagacaagtatgcatattcaaaatataaaggtaatctctgaagaggtggtaaaacaatccataacctccaagagaaaacttgatcaatccacagagggcctgggaacacaaaagagaagcctacaaaaagcatgataaatagaaaacacaaatttggatggtaaaataaaatgaaatgtcagatactcacttttctagccaccctcgcagctagagatggccatgtggacctagttctggccaatgagacatgagatttttcctccttgataaaaagagggacgttcaaggagctatctatgctattcaaagagaatctgttctgatgtctccccacttcatgatttgtgtgtaagaaagtggggaggatgggggctgactgctggaaggaacactaatagtgcctaccaagtgaaccttgataacaacactggataataaccataccaaaaagacacttataggccaatctcagttgagaacatagacatgaaaatactatataaaacattagcgaataaaatacctcagagaaaaatgtatcatgacctaatcagatttacccctgaaattgatgaaattaacatttaataaatctgtgtacttattcagagtaaagtcaggaacacattaaggatgcttgttattaccatgtctatccaacattatgtaaaggcctagccaatgcaataaaacaagagagaaataaagaggaaaggaagaaacaaaatgatcatttgcagataatatgattgtctgatagaaatttcagacatttctacagctgttaacatcaatatgagaattcagcaagattgttgggtacaatccatatagaaaaatccacagcattattatacagcaggaaaaataatagcgaaaatataatttaaaaaattttttgtttataatagaaaaagaaacaaagttacccagtaatcagtctataagatatacaaaatcattttggagaaaaacataaaacatttgtggaagacgttttaaaagccctagacaaatagtgaaacataccatattcatggacgggaaatgttacaaagttggcatcaaatctcaaatcaatctataaatttaataaaaatctaacttaaaatgccaacatgttgttttttaaaaaatagaactggtgctgggtgcagtggctcacctctataatcctagttctttgggaggtcgaggtgggcgatcatgaggtcaggagattgagaccatcctggctaatatggtggaaccccgtctctactaaaaatacaaaaaaattagccaggcatggtggcgggtgcctgtaatcccagctactctggaggctgaggcaggagaatcacttgaacccgctaggtggtggttgcagtgacccaagatcgcgccagtgcactccagcctgggcgactgagcgagactccatctcaaaaagaaaaaaaaaaaagaactggaggagatatttgtaaaattcatatgaacaatttggaaagttgaaggaggggcttgacctactagatatcattataaagctaattcagtaattacataagtaattaaggcagtggggtactagagcagagttaaactcatggaacaaagtagcccccagacagatccaagccattattagtgctttgtatttaatagagctggcataagaaattattgaggggaagatgaactcttcggtatatgatgttgagatgactgggcttctaattggaagaatgactagagccctccttcacactacacacacaaataaactccatggctgggcgtggtggctcatgcctgtaatcccaacaatttgagaggccaaggagggaggatcgattgagcctaggagttcaagaccagactgggcaacctgacgaaaccgcatctccacaaaaaatacaaaaattagccaggtgtggtggcacacagctgtggtcccagctgttcaggaggctgaagtgggaggattgtttgagccctagaggtggaggttgcaatgagccaagatcgtgccactgcactccagcctgggcaacagagcaagaccctgtctctaaataaataaataaatagatagataaattccagattgattaaaaacctaaatgtgaaaaaatcagaagaaaatatatgtaaatagctatattatttggagagtagactagaactaattaaataaaaaataaataaatggaatcattaatattacaacactaaaatgaagagcctttgcatagcaaaagacacacacataaaaagtaaaaaacaaaaacaaaaaaaacctttgcatagtgaaagacaccaaaattaaaagaaccatccctgcctggaggtaagtatttcaaaatgcacatatagaccaagaccaaggactagtatttaatttaaaaaaaaaagaaaaactcttatagatcctttttttttaatttgaaaaaaaagacaataatccaatcaaaagatgggcaaaggattgaacatgcaattcagaaaagaggaaatgagaatggctaatataaacatgaaaaaaattcccaccttattggaaaacacaaaataaaaaagcaatagcatcctcttttacacacatcagatagacaaaaattttaaaaatctgataatgccaggtgttcacaaagatatgtgaaaataactcacttccaatgctagtaagagatataaactgataccacctctttagagagcaatggacagcaactggaaaagttgaaaacatatatacattccacttaacaattatatttctaggtagagccctagaaaaattcttgcactgtacacaaggagacatttaccaggagattagtcctaatgctgtatgcaatagaaaagaaatggaagcgattcaagtatctgtgaatgggaatacattatggcacattcacgtaatggaaaattccacagcagttcaacttaatgaactagacatactttgataaatttcaaatgcacatcgtaacgtgcaatatatcagctgcaaaaaacaaaaacaagtcccggcacgatggctcacgcctgtaatcccagcactttgggaggccgaggcgggtggatcacgaggtcaggagatcgagaccatcctggctaacacggtgaaaccccgtctctactaaaaatattaaaaattggccgggcgtggtggcgggcacctggagtcccagctactcgggaggctgaggcaggagaatggcgtgaacccgggaggtggaggttgccgtgagccgagatcgcgccactgcactcgagcctgggtgacagaacgagacgccgtctcaaacaaacaaacaaacaaatgtatatatacacatatagtatgatgccatttatatctactattaagatatacaatatgcataatattactacatttatatatattgtttacagacaaccgcatatgtaataaaagcaccaaaacatggagaaaccaccctcaggttgtggttacctttgaggagggagaggaatgagttggcatgagaggaaactttacctgtatctactacattttattttattttattttattttattttattttattttatttattttttcgagatggagtcttgctctgtcacccaggctggagtgcagtggcatgatcttggctcattgcaatctctgccttccgggctcaagagatactcgtgcctcagcctcctgagtagctgggattacaggcacatgctcccacgcctggctaatttgtgtatgttttagtagagacggtgtttcaccatgttgggcaggctggtttctaactccttacctcaaatgatcctcccaccttggcctcccaaagtgctgggattacaggtgtgagccatcgcacctggcctattcctttttttaaaagaagaaagttcatcacaaatatggggaaatgttagtttgttaaatctgaatggtaatgttaaaattcagaagtgtacaccaacaatggtctattttactgtaatttaaaaataaaatcgaaaatataaattctgggtggcagatacatgcatgtctgttacctttctctcgattttttatatattttttatgtaagtgaaattctccacaattaaacataatattttaaaagtaaattaggtggagaaatgaaacctggttactgtcaaaactggatggattagtgactgattgaataacaaaaggtacagatgatggatagtggcaaccaagagagaaaattctatgtgtaacttaaaaataatgtgatttagtaatgtgactcagaagtctgaatttggtcctattggattttttaagccaacatctggctaaatatctagaagatatcctttccatacccttgagaaacccacagccaggaaggatgataactctaaaagactgagtgagggctggacgcaatggctcacacctgtaattcgagcactttgggaggctgaggcagatggatcacttgaggtcaggagttcgagaccagcctggccaacatggtgaaaccctgcctgctaaaaatgcaaaaattcgccaggagcggtgtcagacgcctgtaatcccagctactcgggaggctgagccgtgaaaatcacttgagcctgggaggcagatgttgcagagagccaagactgcaccactgcactccagcccgggtgacggagtcagactccatctcaaaaaataataataaaaataaaaataaataaaataaaagactgagtgaggatccagaaaaacttcagtagtttggaattacaggccattttctatcaagatgaaattaaataggggcaagtatatggtcttatctttggatcccaaaatacaaattatataagtatgggatgaaacactgataactttgcaatggcctgtttgaaagaaatacagtgggtttagttgacaattcaatatgaagcaattatacatacacacacacacacacacacacaataatttagtgtgtgtgtaatagattatacagctgcaaaaattattcttcaactgaatcaataaaagtaacgtaaaatatctaaaaccatgtacttgataatcttgcccaattttccactagtcagaacatacttggaatatttttatctgttcctaaatggcacactttaaaatggatatagacaaactatatctagaaactcaagtgatagaaagaatgactgaagaaaccaaggatatttaacccggaaaagctagacttgagtgtatcatggtgccattagatggagaagactcagaactgtgtatgccacaagacctcacttagcaggaccaatgggaccaagaccagtgggtaggaatgccaggagaaagacttcggctcaggttaaggaagaaatttccaagcacacaaaccatctcagaatgccttatagtggattttgctattgctggaggtgtttcagcaagagtgagaccctgttcatcagggtgtcctgaagcagattcaaatatctaataggcggttgaacatattgggtggctggttaagttggacagcctggaagatccttttcaaccctaactttctacactcaaactatctatcagtcattgattgtcctgattctcctccagcatacatatgtaaccaatgaggcacaagaaaagaagtatttttagttatgcttgcaccattctaaaccaggtccaccatttcataattttaaaaagttcttgggcgtatttggtagagtatggatgcatattttggaaccagggagattatgagttagcaagagagaaagaaaaaaattgacagaatatgaattaattagataaatccccatcatcataaaagaaaaccaaatccattgtttaatcatcacaacgtagagccacctcaaggtgactcaagtcctccatgcataagtcatgtgactgccttgtgggttgggctgcttcagagtcataattcattaaacgagtatttgctgaaatgtacgacgtacaacacattgtgcaggcattggagagaatcccttaagaaataagccatggtcatggttcttgcctcctgatcaaggtagggtccaaggcattttcataagtccacagggcagtgggtcctgattgttggaccggccgtaactaagatgttcccagtgcccatttaataatgtacacagacaattatcattgacctatggacctgaacgcatgagccggcatagtgagtggattctcttccttacatcaatctgtatgggaagtcaaaccacattcagaaactgccttattgattacctaaagtaattattagaggcactggaaatattcaaagcctgtgtaatcacagcctactctccagttaatgtggaaatgagaaagttgctcaaaggggagttagagtccacaataattattatcactaagcaaagatagtgtaaacatccatctatcgaccactggtgtgctttggctggtggttatgttgtctgtgggggatgagtggcagacaggccaaaaaggaggcgtgaggctttagcagttaaggtccacagttgccagcaagagaaactgagtctcttgagcagaaaggacatttcatggaaagatgttaggagccctcaggatcatctggaggcttaagagtgggcagaaatcaacagccccatgatgacagccatctttaagtagagccagatggcgtcattctgccctcatcaccccctacctctgctgcctgcagccatcagcaccgcagctgccctgagtagatctgaattgtcctgtttttctttccaccacttgttccaaaatcccaaacacaagtgtcccattgggttcccagaccaagccctgggctaccagtgaatgggagaaaggaactgctaaaccgttttccaaagtggctgcactgttttatattcccaccaggaatgcaatagggctccaatttctccacataatcactgacgcttgctattgttgtctttttgatgatagccatcctagtgggtgtgaagtggtatctcgctgtagttttcatttgcttttctctagtgactaatgttgaccgtctcttcatgtgttcattggccatttgtatatcttctttggagaaatgtctattcctttgccaattttttaattgggtccaatgtccgttgaaaatgccatttatccttttaatacatgcctctcatttcccagagattgtggggttgcttcatcttctggccccctcctacagcatctgacatactgttgatatatagtacattatgatggttgcctaatatatttggtatatgagtactaatgcattagtacatttacattagtactaatacaataatacattgggtaattaagagggaatctcgctctgtcacccaggcaggagtgcggtgctgtaatcttggctcactgcaacctccgcctcccaggttcaagcgattctcccgcctcagcctcctgagtagctgggattatagacacctgctaccacgccgggctaatttttgtgtttttagtagagacggggttttgccatgttggccaggctggtctcgaactcctgacctcaggtgatccgcccaccttggcctcccaaagtgctgggattacaggcatgagccaccacacccggcgtgtgcttgggcttttgatccagttcagttaaccaagtaagtagtatgccttgacacgtcttcaaaaatcctggttacaactggcatccaaggaatgggggcatgatactaatcaaattctagaatagtgattctaaataaaacctgtcacccagaaacatatgaaggtggacttttcttttgtcaccttttcttttcacttcgtcgctagcatctctcggatcccttcccactgaagcccaggaggggagggaatgggggtgggggtggaggggcactggagaaaagatggaggctatttttaggcttgtttttcaaccatgaagtgtcatgttcttcaccaccctggctgctggattaattaggctgtgctggcagctgccagtcagggagggttgccagcttctaacggtgattccgcctaatgcctgaattgattttcagggagagaacatttttcccgctacatggcccttgccttccacggcaatgtctcctggcctctgatggctttgggtaggagaggataaagctttcataagtcatgaactcttttttaactgatgggcttgcaaagctaccagctggtccttttacctaacagcttgttgatagaaccttgtggtcatggcttgggtctctctttcccatttctgcttcctgttctcccagatcttccccaaaataagctcagtgcccagaacttgtgtggctttgggatattccactgcccgggcaacaggcaatagagacagcatcagagacatagactctgaccaaatagctcattttcatgctatttttccaagaatctctatggtgattgttaacttctagatatacaaagacaatatttagtcattaaaaaaatacttattgaggccgggtgtggtggttcacgcctgtaatcccagcactttgggaggctgaggcaggaggatcccttgaggccaggagttcgagacaagcctgggcaacatagtgggactctgtctctacaaaaactttaagatataggcaggcgtggtagcacactcttgtagtcctagctactcaggaggctgaggcaggaggactgcttgagcccaagggttcagggttgcagtgagctatgatggcaccgctgcactccagcctgggtgacaaagtgagaccctgcttctaaaatatgggtctcccagcactttgggaggccaagcaggcagatcacttgaggtcaggcgtttgagaccagcctggccaacaaggtgaaaccctagctctactaaaaatacaaaaattaaccaggtgtggtggcatgcctgtagtcccagctactctggaggctgaggcatgagaattgcttgaacccaggaggtggaggttgcagcgagctgagattgcatcactgcattccagcctgggtgacagagcaagactctgtctcaaaataaataacataaaatatgggtctctctatccatttattcatttatttttatttttttaccaaaatatataagctgctgcccatgctatgtttgaaagatggctccttatctagtaatagctggtcaagttacttgactatgtgaatattagactgtatacatagtctatacatatatatatacacacacatacacagacggagagacagaaacacctgctgggcatcacacaccgttctaggtgctggggttgcaatagtgaacagagcaaacatccctgccctggtgggacttgcattccactcgggagtgacagtgcacaatagccataataaagaacagtatattggccaggtgcggtggctcacccctataatcccagcactttgggagcccgaggtgggtggatcaagaccatcctggctaacatgatgaaacgccatctctaggaaaaatacaaaaaattaaccgggagtggtgtcccgcgcctgtagtcccagctactcgggaggctgaggcaggagaatcacttgaacctgggaggtggaggtcatgccactgcactccagcctgggtgacaaagtgagactccatctcaaaaacaaaaacaaaaacaaaaacaaaaacaaaacagtatatcgtctagaatatatacttttatatagtctgtatacttatgtatattacatattatttatatagggagactatatatgtatatatatatatatatatatttagaaggtgataagtgttatggaaaataatagagcacatggggtgcttccttccaacctttcagtccatgctatcctattctgtccccatctgagtacttaaggacttgtgagggactctcatgctaccgggcccctcttccctgtgctcctgtaggaactcatagaaacagaatgtttaggcctggttgggatctcagaggttttccaggaggctttccacctgggttctgcctcactgctgatggatgatggtgtgtcctgtgtcgccttgccaggggcttctcagcacactgtccacataaccctgatgctgtccaagctgagccttccaggaacctgcaggaggcaggctccttttcccagaatcctgacacaaactgtcttgttaagcagggaggtcgggggtggggcccgtgagtccaagttcaaggaacttggtttctggccagtccctgccggggaggccccggcagccttgcctcccacagctgataactctggtcccgaaactgctcacttccctactgccatataaacaattacattaagagcacaagtaaaagaccagccagaacaatcacttagaagagtaactaaatgaatcagagcagctggagaagatattttaagaccccagaaatcactgcacatagaactggatgggggcaattgattatgaatcaaacagatgtcaattgccagttttagtacaagaaggaaacaaaaggtcagtatattcctcctggactatcttgtgagaaatgaggatatgaaggtagcagagttctatttaaaatgagctgcagtcatttcagcataatctcagtgcagaacatggcaggttttaggtacgctgttgagaagaaaattccaggactgtcttttctgctgggaatgttcaagttctggtaaaggccaggtgcactggctcatgcctgtaatcccagcatttcaggaggccgagatgggaggattgcttgagcccaggagtttgattccagtctgggcaacatagtgagaccccatctctaccagaaaatttaaaaattagctgggtgtggtggtgcatgcctttagtcgcaactaccagggaggccaaggcaggaggatcacttaagcccaggaagtcaaggctgcagtgagatacgatcatgccactgtactccagcctgggcaacagagcgagaccctgtctcaaaagagaaaaagaacaaaataaaatttctagttaagaccaccgtaattctgacccctgttgagaaaatgaaattagactctatttagacacgtttggcctaatgatgttcaaaacctcctggagccaaagcccaagtgagcatacattgcaatgtgagatcaggtaccagggggagttttgaattttgtgatcatagggatcgtaaagtaccagaagcttctaatggagggatgatttaggttctgctccagaagctctttatgaagtaggtaaacacccataacctgagaccagttcagattatgcctgcccctgaaccttcttattaaatcagttgtgatttcgggaaccttggggaatttatgacatgagagatgatctgccagggttcaaaaccttgttgctgctgatgctttgggctggatctttatttgctgtggtggtggggggcggctatcctgtgcatcataggaggctgagccgcaccctgggcctctctctgctcagtagatgccagtagcactgcccaccccacctcgcctctgttgagacaaccgaaaatgtccagacattgccaggtgtctcctgcaggaggcaaaatctccctctagtgagaactcctgttctagggtgaccaaccatcccagtttgcctggaactgagggattttctggcaggtgggactttcagtgttaaaaccagggaagtcccaggcaaaccagatgagttgtccacttggctgtgtcattgatatgttctattttataccaacgtttaaaagtaagaacccgggctggccatggtagctcatgcctgtaatcccaacactttgggaggccaaggcgggtggatcacttgaggtcaagagttcgagaccagcctggccaacatggtgaaactttgtctctactaaaaatacaaaaataagcctggcgtggtggcatgcacctgtaatcccagctacatggtaggctgaggctggagaatcgcttggacctgggagatggaggttgcagtgagccgagattgtgccactgccctccagcctgggcgacagagcaagcctctgtctcaaataaataaataaagtgagtaagaaaccaaagcttttgaaaagtctgtctttgggaggcattgacaaggcatctgggggaatatgatgctgcttgtggtatcattttgcccctctttttcctcaatgtctctaaagcctgagccctggtgagatgggccattggaggtttgatcctagcccatagaccaaggagactcgattcaaacttgctgcctttctaatagagaggctcttgtttgacacttagagtgagcatgagtgacagactttttcttggaattgtaggctgtgtgacagtatacatcatgaaagtgacagcaacagtggggactaatttaattccattttcctttgcaggccctgataaatcattgctgcagggaaaaataaattttactttctcagacaaatgattggaataatgatgtgctgtgaggaaatcgggggctgagagaagatctgttggtgggcttaaaagtatttaaatagcgcatcatggaacttgttgcaaatacctctcgcgtctggcctggaaaataccagaaggaacctcctttccagactgattagaagagttcaggccgggcgcggtggttcatgccagtaatcccagcactttaggaggccgaggcgggcggatcacctgaggtcaggagttcaagaccagcctggtcaacatggcgaaaccctgtctctatagcttgaacccaggagacggaggttgcagtgagccaagattgcgccactgcactctcgtgtggggatagagcgagacgtctcccaaaaaaggaagaagagttccataaaatatcagctatcttgactaaatgatcgtggttttttaggccatctcaatggaaaaggtcattgattatcgtgctgcatatcctatataagttggtggctgaaacagctaaaatagattctagaatctggggtcctgagggaccatttacaaatagaaaaagtctcgacttggatggaaaattgccaataattttcacctcccttccagaaaatgactgtggctcaggagtatagttctgctgggaggcttttaaattgctataggaaatgaattacggggcgaggaggtacttgggccccggactactactatgcatgaggattggagtgaatttgaggaggggtgcaatgtagatggaacccctgcccacaagaggacagtggagaaggggctttaataccgtagggagacatatgcgctttgtctaagctaaacaatgcctggcttacgtgagggagattctccaaccctgagtcagtccattaaaagcacaagaaaatcacctgcctgcaaccagaatccacatcttcccacactaccattggcatattgcgctagggtgtgggggcaaacaggaaggaaccaggggaagttttgctcatgaccatttcctgcacgcgagccagtgtaattttcccactgtcagcgtcacctgagttgcactccaacttcggtgatggatggaatacatcatcagcgaaagctataaaaaccccatccttttgagcagcgtgaacgtaagggaaatgagcagttactgcagagaggattttataggagtgaaaaattctgcatcagagcagcaagaaggattgttatgtgaatgatcaaactgcttctgctgactcctcagagcccgcctaagagcaggggccttcatctgacactcactccacttccggggaactttgctttcctatttgttttaaccctgattaacagcgcagagctatgggttaggtccggccagccactgagagtccatctttgtgttttcaaaagccaggcctggttactgtcagaaataagagaaacaactggaaaagacaggcaaggtacgcagtattttacgggctctgattgtcatttagatttcgcatccaagaggggtttgagacttggggttctgttagctccatgtcccttccagcctcctggttctatcagcttggaattcaaaaccgcttcttgatgtttcttatttccaacatgtagctaagttgctgagagtatacgtcgtcttcctggatccgatcgactgctaggcatgagtggcccagacacttagctataggccccagagtagaaaagtagcaaatggtagcctctggaaggacagaaacacttggttatcgggctggaataaaaatgaaatcatgggccgggcgcagtcgctcacacctgtaatcccagcacttttggaggccgaggcgggtggatcatgaggtcaggagatcgagaccatcctggctaatacggtgaaaccccgtctctactaaaaatacaaaaaattagccgggcgtggtggctggcgcctgtagtcccagctactcaggaggctgaggcaggagaatggcgtgaacctgggaggcggagcttgcagtgagccgagactgcaccagtgcactccagcctgggtgacagagcgagactccgtgtcaaaacaaaacaaaacaaaacaaacaaaaaagtgaaatcatgcagatgtatcttaaggaatagaaatattacatatttcaatataatatttaaggaattagctggggctgcactgttctctaagttttgcctctgaagaaaaacaaaacattgctttctggtttgcaaaagaccctgggacctgtgccttttgagaatttgttttctgcaaatgactgctccagaggaacagctgtgtcattttattggctttctaataactttccgaaacaaattgctgcaaattaggtggattaaaacaacacagatttatcctctagcagttctgggggccggaaacccaaaatcaaagtgttgttttcttctggggaaactgagagagaatctgtcccgggcctctgtcccagcttcttgtgttctttggcttgcagcaacatcatttccatgtctgcctctgtccttgcatggctgtcccctcggtgtgtctctgagtctcaaatctctttctcctttctcttataaggataccagtcattggagttagggcttaccctaaatccaggatgatttcatcttgtgatctttaaattaattacatctgcgaagagcctattttcaaatcaggtcatattcacagttactggagattaagatgtggatccatcttttggggcagacacaattcaacccactacaactgtattttgttgctcttcctatctctaagttgctgctctctgttggttttgtccattttcaaaatgtcacttgtatgagttgcttaggctgacatctatctctaagattagcttcctctccctgccagtgtttgggcttaaacattccgtgataccactcctaggaggcaaaggtcaggctggccaaccctccaaacatggaacccttcaggccctgaattctcatgtctttgcaaatccaaagaggacaggctgacagtctgatggagtcccccaccaggctgtagccttctgtctttacacattttgagagcacttgaatatgcacgggaaaaagttaactatgacaaagaccgaagagatggggaaagggcagctgtggagaaaagagatgccccagaatccccctgatttctccagcattttatccagaaagatgtggtagtgtggtgagactctgaacagactccaattgtcttttttctttctttcctcttagcaaactgcctagttgggctagagctgttgtccccaaaatattttatgtgacagagaaggcttggaactattatccctacacaattacaggtaagtccttagtacaaccatatggcacatgtagtgagtgcaaggacatagcatagttgaatttcactgatttacagtggattatccaagcagggccttgtgggagccccgtagtatccctctttttttttttggtttcttacttgtaggttatcaacacttctaacacagacacagagatggcaggtgacaggggggttaagctaagccattccatcttcgttcttagagttacaataaatagtttacggagggccaggcgcagtggctcactcctgtaatcccagcactttgggaggccgaggcaggtggattacgtgaggtcaggagttcgagaccagcctgcccaacatggtgaaaccccgtctctactaaaaatacaaaaccaggaggtggaggttgcagtgagccaagattgtgccactgcacgccagcctgggcaacacagcgagactccgtcaaaaaaaaaaaaaaaaaaagcttatggagaaggaaggtgaagatctttatagagacatttccagaggttttatgattcttatttccctgtttcctcaataattcccaagtaatttaggggtataatttgtctgtaaacaagttgcttattatgacttgtttgtttttaccactccaaattttgactatactttgtataaaagattctattggatctctctttgcccccagatgacttcctttgctattagataatatgaaaatatttaaggtcagtctccctctcacttgcaatgcgatgacaataaactctttgtactgaatactgtcctagaaactttggccaaaaaaactcagaaggtttggttcctgccctcaaacacaccaaaatttgaaatcccacctcaacgtcatcaataacaagctcttcttattggttacaaaagctgcttttccacttaaaagatttcctttgtggttaatgaaatactctactggaattattagtctttcatttgcttttataatgccaactctttggtttttaattagccacaagcctataggctaattgaatcttgtcttactgttcttatctgcccaaccacataagtatcatgaaagaatttcagtgcaacacggagacattcagtatttatgaaagtttcattaggacatcttttgtaattatagttcgtcagtatttgttagttctgtggtttttatattgcatataagcatgatctaaatcatcttttgtctcttttttctttcctctcttcttcaaatgaacatgtggaaacagaatacacagtaagttccatttaattatttttaaacattctgtctatgatcagtggagtaattggaatgtctcttgtattacttgtcttatcaatgtaataattaaaaaggggaataattccaagtcagaaatatttaaatgtaggctattgcatcgttatatataatgcaataatttgaatgttctcatttgttcaagaatgtgaatcctaattgaaatcgccttgatagtcactttacgtaatcagcctttgcttgtaatttttaaatagcttgactgctttgttggtgatagttcactataataaaagaacagtttctagcaacgtgatattaaagagatgatggtagttatcgatggaaggtggggcttttactcatggactgtgtcctgattccttgttggagaagcttgaaagtgaagaggcacatgtgcaaactattttgcacaacagagatctgggttgggcagtcgctgtggcttgataaaatttcttcttctcctaagagcctctagggttattacttagactgaaagaaaaaaagacagaacctataatatcattgtgttgtggtattttcatttagatcattttcccaagcagctaacaggtcaacctatcacaacaagaaaatagtttatgatttttttttttttttttttttgagatggagtctcgctccatcacccaggttggagtgcagtggcacaatcttggctcaacagaaactttcacctaccgggttcaagcaattctcctgcctcagcctcccaagtagctgggattacaggtgtgcaccaccacgcccggctaatttttttatttttggtagagatggggtttcaccatgttggccaggctggtctcgaactcctgaccttaggcgatccgcccaccttggcttcccaaagtgttgggattacaggtgtgagccaccacacctggctaatagttatgattttctgagctgtgttaagagttgagtttttgggttcaatccaaatagccaaaggatagagaggtggtgagagaaatggaagaaaatgatttgtcatgccctgggcaggagcatagtacccaacgcatcgtaggtgctcaatcaatagttattgaatgacagaatgaacacacaaattctagatagataaatggtcccagcacaggctttggcgtcagaaaggcttggctgtcctctggttttgccactcactgccagaattcctaagcgactggctcccaactgccagttcttgaattcacactggtcctcgactatgttctcaccagtcctctgcagaatgaagaaaaaacaggaatagtattcagagattttcataacattaaatttatttcatccaaagtactgttggtaattatatcccatcatactcggatattaaaatatcttttcttttttgaaatgataggaatatatatagtatttccccccgcaatgtccctaactttgaaaaaagaggcaattttatggcaaaatgcaaatgtaaaattttagaagcaggggaacctttgctctagaatgaacatcttaacttttctgaacctgtttcctcttttctgaaattagaataatccctccttcctagagatgttagcggaaggattcagtggtctacccttggattggaaaacattgtctttagagggtcatattgtaaatgttttctgttttgtgagtcatatagtctctgacactgcaagagcagccttagatagtatgtaaacaaattagcatggtcatatatgcccaggcagcgggtcaaatttgtcccccaggctactttgccaacgctaaatataaagctgttagcacactgcctgtatacagcaggtaattaaatgattccctaccaccaacactaccccctagttccattgcttctggcaactgcataatcatcaagaggtagactttgggccgggtgcagtggctcacacctgtaatcccagcactttgggaggccgaggcaggtggatcacttgaagtcaggagttccagaccagcctggccaacatggtgaaaccctgtctctactaaaaatacaaaaaaaaaaaaaaaaaaaaaggtagttgggtgtggtggcgggcgcctataatcccagctacttgggaggctgagacaggagaatcatttgaacccaggaggcagaggttgcagtgagctgagatcacaccactgcactccagcctgggcaacagagtgagagtccatctcaaaaataaaaaattaaaaaattaagtcaacggtcatttattaggcatcagtgaggtacaaaacatcatgctagatggcataactgagcaattatctctgtcatttggggtcacaatctggttggaaatagctggacattccagtcaaagcctggcagtcatcagcaagtgctgggcttttctggaggcaagaggggacttagccaaggaaacaagctggcctcagacctgtccactgggctggataagctctgaactgagctgccagcagagattcagacctcagcagagggcagaatcaatgactctggggaatccaaccagataaagcagttgcaatgtgaaaagaagggtgctggcctctgcattggggccttgagttttggggacagggctacagtccccaatgtgggagacaggaagaaaagtacacagcactcaaggaggttactcagtatcatggtgctggggagataaggttgtcaaccttagtaagtgaaaatacagaatgtccaggtaactttgaattttcagataaacagtaaataatatttagtataagagtgtcccacatgttgcatgggacataattatgccaaaagattgttgtctcatattttgtctggcaaatttatgggagagagatggtggtgtggaagaactggtctcagagactcaagtacaaaaatcagttatgagaacagggcacactgatgggccaagggaagggaggggtccagaagtatgtaatgtgggaacccatcctgcaattgacatgccataggaactctaaggtcagaccagagattcagccatctggtctgaatctctgctggcagctcagctcagagcttgtccagctcaatggacaggtctgagactaacagtcaaatgcactgatgggaccactccaagagccttcctgcctcagttaggattggctcaggaggtggaatggaaggagctaggcagagttcgggaaaattaagtggtagcagatgaatacataactgtcagcattttaaggaagaactgtgttgcatgtaagtgttagagctgaagtgcagacagaggattgtaggaaggagagagggattctgccagggagaaatatgaggaggtttctcagagaaggtcgcatttgggctggacctgaagggacagtacaactccccctgcagaggcctgttctgtgttagctcatgttgctctaatgaaacaccacagacttgggggcttgagcagcagacatttatttctcacagttgcagaagctgaaagtgcgactgggttcctggtgagggctgtcttcctggtaagcacgtggccatcttcttgctatgccctcacatggcagagacagagcaagttctctggtctcatctttgaagggcactaatcccatcatgagggccccaccctcgtgacctcatccctacctgattagtcccaaaatcccatctccaaacaccattgcactggggattacagcttcaacataggaatttgggggagacacagttcggcccatagtatgctccttccaggaccagtgggcaagtgatggaggtggatcctggccacctggacacatggatggagggcaggtcgtggtgttttcaatgtcaggtcaaggtctagatttaattctctgtgaggaggtcacattgttcctggctagttcacttttattttccatcccaaatataggacagcttttctttccatctccctggtgacaaggggatccggatttttctctctggctctagtgcagtcctccgggcccacagtgtgcggtttgaagctgccacctcttgactcagattcagccgtgttctcacgctctctgtccacgacagccctggtggcagaacccacccttgactctgactacagagtctgcacccaggatttatgacagatgctttcagttgccttagtcttttttcctgttttaaatgcttttgaattgtgctctttatcccctgatcctttaatcctaaatacctcttcttgctgtctttcccaagctccatagttcctgttcggtgcctcaaagcaaaacttccccaaggtcagagccccagttaggatcacggtgcccttcctttcctcagagaggcagcccggagggctcagaaacctccaaaccaatgtctcttcttggaaagcattagtccagagcacgaggatgtctatactaggatcccctaggtcttatatctgactgtttagcctattactcagacctcatgctgccctcattcgtgacaaagcccaggcaaagaaacctatttagagtcatctagggcttcagcactatcacaattatcaagacataagagctttttcatcactgtgagtgactgcgtgtgtttagaattatgtggaaatgccatttgcccaggaagtgggaaaaacatctttagcttgcttatgggaaaaaaaaaacacttaattatacagtaaacaacaacacaatgacagtttcacagaggacagaccattcaaccagttcttccaaactggtgggttcttctgaagttggtaaagtctgcaaagaaaggtgcctgaggagactggctgccttccaaaggagttgattttgtttttctagagctaaaaaaaaaaaaaagtctgcgctttcagatgagcataaatcagcagtatcaattcagccttggtactaatgaagaacaaaggattttcttcttgtttgtaggaatttgaaaacttaagttacaggaaatggatagcagggacctagagtaatacagttggcgtatatattttgcgaccgtgatcacccctctccaccggcatctctcttaataagaatccacaaaagaggagaaatgggatgcacctttgtgttagttagaatgacagaagcaaaggcagatgggttgtcaatgttacccaacattttaaattatttagatgagagaggtggaaaaataaaattgcaacagaccagggaggatgaaatgactctttcatgagaacctcaaatcgtattgagccactatgagagagagattactcagggctggtttagaagagccaagaaagagaggaaaggctgctcacagctgagagtctgtcatcagtcaccccaggtgaacccgggttatctgcccaggagtggccatggggagaatgaggtatgtttctgaaagccactaaactatctgggataggaattgccctcacagtctgggccttatcaagctcccccagtaatccaaagagctgataggtgctgtgtttagagaccagtgacccccattcctcccaagccccgtctcctttcttaagcctttcttccccgcaccttcccctgagtcccagccaaggggcagtacaaaccactgtatttcataactaggaacacaggaacaagtccagggaagattatgtttattataccagacctctaggattgggcttgttaggaaattaaagaaaaaaaatctggctatctcatctacgatgtaagctaagagggtgaaagtccctaagagtcccttctttgaggccatggagtcaggagttagcgggttaggaaataacttttatctatgtatcacaattaaccctcgatatttagtgcagtacataattttttttagacaaagggaaatatcctttttttagggaccaggccaaagaaacagtcctccagttgggggcactgatgagcaaggcagcaattaggcacgggcctgaaaagcacccttgtggagaagaggacagtaaggccaggtgtggtggctgatgccagtaatcccagcatttcaggaggctgagataggcggatcacttgaggtcaggagtttgagaccagcctggccaacatggtgaaaccttgtctcgactaaaaatacaaacattagctgtgcatggtgacgcatgcctgtaatcccagctcctcgggaggctgaccttgaacccaggaagtggaggttgcagtgagccgggatcatgccactgcactccagcctgggtgacagagcaagaccctgtctcaaaaacaaaaaataaacaaacaaaaaaacccaaaaacaaagaagattatgtgagaccggtgtcatcacagagccagaacgaccaagctcaaaaatcgtcacagttctagagaatttagatggaagcagtctagaaccatttataactaccattcaagatggtacacagcccattaagtaagggatgggctatacagagctaaacagattttataattataggacttctcagagcctttcttattctaatgtacattgtgaatctccaaagggagctgtggcatgcaacgtttcccgagctgatttgtccaagggatcttggattttgcaaggccaatcttttaagacttagaggtgttccagaaacttctctttaggtcagagccattatgtgcccactaactatgccagtggatcaattctatttcagtaaatgttatttttttctaaatttcagtgagctaatgtgttgcctgaagatgactattactcagataccaaagttttttgaagaatgcccaacagtaatggaagtgttttatttttagaatcaggtgacacagaacccgtaagttccttttcaagcaaagtcagttctgttcaaccacacagcaaagtcagcagtacgttgggatggcagtgggtttgtgcatttggatttgtttccatttagaaaatgaactggttgtatggacgagccagttgcaaaccagcctattcacagatgtaccgctgcccttgtgtgggaccagagctcgcctctacatctcagcaccccaattagtgcctggtgaagcaggagctttggaacagccagttttgtttgttcagattatcccgtttccacttgctctagctgttcccaagctcttctttggacttcagagaaaattaattcagccattttgaggggaaagagcaggtgatagaacacgtggctctactgtaacaaaacataacattttaaaattgtttgcatttttttaacaccactcgaaatgactttacagagggcaatcagcagagaatacagagttgtttaagggaatgtttggtagaagattttactaagaaattctccttttcttcttttttgtttattttccacttgcagtactgaaaaatttgatttcccttctgcagtttacaaatgtctgtggagttgtgttcagctcagttgttgagatctgcagaatacaactggaaagattttgtgagcagatttctttctgtaaaaataaaacagtatgactatgggtataccaacatagtatatttcagggattaaagtgaatgcaaaggccgggtgtggtggctcatgcctgtaatctcaacactctgggaggccgaggcaggtggatcacttgaggtcaggagttcaaggcaagcctggccaacatggcgaaaccccacctctactaaaaatacaaaaattagctgggcgtggtggtgtgtgcctgtaatcccagctactcaggaggctaaggcaggagaatcacttgaacctgggatgcggaggttgcaatgagccgatatctcaccattgcactccagcctgggtgacaatgtaagactctgtctcaaaaaaaaaaaaagggaatgcagaattgccctgaggtctttgatctttttgatcagtaagataatgtgaactacacgatagtgtgtatttctttactgtctagacaagtgttgatacatcttttcagttcagaattttaaacatcgattctactttcttaagtgagaatttgctaggttggtgaagggggatgattcttaaccctttttaactgagaaggcttgccgtctgaaagtttcttacctggccatatgctcacctgtatttgggaagtcacactgatccattcccatctctgttattattatttttaattataaattagaggcaggttttcgctatgttgcccaggctaattttgacctcctgggctcaagcaatcctcctgcctcagcctcccaaagtgctgggattacaggcgtgagccatcacgcctggccctatctctgttatttacatgcaattctttttatttgatgtggtctccctgtctctttaaattcttgtcttgccattatagtatgtagatatcagtattcatgagcatcctctgcttatttctgccttgacaagtccagccctagatcgtatgagcctgaatttcgtttccctgcatgattatcctagaagtgcaagtgagtagcaaaccatcccccattcagaaaacatgctttcattcatgtcttcggctctgtctcccttctggccttgctttcctagtgagttgctattactcagcatgtcagaggacgggaagaggatccatgagtgaatgaactaatgaatgaacagaagcctctgtgtagggtgcgggctggtgaggagcagcggagaggcccgcgtgcatttccatgctgtagctggaatacaagcagctgttttccggctgtgtttcggagctctgccttccacacagtcccttcctctcaccctcctccacatctctttcaggtcccaccattcctcttggccacatttttcttcctatgcagcatatatttaggaagtcactctgattcatcctcatctctattatttacatgcaattccttttcttcctttcctctttccttgaaaagtctactttttttttccccacttgagttcttcttctcacttttgtggaactatcttctttgcaatttttttctccaactaccctgtcaccataaccacccaccttatttgtatctaaagtcatacgtaaccctcacaaggcagaagggcgaagggagctcaaatatctccccttatttcctttgcatctttgcctgtatgataactaaggttctgagtagagggtgacggccagacatttacctttttgaaattgatgtgtgtattaaagatcttctgtgcacaaaacagaaatttatattttgccttccaagcgtggggtaaaatttctatcaaaatggggagataaaaattttttaatgaataaaggaagctgaaaggtattttaagatctaggttctaccaactgtctgtatacacatttatcatccactttcttctacttttcaagcaacacaggcttttctcatttattttccagtagctccagcctcagagtcctggaagataataagccctaaactctatgcctgccctcattagcactgtggaacattctggatgtgagtctcctgttggtgaacagaggaaacacttgcaaatctagttttattaatgatcccatcttaagttgcaattcccagtgtggctttggagcacagttaatatgacaatatagaatacagtaccagagaatcgatgtcatctacaggggaactccattagagagaaagtcaagtctgtatagagtttcgtgcttgtggatagcagggaacacgttctacatactgttggaacaagatggcaagagaagaatgcattgaattccagataaaagctaaaaggaaattgtcttttaaaagcctataaatacttcatcaaccccaagccagctcctcaactcttccatttaactttcttgatgttaggcccgttgtaaagtgctgctctcagacatggaagaatttgggctggtaaacaagaataaagcgttgagttactgggctgagggttcttctcaatgagtggttttcaaactgtcctcctttaggtccaggagattccatggacaggtctcagtggccattctgtccctaatattttatttaaagaaaaactctgatgccagttaaaatggtttgaaaactactgaactgtaatatctctcagctcctgccctactctaaagaccatgaataagtgtgatgtatgtgggacaggaaccacttgaagcagcagttcccaaatttaacagatttgcaactcctctgtctacttagtggtgcttatattagtcaaggttctccagagagacagaaccaatggtgggggagatgtggggagagagagaaatgggtggatggatagatagattagatagctagattagatatgtagattagatagatggatgaatagatagatgattgatagatattaatagataagagagatggatagatagattagctagattaagtagatagatagatgatagatattaatagatagattgattagataggtagattggatggatggatggattgatagatattaacagatagatggatagattagataggtagacagattagataaaaagatagattagataggtagattgggtggatggatggatggatggatggatggatggatggatggatgagaggggatttgctagggaaattggctcacatgattagggaagctgagaagtcccacaacagcccacctgcaagttggagaccctggggtgccagtagtgtggctgagtccaagtcagaaggcttagaaccaggggagccgcgagtgtaggtcctggagtccaaaggctgaggagcctggagtcgttatccaaggacaggaggggaggagtgtgtccccactccagcagatagatccatacatttgcctttcctctgtattggtcctctccagcccctcagcaggttggatggtgcccacccacattgaggatggatcttcctcacctagtgcataccaactcacatgacagtctctggaaacaccctcacagacacacctaaaataaggctttactaggcttctaggtattccttaatctagtcaagttgacgcctaaaattaaccatcatagtgttctttataacataatcctctttaagttaaagtagattaaattataagaatttttggaaaaccttgtgacttcctgtaagataatatagttactctgggatgccattgatgtattcactcatttttaaattggatttaaattttttctgcttactaaaatagtagatatttattgtaacatccaagcattataaaaatctataccacagaaaataaaagaacttcataatttccactactctcctccatgagaatattttcccatgtttttcggtgggtatactagtttttcaatgtttttcagtgtgtatactcgtttgccatgtttttcagtggatatactagtttttcaatgtttttcagtgtgtatactcgtttgccatgtttttcagtggatatactagtttttcaatgtttttcagtgtgtatacttgtttcccatgtttttcagtgtgtatactagtttttccatatttttcagtgtgtatactcatttgccatgttttccagtgtgtatactagttttccatgtttttcagtgtgtgtactagttttctgtgtttttcagtgtgtatactaattttccatggttttcggtgtgtatactcattttccatggtttttgatgtgtatattagttttccatgtttttcagtgtgtatactagtttttccatgttttttcagtgtgtatacttgttttccatgttttccagtgtgtatactagttttccatgtttttcagtgtgtgtactagtaattttccatggttttcggtgtgtatactcattttccatggtttttggtgtgtatattagttttccatgtttttcggtgtgtatgctagtttttccatgttttttggtgtgtatacttgttttccatgtttttcggtgtgtatgctagtttttccatgttttttcggtgtgtatacttgtttcccatgttttccagtgtgtatacttgttttccatgttttgcagagtgtgtactagttttccgtgtttttcagtgtgtatactagttttccatggttttcagtgtgtatactcattttccatgtttttcagtgtgtgtactagttttctgtgtttttcagtgtgtatactagttttccatggttttcagtgtgtatactcattttccatggtttttggtgtgtatattagttttccatgtttttcggtgtgtatgctagtttttccatgttttttcggtgtgtatacttgttttccatgtttttcagtgtgtatactcgttttccatgtttttcgatgtgtatactagtttttccatgtatttcagtgtggatactagtctactttctttttgtttttacaaaaatggggctatcctgttttacactttgtttttttaatggttttagagtcgatcccaatgtacttaaccagccttctactggtgaactttgacttgtttccaagtttttttataggaccaacaatacagttaatgaacatgtgtttttttgtaatattttttcacatctcagaattcatgctggagttctgggcagggttttttgtttgtttgttgttttttgatacaggggcttgctctgtcacccaggctggagtgcagtggcgcgatcttggctcactgcaacctctgcctcccaggttcaagcgattctcctgcctcagcttccctagtagctgggatgacaggcgtgcaccaccatgcccagctaatttttgtatttttagtagagacagggttttgccatgttggccaggctggtcacaaactcctggcctcaagtgatccacccgtgtcagcctcccaaagtgctgggattacaggcatgagccacccacagggcctggacctgtttttaaaagcactttcataataagaattaacctaagccattatatttcaattcagtttttgaaaattattgtgttttcaaggtactagggtaatttggcatctaaaggaataccaatgaatttctgaaatgaataattatttccctaatatatcttttgagtaactcctgcttttcctgatttgggtttgtttgaagcaaggcacgtctatcatatgacagattcacacacacatattttctctgctgttagtggccacagcacatactgagaagcaaagcctgtgctttcaacctctgcttccctggaagcacttccatgatttcctgatacttaagaatcagcatgagatcacaagcatgcatgtcagagctagacagcctggcttgaatcccatctcctctatgcatttgttgtgtgacttacagcacactgttggacctttccgtgcctttgtttcttcatctgtaaaatggggatgtatgagggttaatgagttaatagatgaactaatatatatcaaatactcggaccagtgcctgttgacaggaaggacggtataacactattgtcattataacctctgtattgggttgtgtctgtccctcactggacatgtggaatgttggccaggtctcctttggattgtcattttgacccagaacctcccagagttaagaaatacctggacaggccaggcgcggtggctcacgcctgtaatcccagcactttgggaggccaaggcaggcggatcatgaggtcaggagatcgagaccatcctggctaacatggtaaaccccgtttctactaaaaatacaaaaaattagccaggcgtggtggcaggtgcctatagtcccagctagtcaggaggctgaagcaggagaatggcatgaacctgggaggcagagcgtgcagtgagccaaaattgcgccactgcaatccagcctgggcgacagagtgagactccatctccaaaaaaaaaagaaatacctgggcgacgagacgtgctatcaaggaggtggggaagttggaactctcctacactgttcatgggaatgtacaagggtgcagccactttggaatggggtagccgtctggaagttcctcagaaggttaaacatagagttacagtgtgatcagcaattccactctaggtatacactcaagagaaatgaaaacatggccgggcgcagtggctcacacctgtaatcccagcactttgggaggccgaggtgggtggatcacgaggtcaggagtttgagaccagcctggccaacatggtgaaaccccatctctaccaaaaatacaaaaattagctaggtatggtggcaggtgcctgtaatcccagctagtctggaggctgaggcaggagaatcgcttgaacccagggggtggaattgcaatgagccaagatcacaccactgcactccagcctgggcaacagagtgagactccatttcaaaaagaaagaaagaaaggagaagagaagagaaaagaagaaagaagaaagaaagatagaaatccacacaaaaactcgcacaagaatagctgtggcagtattgttcatagtagccaaaaaatagaaacaaatgttcatcaactgataaatggagaaatcagatgtagtatgtccgtacaatggactatcattcggccagaaaaaggaatggagtacccatacatgctagaacatggatgagccttgaaaacatgctaagggaaagaagccaggaacaaaagaccacatatgatacacttccatttgtaggaaatgtatagaatagacaaatcttagagtagattaggagttgcgtacattgtggtgctgcaggtaggcgggaatggggacgtgactgctgatggatacagggcttctttgggaggtaatggaaatgttctaaaattagattgtcctaatggttgtataactctgaatatactgaacaccattaacttgtatacttgaaatgggtgaattatatggtatgtgaataaagctattttttatttattttattttatttttttagagatgggatcttgcttgctctgtcacccaggctggaatgcagtagtgtgatcatagctcactgcagcctcaaactcctgggctcaagtgatcctcctgcctctgcctgctgaatagtaaagctatattttggggggaaaagggggaaacagctcctgagtttgggggtgggctcccagaatataccagcttactgaaagcgaggcatcgggagagaggcctggaatctgtttttaacaagcccagcaaatgaggcatcattaagtaggtcttagaaatacactgtcatagagaatacttttatttttcttttacattgtaaagtgggatagggtaggattaatacattttagcttacgtttttgccacaggctaggtgctgtggaaatacagtatcctttgatgacaataatgacagtcttcaaagtgagcggtgtacattcttccagaagtttcgcacttcctgcttctgaagtgcagtgccctagagagcctcagacccatccccagggcccccattcactgcagccactatcgtctctctccctatgcaggtgctgagacagaaataagggctgccagcaccacccagaaactgactatgaaatccccaatgtgtctgaccctttctctttaagactttggtttgcttacatttcattttgttcctgtaagtgtttcttattgccatagcaaccctaatcgatcactggaccaaaaatagctctttcatgttttccaaagcatgtctgtagtgaattggaaattcagttctgccgtgcattttgcatatgctgctttcatttcccgacactgaacctgggagggcttgtgtctggaaattattcttgcagagacccagaaacctcacttgtctttcctggcgttcttcttccccactgcagatccacccgtcacttccaaaagctacaagtagctgcatttaaatgttccaccatcacttttctgcacattgagttttgggtgctggaggttttacaggtaccagaatatcacttttcaataagaggttcatcctggtggattccgttgggtttggaaggccaattatagatgcttagacaccagataaaaggaagagggtcatggcagggagcagatggcagcaacacctataagattcctctggcttacgtggatctaagctagaaaatcaaagatgagatgacaggagagctcctgccttgactccctgacttcttcctaacactgctactgtttttagggggttggggcaaaataaacactggatgtaattaagtgaatattttctatgatgctttctctgctttattctccctgccaagctgtgcctttagtcaagaagagggagagagagataaaaaagaaaagatttttcatgagaaagaggattcgagacctggagtgagcccagaggaggaagaagaggtggagagggacagaaatgactcactgatttcccccaggctccagggacaggcgtgcttttttgcctccccctctgcctgtaagcagagtcatctctgtggcctcaagggttcccaacttctgttttatgcttctgtttcttaacttctttgagccttggttttggcgattgggttgagtgaaccagcggacgtgcaccctttagatctaggaaagaaaagagttcacggagatcctggtagagtttttgttccctgcatgaagtcagcagggggccaagggaaagctcagagaagaggccagtggaaggggcacctgcccagaagaaggagctgccaaggatggagcctgggacacgtggtgacatttcctcagcagcagagcaggtcagggattcagagtgagtctggaagagcccagatctgctctgtggtttggctgccttccttgccatgggaagaagccatcaggtgtcctgtggatgcctttccggaagcctctgcatccttgcatcttcatagtggaggatctgcctttgaccccagctcagctttctcgtccacattgcctaggagggtacaatggagtggaccaacatctctccagcatctgccaggcgctgcctggccctggacattcgttatctcttttcattctcaccccacagctttgaggttgcaattgtctccatttgatagatgaggaaactgaagctcagagggaatcgtgaatttgccccaagtcacacagtttgttggaaaagaagctgcggtttgaactgaagtctgttttactccaaaaatctgtattttttttttttttcctactaaatcatcatcctccctctctgtgggttaggtgcctgctgctgcatctggacaccagataatgacaagcttgctgacatcagttactagtaaatatcaccctgggcaataagcagtggccattgattgacaaagcaggtggcatcataggtggaactaataagtcagaaaaagcaccaattcccccttcccttgcacttgcttgaacctcagagtcggtgatgctttactcagatgaaaaccagatgggtgatttggaagaaggcagccagcaggctgagtgttgtgttggttttctcttgctgtgtagcaaatctcccacaaatttagcaacttaaaacaacacaagtggctgggtgcaatggctcatgcctataataccagcactttaggaggctgaggttggaggatcgcttgagctcaggagtttgagaccaacctgggcaacacagtgagagctcatctctactaaaagtaaaaaaaattagctgggtgtggtggtgcatgcctgtgatcccagctgttcaggaggctgaggcgggaggattgcttaagcccaggaggtcaaggctgcggcgagctgagctatactgcattcaagcctgggcaacagaatgaggctctgtctcaaaaaagaaaagaaaagagaagagaagaaaaataacacaagtttgttatcttgcagtttccatgggtcaggagttggaacccaggctagctgggtccttggctcaggcaactcaccaggtagaaatcaaggcatcaaccaaggttctagtttcaccagaaatgcagggtcctcttccacgctcactggtggttggcaggattcattccttgtggttgaaggacgaaggtcgcgttttctagctggttcttctccggctgtcactctcagttcccagtagacctctcttgggtcctatccacgtggctatctcacaacttcaaagccaacaaaagaatctctgctttttctaaagtgaagtcttgtatacactctcaggagtgactgactgtcttgtctttttgctatcaatcaaaagctgtgctccctctgaaggttctggggggcaaccaggggagtgacagcccatcatatccccaggttctgctcacacccgaagggaaggattacacaggatgtgtgcaccagtggctgggactctggaggccatctcagaattctgtctgccgtgggtttttcagtctttccttcatatgctgtgggccaaatgggactttagacattcagcatttccaaatgactgttccttagagagcacgggatgcttcagcagcccttagacatctttttctgttttagccaatggctgacgaccctagtgtctctcttcttggagcaagttcaggtgtggttacatcagggttcccaacgttttttccacccccacactcctgacagatccctcggtgatatagaatccctccacccaaggacatttatcaggatctttagggaacagcgcatattttgagaaaaagtccagggttggaaagtggggttcccgtctccccattgacattgagaatgactaggttagatggtatattcctagtggaagcaaaagtcttagttacagaaagcattatttgagcaaacctaaactaaaggagatgctttaacacctgaagaagctgggtaaagcggggggggggggtaaagaagaaggggggtgactttgatgaccaccattcctagtggtgctggtattaggggggcaccctcctgttagagtgtgagcttaccacatggttggtgagcctgggacacagatagctaatggtaatggtgacaaaggagatacgcgctgtgataaagggacaaacagaatgctgccagcatgcatgggataatcattccgaagtggtacttgagatggtctttgagtaagatttaggaaagaaatttcgggctgagagtaccatggccaaaaaaaaaaaaaaagacctgacagcaggaagttttccagggaagggggagtggacctacctagatttagggtgggtccaaatccaatgacttttgtccttgtaagaagagaagagagcacagagacccagagggaagaaggggatgtaaagacggaggcagagactggagtgatgcacccactcccggtgccaccaacagctggaagagacaaggacagattctctcccagagtcttcagaggtagtatggctctgccaacaccttggtttcaggcttctggcctccagaactgtgagagaataaattgctgctgttttaagccacgcagtttgtggaattggctacgataattctagagtaccagtacagtcagggagaacattcgcgttcattctggacctttcaagtttgatgaacctgtagggtctttgttggggatggccagtgggcacctggaaatgtgagaggagttggaatttgcgatgttgatttgggaggcatctgccaaaaaagaaaaaaatcatgaaaagtcagaagcagatgagatcaccaggggagagggtttggatcaagaaaagaggctgtaggtagggtaggacctgagggatctcctgtagggaaggagtggaggagggaggaaagggtgaactgctgctcaggatggaggagttgctcagtcatattgcagtgtagagaggtctccagggtgcaaatggaagagtgatgctgctttggaaatcctttgatgatcaggtgggaggtggaaaaagtagagacaggaagcactgaaactgaatactcttttttttttttttttttttttttgagatggaggcttgctctgtcgcccaggctggagtgcagtggcgcaacctcagctcactacaacccccgcctcccgggttcaagcgattcttcccgctcagcctcccgagtagctgggattacaggcatctgccatcatgcccagttaattcttgtatttttgtagagatgggggtctcaccattggccagcctggtcttgaactcctgacctcaggtgatccacacacctcggcctcccaaagtgctgggattacaggcatgagccaccatgcccggctactgactactcttttaataagtttttttatgaagacagaaagagatacggaattgattatagatgggggaagaaataggatcaagggaactttgtgcttatttattttttaagactgtgtctcttttcattatatttttaggctgtgggaaggaagcagggaaaagatgcaaataatcaatgaaacaaggttccagagaagagcttacaaataatttgtactgtgcacctactatgtgccagtcactgtgctggggtttagctgtgtgatctcattgatcttctgaacactcctacagagcggaaaaggattgtccccattctccacctggggcaactggggctgagaacagtaaaataacttgcccaggttgatacatcttggatttgagcccaagtcagctggctctgatgtctcagtgcttttcattatattatttctccactgaaaaagaggaggatatatctttctcggattcacaaagaataagaaacgtaaagaaataagcagatttgtaatggaggaaagggatgtgtcagtgtttctatcatgcagttcatgtcctcattaaactatgactcaaagtgatcagctgcaagggagaggggagaaagggtgaagccaggcaagggaccttgagagggtaagggatgtaggatagatcagtggatgagatataacagggagccaatcaggaagaaataaaagaccttgctttaaagctaagcttccgctaggattagtgggctggatttttggagaaaccagcctgcatgggggaggcagaaggttatcttaacatggacatcacccctgagagatttcagtgacggcactgaagaagcccagagccacagataattctgattttaactcaagacacccgcacaccccaggactctgagaacgagtcatcagacatcccaaggggattatcagccccaaccacctgccgaaggagaaagtactgacccgcttggagttaccaggagctgttctctggccaccctgctgaagccaggtgcactactcctagcctcgtggcaaggttgccattctgatatgaaaataaccaaagtccccactcaaaaataacaacatctgctaatttgcatgggagttttgcatttcataattgggtttaatacgcaaatgctaaaattcatgtgttgggctagctaagtggtttagaggttcagtgggtaaaaactcctcacagtgttccactctggtgcaccgagacccacacccacgctccacaactctgtactctccccactccttggtttgactctcatatgaattatgggataaaaaatacaaaatcgatttacctaaaggcttgtcgtgtctaagagggtctcagccagggcatccccccacgttctcatgtctgctttggggctctgagtcctccagcgtcttcatttgagatgagcagctgctccttggtgctacctgaacccggatataagggcagcggttatggagtgagaagtttgagaggagacagcagagagggtgttaatgaataatcgcagggccttgttctccataaaggcaattactgggattgattgtttccgtgtttccttagtcacggttcagatcccttgtttcactcagattaagacagatgcgtgctgaacgcgtcctggcatgtgatgtcaggagaattatcgatggcacgtcccaggcctctgtcttctcgtgcaggtgccaccaggggtctcagctgggctgaaaggggagcgtggtcattgtgcggctgaagcatgtgtgtgctatagccaggtggttttccaggttgagcatgcctcagcatacactggagggcttggtaaacagattgctgaaccccacctccagagtttctgatttagttggtctgctgaagaatttgcctttctttctttctttcttttctttctttccttctttctttctttctttctttctttccttccttccttccttccttctttctttctttctttccttccttctttctttctttcctttttttttttttttgagactgagtctcactctgttgcccagactggagtgcaatggcatgatctcagctcactgcaacctccacgtcccaggttcaagcgattctcgtgcctcagcctcccaagtagctggaattacaggggtacaccactacacctggctaattcttgtatttttagtaaagacggggtttcgccatggtggccaggctggtctcaaacccctgacctcaggtgatatgcctgccttggtctcccaaagtgctgggattacaggcatgagccaccgtgcctggccaagtatttgcatttctaacaattctgggctgctggagctggtccagaaactcctctttgagaaccactcagtatggtgaagagtatggacactgagacctggccacctggctgcatgagactgtaggccatttacttaccctctctgcacctccatctcctcatctttaaagcagggggggatggtaatagtacctccttcacgggattgttgccaggaataaatgagtgagagcatcagagcatttgtagcagtgtctggtatagacagtatgtgagtactggaatcatgtataagggatccagcctcttgggactgtgatgctatcaggccaagtctggtttccccaacacccacagatcccaatgcaggtgctgggtcattttgcccattagccgtcaatcccatctctggtggccaagaaagttaatgcccagcttagggctagctagagcgtggttacaccaacatccatcaaaattctcttcttaagccaccttaacccttcacatctactgaatgcataggacttgactcagcgagactggggctgtagggctgggttgcatttggggtttctgtccctcgtgtggacaaagacaaagacaggggctgccttttctggttcagtttctacccatggatgctgtctgctgaatgcattcttgctgcccagtattatacatttttaaaacatcattttattaatatttaaccctcacagtgttgctcttaggtaataattattactcctgttttaactctgttggggttcagagaagttaaatgacttatccaaattacatattaaaagccaggtctcgcccggatgcagtggctcatggctgtaatcccagcactttgggaggccgaggcgggagaatcgcataaggccgggaatttgagaccagcctgggcaacagagagagacccttgcctttaccaaaaaaattttaaaaatccgccaggcatggtgtcacacacctatagctgtagtcccagctacctgggaggctgaggtgggaggatcgcttgagcccataggtcaaggttacagtgagctgtgactgcaccactgcaccccagcctgggtgacaaagtaagactctgtctcaaaaataaaaataaaaagaaggccgggcgcctgtaatctgtaatcccagcactatgggaggccaaggtgggcagatcttttgagctcaggagttcgagaccagcctggctaacatggagaaaccctatctctactaaaaatacaaaaattagccgggctacacggaaggctaaggcatgagaatcacttgaacctgggaggtggaggttgcagtgagccgagaccacaccactgcactccagcctgggcgacagagcaagaccctgtctcaaaacaataaaaaataataaaatttaaaaattaaaaataaaatttaaaatttaaaataaatttaaaaattttttttattttactttaaaaataaatttatgttttaaaaattaaaaataaatttatgttttaaaaattaaaaataaaagccaggtctgtctgacttcaataatctatgactttaaagttctactatatccccttgctaatgttatatgagcatttatataaagattaaggctgggtccccaggaatccagcaatggtagctgctccccaaaagtaagctcaccagaactggaactggcgtgatttaggggtttgcttttctaaagcttatgctaggagtcacagaacatattccttttggaaatgttctcttcagggacttgccctctactgctggttattctctgtggcctgacctctgtctggatgaaactgtgttcattgtcctaaaggcggctttcctttgtctgaatttggatattgacttagtatcttaacatttctgttccgggacggtgcttgcaaccaaatggccaggaaagtattcagaagctctgctgaatataggaagagagaaaaaatgttatgctaatgaaaatttgcttttctcccacagtgttcctttctgccgaaattctccattcatatagaaaccaagtatgaggacaacaaaggaagcaatgacaccgtgagtagcccctccttccatgctgcgctcgcctcgtgggctctgaatatcacagcacttctcacagcccctctgtgaccagggccagcagtgggacctgtgcctgggacctcagagatgttctggcctttggcttctgagggttatttccctgggacttttccctggaattcttttgttgtctagcttttctttcttctcatttttatgtactttccctgggcctctgagcagaagcctctgacctggggtgattgtcatggaggtggagaggatgacagggcacttggaactccaagatttggtttttgatcattggacagagtacacatcttctcaatgcctattaatatctacttcggaaagggaatacaatcaaagatatgtgtacacagaaaaggaaatacagtcagatgtatgtgtgaacagaaaaggaaatacaggcctggtgcagtggctcacgcctgtaatcccagcactctgggaggctgaggcaggcacatcacctgagatcaggagttcaagaccagcctggccaacatggcgaaaccctgtctcgactaaaaatacaaaaattagctgggcgtggtggtgcacaccagtaatcccagctacttgggaggctgaggtaggaggattgcttgaacctgggaggcagaggttacagtgagccgaggttgcaccactgcacttcagcctgggccacagagcgagactccatctcaaaaaaataaaaaaagagaaaaggaaatagaatcagatatgtgtgtgcatactgcatgcatgcttacttacacacatgcggtgtatgtatacacccacacatcctaccttaaaatcagggggtacccccacaaaatatttacctcctgaggcattctgacttttactaaatttcagccaagtattttgcttattagtgttgggtaaaacccatcttctgacctggcttttacccccaggctctttctgtttgggcagtaaatttctaacttctcttttctttgggggtgactgttttgacctaccaaaagcctcacctgggattaggctgtgggttccctcaggacccgttgaaaggaagaacctggatctagaagcttcggggcttccccagagttcatggaacttcccagaggagagaaaaatacagctggcagcagtactatcctaccactctgttcaggaaccccatcgttagtgtctccttgaagtggcagcccaatgggaaatgtttagggccattttcctgtcacagcctgaaatcacaggcgcgttgctggccaaattcatcaaaaccaccatgcctaaaacagtgtcacactgtgtttcaacttgaatccttgtaaaatagtgattttttttttttttttttttttttttttctgattagaaagcagcctgggcgcggtagctcacgcctgtaatcctagcatgttgggaggccaaggtgggcagattgtctgagctcaggggttcaagaccagcctgggtaacatggcaaaaccccatctctactaaaaatacaaaaaattagccgggcgtggtggcgcatgcctgtaatcccagctactcaggaggctgaggcaggagaattacttgagcctgggaggcagaggttgcagtgagcgcagatcgcgccactgcactccagcctggcaacagagcgagactctgtctcaaaaaaaaaaaaagttaatacatggctattcaaacttggagaatgcaaaaagaaagtattgaaaaaagaaaggaaaaaccaatagcaatcccacaatttagagatgacttctgttagcaatttggttcatgttgcagattatggacaaatttattttttaaccaattcctcctgaattgaatcatatagtatgttatttttaacatgccctgaagtatgcttccctataatgatttttcctggctgtaccaccttccatatttcagtgtacttctttaaacaattgctggtcactggatattgaagtaagcttgactcttttcacgtagctgtggactctcatgaaaaggataataaagttcagttgcttgaattgcttttcctggcataatatgaaaatatgggggaattttttttttctttataagacagggtctcgctctgtcacccaggctggagtgcagtagcacgatctcaggtcactgcagcctccacctcctgggctcaagcaatcctcccacctcagcccccctactgggactacggcacacacaaccgtgcccagctaatttttgtgttttttttagagacgtggttgtaccatgttgcctaggctggtctcaaactcctggactcaagcaatctgcctgtcttggcctcccaaagtgctgggattacaagcgtgagccaccatgcctggctggaaaaaaattttttaaatatcttttagtctttccaaacaaatttccttgctttctctctttttctctatgcctctatctccatgagtttattcaaaacagctctccatttgaagaggtgtagagaggccaggtgctatggctcacacctataatcccagcactctggtaggctgtggtggacggatcacctgatgtcaggagtttgagaccagcctaggcagcatggtgaaaccccatctctgcaaaattaaaaaattagccaggcgtggtggcacacacacctgtggttgcagctacctgggaggctgcagtgggagaatcgcttgagcccaagaggtcaagcctgcagtgaaccatgtttgcacctctacactccagcttgggtgacagagtgccacctaaaaataaaaaagaggtgcagaggggacacgtggcctcactgtgatccctatagattggtgggaccactgtaatctggtttatcctctgcccagttcaaatcatccccaaaattcatatggttattgtgtattattatacatccttttttggcaggtgctcaggttttttgactactctcctaggaatttaaaataacaggttatccaccttacaatcaggatccaggcccatgccaagggccaggcccctttgagacttaggctgggctgcaagagaagcacctatcacctattcactctgtgcagtccttggacacagtttgcttcctctaggagaaatctcagctgttgtagcctggcttgcctccctctccccagaatgtggactctggaactgcccaggggacctgctgcttgtctgcctgtcatggcacccaacttgcccaagccccagtcctgccatcttgttacactaaagaggccctaaatgtgtttttggcccagttgccaccccctgccccccaggctctgcttgaccctgctccacggaccccaggtcttgctcctgaggccattggaccacacggcccagccccacttcattagacttctttgccaatttgccctcctctgttttacatattcagcggctgttggttgtccagcagattcaaagttggtcccagaaaggcagaaaaggagcgttgcgccgaggcacggtggctcacgcctgtaatcccagcactttgggaggctgaggtgggtggatacctgaggtcaggagtttgagaccagcctggccaacatggcgaaacctcgtctctactaaaaatagaaaaattagctgggcatggtggcgtgcacctgtaatcccagctactcaggaggctgaggttggagaattgcttgaacccgggaggcagaggttgccgtgagcagagattgcgccactgcactccagcctgggtgacaagagtgaaactctgtctcaaaaaaaaagaaaagaaaagaaaaggagggctgcatccgtttccattcatacttgttaatacttcaaaatctgaacataagaagtatatatttatctaacaattctttaattactaaacgctagctttatctagccagggattcaaaactggtgttttaagccaaggagtgtgctggtgtgctctttttctgtcctgggttgagtgtggagtttttggtgggaggcagagttgctaaggaaagcagtgcagtagtggataattctcttgtctcaccgcgtttccaaactatttaataaactcagttcatttctttgcactttctgggtgtacactcttatcattcagctaccatccttcatactgctatctgcactgtttcctcccctacctgccaaaaatttaatgaaattgatgacgataagaagcaataattaaattgaaagaggctgctgatagtcatattgatgatagtggttgaatcgagtacatgttgttatcctattatcaattaccatataagtaattttttgacgtgacccaatatctagtaaaaaaaaaaaaaatagtggcagtatgagtaaatatcttccttgttaaaaataaaaccagtatacgtatgattgtgaaaacctgcaaactgtgattacattaaccaggatgcaatggggaagttgtcttaaactgaggcccatttattttatgcacatacttatgagaattacttgggccttcattcgtgctagggaggacggcaccgtgccaaggtaaggttccgttgtttatccaaggccataaatctaggcctgtgagagtccgtgcttagcactgcctggttcagctgaatgagaggctgcccatgtggtgacggctgccaggttactggtgttcaatggggttaatgggggcagccttgctactttacttcctcttccaaacaaagcaggcaccatttaaagcagtggttcccagccttggctgcacattggattcacctgagaagttttaacaactcatgcctgggtcccagcccctgggattttatttaatgggtcctgggcgcaggctggtctaaaccagccaataagcatgaaggacagaacactcacttccagaacaccaaattctccagctggcagtgtgtgcagttttagagtctaccctgaggctgaacctgatatgttccctcaggagacattggctatgctgtccccacccctgagagggtctagaccagcagttctcaatcacagctgcctattaaaatcacctgggccaggcggggtggctcacacctgtaatcccagcactttgggaggccgaggcgggaggatggcttgagctcaggagtttgagaccagcctgtccaacatggtgaaacctcgtctctactaaaaatacaaaaattagctgggtgtggtggtgcatgcctgtaatcccagctactagggaggctgaggcaggagaattgtttgaatctgggaggcggaggttgcagggagccgagatcacaccactgcactccagcatgggcaacagagcgagactccttctcaaaaaaaaaaaaaaaaatcacctgggaagatttagccatcactgatgctgctgtcccagccctggggattctgatttcattggtctgaggtggggttgaggcattgggattctttttttttttttgagatggagtctcactctgtcacccaggctggagtgcagtggcgcgatctcagctcactgcaagctccggccttccaggttcacgctattctcctgcctcagcctccagagtagctgggagtacaggcgcccgccaccacgcctggctaattttgtgtgtgtgtgtgtgtgtgtgtgtgtgtgtttgtgtgtgtgtgtgtttgtgtttagtagagatggagtgtcactgtgttagccaggatggtctcgatctcccgacctcatgatccgcccgcctcggcttcccaaattgctgggattacaggtgtgagccaccatgcccggccggcattgggatttttacagttcccccaggtgaatctaaggggcaacaagactgagaactatagatttaaagaaatagtaagtgctatttaaaaccaacacttaggaaaacaaatgttttcactcctttatactcctggaaaataggacagtttacaaaaggcatatgtaaaccccactccattccactcccactcacacaataaaaagacctgggtaacatatgtgttctcattagccacatatcaccaaggacattatttcttggcaaagaaactcctctgataaaatgaagagaatgtccagtttagttcctggaaacatgaagctctgtctttcacaggggtctccttggaagctgcctaaaagaagtgtctggaatgtatttcatttctagctcctctgtgtggtaatgaaagaacacaaagttgttctttgtgaaacagaaagatcagtattgaagttccagttatcaccataagcctaaggcttggtttctttatttaaaaaaaaaataggataaataatgcttccatcagggtgtagaggatgcatagaggttcatttacatggaagcacttcataaactgtgaagtgccatgcaaataagagacatgattactgtgatggccacacctcgggattaactgcactcatgatgatttcccaatgagactctgattttgtctcaagtgtcaatgaaccatttgctgttcaacaagttttgagcacctactatgtcccaggcattaggagaaggatcggggatacagcattaagacaaaccagccctccaggccggttgcagtggctcacgcctgtaatcccagcactttgggaggcagaagcagccagatcacctgaggtcgggagttcgagatcagcctgaccaacatagagaaaccccatctgtactaaaaatacaaaaaattagctgggcatggtggcgcatgcctgtaattccaggtactcagcaggctgaggcaggagaatcacttgaacctgggaggcagagattgcagtgagctgagatcgtgccattgcactccagactgagcaacaagagtgaaactccatctcagaaaaaaaaaaaaaaaaaaccagacaaaccagccctccattaatcatggagtaggggaagcagataataggcaagtaaacaaacaaaagaattgcagctgtgctaagtgctaggaaagctataaacagactagagggagctcagcctgaggccatgtggtcagaaaggcccctcagaagacacaagtccacttgaggcttgagtatgggaaggagccagccctatgagatatatgttcccccaccccaggttcatacgtggaagctttagaatgtgactgtgcatggagacaggacctttaaagaggggattaagttaaaatgaggccattagagtgggtcctaatccagtctgactggtgttcagataagaagagaacacttgggcacataaagagactctaggctgggtgtggtggctcacagctggaatcccagcactttgggaggctgaggcgggcggatcgcttaagctcaagagttcaagaccagcctgagcaacgtggcaaaaccccatctgtacataagaaatgcaaaaactagccagatgtggtggcacacacctgtagtcccagctactcaggaggctgagatggaaggatcacttgaacccaggaagcagaggtttcggtgagccaagatcgtgccactgcactccagcctgggtgatagagagagacgctgtctcaaaaacaaacaagcagactctttgggtgcaacacgtgaagacgtagggagaaggcagccatccgcaagtcaaggaggaggtctctgaagaaatcaaccctgcaggcacattgatcttggactttcagcctccagagctgtgagacaattaattagattttgttgtttacaccacccaatctgtggtgttctgttatggctgaccccacaaactaatgcagggagcaaaggccctggaccctaacacagcctcacatattccaggaactgttggaaaaccactggctagagcattaggagtgagaataagtagactggcaggaactgaggttgaaaatgtagtaaaagctagatcacgcaagagctatggggccatggcagagtgtggatttcagtgcagtgggaacttattcaaggattttaaacaaaggaataacaagatactgttcgtggagttttttaaaattttttatttggggataattttaaatttatactaaagttggctgggtacagtggcttattttccagcactttgggaggctgaagcgggcagattacctgaggtcaggagtttgagaagaccagcctggccaacatggtgaaaccctgtttctacttcaaaaaaaaaaaaaaaaaaaattagctgggcgtggtggtgcatgcctgtaatccctgctactcaggaggctgaggcagaagaatcacttgaacctgggagacagaggttgcagtgagccgaaattgtgccaccgcactccagccggggtgacaagagcaaaactccatctcaggaaaaaaaaaaatgtatactaaacttgcgaagattgtgcacagggttctcaaataccctctacccagtttccccttacctaaccatgattccactgccaaaactacagacttcattcagatttcaccagttttcccaataatgtacttttgcttctgttccagaatccagattaggacaccccattacattggttgatttatgttttaaaatgtttgctctggctgttctgtggagaattagtgaaaggcaagactggaagcagggagtccagttggtaggctattggaatgatccagaccaagatggtggtttgagctggaaagatggcagaggataaagaggggaggaagggatctattttgaaaacagagtgactttctgttagaattgatgcggggcatgagaggggaacaaaatagggatgatctcaggctttctagctctgcctagtgggcctgggtaagtggtggtgccattgccatcatgggaaacagtggaggagaagcaggttctgagaagaaaagcaagagcgccatttagtcatgatgactttcagataccaatgagactgccaagtggaaatgaggggtaagaagttggatattggccaggtgttgtggctctcacctgtaatcccagtgctctgggaggtcaaagcaggaggatcgcttgcacccaagagttcaaggccagcctgggcaacatgttgagacccccatctctacaaaaaaaaaaaaaaatttaattagctggacatggtggcacacacctgtcatcccagctactcaggaggctgaggtgggaggatcgcttgagcccaggcagtcaaggctgcagtgaaccatgatcaagccaccatactccagcctgggcaacagagcgagactctgtctcaaaagaagaagaagaagaagttgcatatgcatatgaatctggcattcagagagggatgtgggtcatgatttttatctagggagaggagtgacagaaaagagaagtttctagatgctccgagatagagattgcccaggtcctaagaaggaccttctgatggcttccaggtccagcttctcgttgttatctttattccttggttaagactaattttcaatcactgggctgtgcttggttttaggaaataaacgatctcattaatttaaccacaaagatttacttagagagatctaatttctccccctgggtgcctccttcgggtaaattgcataaacatctcaatgtcttgactgggctcaacttgcatggctttggagagaaatgttctcttcctgactacaagtagcttcccctggaagttaccagctgacaaagagggaattttagcatttcaggagagctgtatttattgaggcttgctatgacaatagccatcgtgaagtttgttttctttcttttttattttttgaaacggagtctcactttgtcacccaggctggagtgcagtggcgtgatctcacctcactacaatctctacctctcaggttcaaacgattctattgcctcagcctccagagtagctgggactacaggtgcgcgccaccacacccagctaatgtttatatttttagtagagacgggatttcaccatgttggccacgctgatcttgaactcctgacctcaagtgatctgcccacctcggcctcccaaagtgctgggattacaggcgtgagccaccgtgcccagccgtgaagtctgttttctaattagcacagtagtccctgcttctccgaggtttcactttctgcagttttagttccctgcagtcaaatgcagtccaaaaatattaaatggaaaattccagaaaagaataattcctaagttttaaattgcatgctgttttgaggagcaacatgaaatctcataccgtcctgccccaccccacccagggcacgaagcctccctttgtccgtcaactctgctctgtatatgctacacgcctgttagttacttagtagctgtctcggttatcacatcaaaagaaaaaaaatagagcgtgtatagagtttggtactatctgaggtctcacacatccagtgggagtctcagaatatatccccctcggccaaggtcggggacaactgcatttgtatttgtaactccaagaggacaacatagatggatggatgttaacacatttcaaaatgtactaaaattaatttgtaaagcaggagtgccagtgggaactgcagaatccatatttacaggtctctggagctgattatctcttccttaaatggcttctaattgaggattacagaaagaaaaaaagcatttgctttatttttagacgtgatctctgatgtcttcaacttttatcgttctgtttttaaccttagattattataaccagccacctacaaaatctgcaattttctctaataagtcagcacctgttaaaaaggaggttgcacaaaacactcccatttgcagtttggaaggattattatctgctttggtctgtgaagtggaaagtcaatgttcttattcaatctgtgtctaatggtgtcattttgaggacaatggaaaacagatcatgtttgattccttaagatgtggccactgctatttgtggtacaatttgtgatctgagagctgcatgtaaaaaacacatgagcaaaaagaatatccagcacacaagggctggctttctgattctcagaggtatagtgacaacacagcttacctctgcattcaaagaagctagaacttaccgcggataatcattagtagaagacagcttaaagtagtgtctgctttctggctaggcctgattcacaggtgctgtgataaattcaaaaagacctgcctcctctgatgtgctagtatcaagggtgagggagacagttaaccaaactggtcaaaagcattgtcagcaaagacctggtgctgaatcatgttgggaaactggagtttggagctagagaggcaataccaagtatcaaggtctgaatgtccactttgtaaccactgtagtaataattgactcaaaaaaaaaaaaaaaagccatcaatggatgctaagaccgttgagcaaaacaagtattgggtacaggatatatcaccaccaatgctgggtgtgttagctcacacctataatctcagtactttgggaagccaaagtaggtggatcatctgagttcaggagttcgagaccagcctggccaacatggtgaaaccccatctctactaaaaatataaaaaatagccagacgtcatggcacatgcctgtaatcccagctactcgggaggctgaagcaggagaatctcttgaacccaggaggtggaggttgcagtgagctgagatcataccactgcactccagcctgggtgacagagtgagactctgtctcaaaaggaaaggaaaggaaaggaagaacaggaaaaaaaagacatgcagagaggacaaaccagaaaataatgagattggctacctacagtgggggtgtgtggaaacggggtagagatggtgagagaagcactacctctgggagtatacctttttgaatcattcaacttttgaaatcatgttaatgttttccccactcaaaaataatgaaaccaaatcaacagggattaggcagggggttggtggggtggaagatactaaaatagaattaaaacgaaataaatgaacctaactgtattttaaaagaaataaaatagccacactgaaaaggagagaaaaagacctttcccaaggaattctcaattacacagcactctgactatgtatcctcagtcggaagacaataagaattgtaaacaaatactgaattctaagtaataagtttgtttcttactgtagtatgggctaatactactgaaactattttttgtgtaatttaagtttgagcaaatacacaaccctagggcctacctgtagaagaaaatcaccatttgcaactatcataatagtaattgatttagtagtaaacatcattgaatgctaaaactagtatgtgaaaagtttgatgaggaacaggatatttacatggactaagagtatttctctgcaagtgacttactaatggaaaatggaaatagaaataattttacaatagacagccaggcacagtggctcacacctgtaatcccagcactttagcaggccgaggtgggtggatcacctgaggtcaggagttggagaccacggtgaaaccccatctctactaaaaatacaaaaagattagccgggcgtggtggtgggcacctgtaatcccagctactggggaggctgaggcaggagaatcacttgaacctgggagatggaggttgcactgagccaagaatgtgccattgcactccagcctgggcaacaagagcgaaactctgtctcaaaaaaaaaaaaagaaagaaagaaagaaagaattttacaatagacatacctggtgtataccaccttaaccaaatgtctgtaacgttatcaatcctggaacaaactagcatcagaaatgatatgatgtgctgaaaaagacgcatcacctctttagtgttcttgtcaaaaacaaacaaacaaacaaacaaacaaaaaacccataagctaaatctaatcataaggaaactttacacaaactcagattgatgggattctataaaatagctggcctgtactctccaaaattgttgaggtcatgaaagacaaagaaaggctgatgaattattttagattaaagaagactaaagagatgagactactaaatgcagtatgatcctggactggaacctaaactggagaaaaagagcccaaaggatattactgggtaatcggcaaaatttaagtagggactgaggattagataatagtattatatcaatgttaaacttcctaattttgatcgttgttttgtaatcaggtgagagactgtctttattcttaggaaattcaccctgaaatatctagaggtcaagggacatatctgcaatgttttctcaaatgtgaaagacaaagcaaaagaagcaaatgttaacggctggagaatctgggtaaagggtgttcagggattttctgatatttcttgattttttttatattcttgcaattttttgacatgtttgacattatattaagatttaaagtcacaattatttattgatttaaaaatttttttgggagacagggtcttgctgtgtcacccaggctggagtgcagtggcaccatcacggcgtactgcagcctcaacctcctgggctgaagcaatcctcccacctcagccttcttagtagctgggactacaggagcacatcaccatgcccagctaattttttttttttttttgtagagatgggcatctcgctgtgttgcccatgctggtcttgaactcctgggctcgaatgatcctcccaccccagcctcccaaagtgctggcattataggagtgagtcaccacacccagcgcaatgattttttaaaattaaaattgaaagagcaaaaaatggtataaggaatgtaactaaagataaaagaattttgttataggcagacagtgtgtctaaactgaaaacctaagagaatttacaaattatcttaaatagaatactaaatagttaaaatgatagcaaaatgattatgttcagaagggttactggctatcagatcaacttacaaatatcaatgatattccatatatgagtaataattagaaaatattaatcccatcatcaatagcaacataacattaaggtacccaagaacaaatctaacttttctagacgaaattattatcaaaggacctaacaaagacctgaacaaattataaatactccatgtgcatggagcaaaagactaaatactgtaaagaaataagtgatttcctaaatcagtctccaaattaaatgtaattccaatcaacatctcaacaggattgtcataaattgtaaaatcagatggaaaaataaaagtcaaaagatagctgagacaaattttgaacaaagaacaaggaggcgaagttcatcatatctgataacaaaatcatatgaaagaatgtggtatttgcacaaagatagaaataaacgtaagctgatcatgtgaatttgatacataatagataatgtgtctccaatcagtgggaaggaaagataactttctcagtaaatgacattaagtgagttgacatttcatagggaaaactaaaataataggctggacacagtggctcatgcctgtaatcccagcactttgggaggccaaggcaagaggatcacttgagtccaggagttcaaggccagcctgggcaacatagctagaccccatctctgcaaacaataaaaataattagccaggcatggtgatgtaggcctgtagctccagctacttgtgagactgaggcaggaggatcacttgagcctgggaggtcaaaactgcagtgagtcatgatggcgctactacacttccatctgggcaacagagaaagaccctgtctcaagaaaaaaagaaagaaaagaatggatccctacctcactccatattcaaaaataaattccaaaagtgtttacaaacctgaccatggaaaccattaaaatcatttaagaatatcttatttatggatgcagatgcatttatatgttacataaaatacaaagtttattttaaaatgtggactaagttcacaataaatttatgatagctgtcagccaggtgtggaagaggaagggatttcaactataagtgtgaaattttctcttttttttttttttaagtagggacagaatcggaatcaaatatgacaaaataattacatatgtttgactggtgggtagtggctgttttttggctttttgattttttgttttgttttcttttttagatggagtcaccctttgtcacccaggctggagtgcagtggtgtgatcttggctcactgaacctctgcctccagggttcaagcgactctcctgcctcagcctcccaagtagctgggattataggtgcatgccaccacactatgctaatttttacatttttagtagagacgaggtttcaccgtgttggccaggctggtctcaaactcctgggctcaagcaatctgccctccttgaccttctaaagtgctgagattacaggcgtgagccatgttttttatatgattttttatattcttgatattgatcttttgagttttgaaaaagaaaatattcatctgagtcttctgttccatgaaactcaaacctctttaattctttgtgatccactgttagcctcagtcactggctctgcagttgtttcccaaatgtttggctccttttccccctcataattactgtgggaatacagtgtacgtcacttaaaaaaaataaggcacagctttgctgtttatttacctagagctttgtgtttatgtttgttgagtccagtggatggtgccttggtgggtggattgctcatgacagaggatggacagcaatcttgggtcgtggagcattttggtggagaacacttgaggaatctgccaaaagctagcagctggtcaggcccagttagtaggattctgtactagaatcagagaaatcaccagccttcgaccaaatagggtccaaagcagggctctgcagccaagtgataacgggacttcgctgttctgaacttccccagctgtgtaaaggggaaaatggcacccacttcagagagaattgagaggatgcagtgagatgctgcatgtcaaatgcttcataaaccatagttctcttttctctttcacttcagttatacctcatgggaaccacttcagagtggactcttggagatccacaaatggggaagtcagtgtaacttggggagtccaagttctcacgtttctgaagtctgcagtccctattcctttttcaccacccagaggcatcctcagacatgagttgataagtcacgtctccagggacttttgagttcactttttcaaagtggagaaaggagtggttactggtgcaagcagcagaccctctgccttgtggcctcctgcttggaggttggggattctggtttcagacacagtccttccttgggttttactcatctgtaagggatcctgcttggcacagctctgttccaagaggtgagagccatctatgctgttgttcccagttaatcatcaacagaaccgtggcagaatggagacaggatgaagactgtaggcactagagtcaaaccaggtgtctttgaatcccaagtcaactccttagcagctagttaagtcatgttacttcacttccgtgtgcccctgtcaaatgagtatcatgatagttcccactcatagggtacttgtgaggattaaatgtgttaagcctgaaaagtgcacagaatagagctttgtacacattttagacattcagcatgttttaacacggccattgtttttcatgttttaacaactttacaaatgaaacgcatattagagttgatggcatgttacaattacaagtggcagcattttttctttttcggtggtatagttggtggcatcttagaatcaatgaattaattcagcatgatatctccttttgcataggatattgagatgtacatcatgagtgcatttcagtactgaatagtgtttgcatatcaaatgtgaacactgaactgaattctgccaaagtcaagtcattgaataataagctattcagttgttcaggcctggaaggttgtttgttaactttttccagggcactggctggcttcctaataatgcaaatgacttgatagaactctgaaaagggaaccattgaatcttcttccccttggacatccagagccatcatctttataaaatggatttcttactaaaaatccctggatgccatctatctgatacaccttcaaggacaaagtctcagctagtattttagtttttttttttttttaatgtggggcaaggggataataggagctgagcttacagaaaagaagttaatgatttccaatggacatgatttcaaagcaatttctgccttttgatgcgctgaaatcattgcttccatctgctcccctacttgtacacagggctctgctttttaaccatgcagtgtgtcagctgttgcccaccaaattctgcacttgatcttctgagactgatggcgattctctatgaataatattaagctattaaatcacatttaaatcctatttctccactaatacctattgaaggcctgtttatattccatcagatttttatggccatttggtacataaatttgttaaatataaacttcatggagcttcatctgaaaatgtttcatcttgttcccagtcctgtaaagacatggtcataaatacctttggactatgcaaaccattatctagagtaattttaattatctttagctatgccgatcagatgataataaatagatgttgaaaagcatcagcaaaatgccatcatggaagagatactcaggggtaaaaccaaataattgaccatttggtgctgaaacattttattatcattcctacaaaggttcagaaatctatcatgagattgggtttgttatgaactcaacatcaccttggttgggatgtcaaaactagagtaaattattgaaatgaaatatgaaacatattaaggaacgtcctcgggaatgaaggacactggaaagactgaattttctagtaacttaatttcgatctatgggtgaagctttgttttcagcacccagctatatttgcttggaaccatctgggtctcttggaatagataatgttaaaccagatacactagttgtacacgtggtatgtctttattgggggcttttggtaacagtttaagatagaaaaaaaagtattgctttaaaaaaaaagtgatccttggtactcacgggtaacaacattctgctttggctaagagtttacgtaactgcatactgttccctatttctttgttgttgttgttgttttgtatttttgttgttattgtttttcttttgagatagagtctcgctctgtcgtccaggctggagtgcagtggcccgatctcggctcactgcaacctctgcctcctaggttcaatcgattctcctgcctcggcctcctgagtagctgggattacaggtgtgagccaccacgcctggcttgagagatggaagatcagactcgatttgctcatgttgttcctaacctttattctaaactgataaaaatgtaaagtcatctgatttcaagactgattgttcccttgggtgttccttaattccctagaggccgagtaaattcttatggtttaaaggctcttcccccttgcttttctatactcccttgggtttgtttttaaaatgatagtgttctgaaccaatttttttttttctttttgagacagagtcttcctctatcacccaggccgtagagcagtggcacaatttcagctcactgcaacctccacctcctgggctcaagtgatcttctcacctcagcctcccaagtaactgggactataggcacttgccaccatgctcgcctaattttttaattttttgtagagatgaagtcttcctatattacccaggctgatcttgaacccctgggctcaagtgatgcccccaccttggcctcccaaactgctgggattataggcatgagccaccatgcctggccccaaataatttatataagccatttatcatagttcctgacatatcatagatgttcagtaaatatcaattatcttcctcaggctgagcatggtggctcacgcctgtaatccccgcactttgggaggccaaagtgggtatcttacttgaagtcaggaattcgagaccagcctggccaacatggcaaaaccccatctccactaaaaatacaaaaattagccaggcgcggtggcacacacctgtaatcacagctactcaggaggctgaggcaggagaatcacttgaatacgggaggtggaggttgcagtgagctgagatcatgctgctgtactccagcctaggcgacagagtgattgagactccatctcaacaaaaaaaggaaagaaaaaaacagttatcttcctcaatccctttgtgttaagttcctagtggaaatttgagaagtcctttattttacatttaaaagataggatgcttttaatggtgccttaattcatcgtacaagaaacatttgttaaacatctattcggcaccaggggttgttaggctggtggaagggacaggtactctcattgcaaggcagtggggtaggctctatggagaacacatgctagagggtgagaatgggtagacaggcaagatcgtgatgcagggagagactggtagagaacacaggagatttttgcagtagatcagatgatagagaatgcagcccgagatttaaagcagtgacagtagaaatagagaggagacgctgggtgcggtggctcatgcctgtaatcccagcactttgggaggccgaggcaggcggatcacgaggtcaggagatcaagaccatcctggccaacgtggtgaaaccccgtctctactaaaaatacaaaaattagctgggagtagtggtgcgtgcccgtaattccagctacttgggaggctgaggcaggagaatcgcttgaaccagggagtcggaggttgcagtgagccaagatcacgccactgcactccagcctgagagtgatctccagcactccagagtgagactccgtctcaaaaaaagaaaagaaaagaaaagaaatatagaggagagaattaggaagacagagagagattggtgcctagttaggatggagcaattagctcagtggtctgagataattcaggtttttgtaacgaatgggtgttcgtgctaccaactaaggcgaggaattttttttaagtggtttaggagatgccatggtgcccctcacccccaaattcctatgttaaaatcctaatcaccgcaaggtgatggcattaggaggtgaggcctttgaaggtgcttaggtcttaagggccccagagagaccccttaggttttaagggccccagatagaccccttgtcccttctaccatgtgaggacacaactagaagttgctatctgcccaggcatggtggcttatacctgtaatcctagcactttgggaggccaaggcaggcagatcatctgaggtcaggagttcatgaccagcctggccaacatggtgaaaccccgtctctacaaaaaaatacaaaaaaattagctgggcatggtggtgggcacctgtaatcccagctacttgggaagctgaggcaggagaattgcttgaacctgagaggtggaggttgcagtgagccgagatcacgccattgcactccagcctgggtgacaagagtgaaactccatctcaaaaaaacagaaagaaggtgctatctatgatccaggaagtgggtcctcacctgatgccaaatctgcctcgatcttggacttctcagcccccaaaactataagaaatacatatatatatatatatatatatatatatatatattttttttttttttttttttaccatgttggccaggctggtcttgaactcctgacttcaggtgatccatccaccttggcctcccagagtgctgggattacaggcaagagccactgtgcctggctaagaaataaatttcttttgttcacacactacccagtttatggcattttttaatagcagcccaaacagactgagacacgtgaggttgatgaattcagtttttgtccagttgagtttgaagtagtcacggaaaacttagtgaaataaccggtagggaatttggtatataaatccaaagccgagacctagagatacagatttggaagtcataaacgtagttttgaaagcatgagaacagaggatattacccaaaggatacatgagggataaaatgaaaagaagggcaaggatggaacctgggggaatattgacgtttaatgggagggaaatggaagagcatctcatagagatggatgagaaaggagcactctgagagttaggagaatcgggatgcctgggagtcacaaaggcccaggaaagtgagaacaccaaggaagaaattgtcaccagtaacagcaacagagttccgtgaacacagaatttaaaaggtcctgtgagaatgagcaataaggtcactggtgacctttatgaaaacgagagacatggtggagttagaagccagcttgtagtatcctttgatgcttggctgtagaaggaaggaaaagaattggatcagaaggggacttagagtggaagggagaagcctttgcaagatttcccatctctgtggaaaagaagttcatgttcgggtgtatctcctctgttccaaacgcatagcagtgacagataaaatacaaagagagaaagccaaagtgatattgctggactcgtggatcaaaaactcggaaggatgagggtagcctggattgactggaatctgggtcttggggtcaggcaggtattgatgtaggtcttttatggcaataggactaaaagtactcaatgcaagctgggccaccagagccagggtcactgtttgaaaaaagaggctggaggtaggcctccccaccctcttttcattctttcaggtgaaaggaacctgaaaagaatcccctgtgtctgatgcctgggccatggcttacagtagtagttctgctcttagaaggcaactgtaaaacctagagattggtgtgaggagtcagggagtggaggtggagaaaaaaaagcagcaacagtgacaataacaacaaagcctcccactcaaaaacgaccccgcaaatctaacattaatgaagacagccaaggtatcaacagtcagaatgtaaatctactgccgaagaaaataactttgtagacagacctgattaaaatagtatattcgggctgctcagagggaaaagtaaaggaataatgttcattttaaaagaatgagaaattaggaaccaaaaaagaaacaagaacagaggatttgaaaaagaaccagtttgaaattcagggactgaatcattgaaatgaaatctaagtggatcagataaactaggctagatacaactgaagagataattagtgaattggaagatattaatagtattgagaaatacaacccatttcatagcacagaaatacaaagaattttttaaatacatagttaaattagggagaaagaatgagaattgccatatagctaactcataggagcagaaaaatattaggttggtgcaaaagtaattgcgatttttgccattagttttaatgcaattacttttgcaccaaccatacaatggaggaaataacagaaaagcaatatttgaaacaataaaggctgagaattttctagaattgaagagagacataaatccttacatcaacgtatatttgagtaataacaataatggtaaacacttatttagcccttatgttccagaccctcttctatatgctttctatgtattaactcattaatcctctaatatcccttggataagagtaatttacatgtgagtaaactggaaaagagagaatgtgtgtagtttgcccaaggtcacacaactgggtggtgggatttcaccccaagcagcctggataccctctaatacttctctaaatcctaaagggattaaaaataaatctatacctggacacattgtcatgaaactgcagattatcaaagatttttttttaagagctcctctagaggaaagacagatcacgtacaaagggacaatcctcatcctaatagtggacttctcattagcaacagctggtcaatgaagacaatgaaaggagagattctaaaacccagggcaaggcatagaacacaagaaacaaatgtgggcctatcaaatgatacaatgttatacattaacttaactgtgaaatactgaggaaggagctggtaggccagtgagtttggagttacaagaggaagagcagctgggcaccccgtggctcatccctgtaatctcagcactgtgggaggctggagaaggaggatcactttatcccaggaactcaagaccagcctggacaacatagtgagaccccatctctacaaaaaaaaaattaaaaaatttggcaagcatggtggtgcgtgcctatagtcccagctacttgggaggctgaggtgggaggatcacttgagcccaagaggttgaggctgcagtgagccatgattgcgccactgcactctagtctgggtgacagagcaagaccctgtctcaaaaagaaaaaggagggaaagaaaataagaggaagagcctgcccccgggaagccagaaagtgaatggtcttcgtgaacctctgaaatagaaggaaaagcagggcaggcaaggagggggagaaggggcagagagtgacgagcacacgcagaaggtctctagtttccagtaatatgggaagaaaggtcatctcctgtaaaggaaggggtcaggaaagagggggctgaaggagggtaataaaggtcaaagataacctttatgggaaatggatgagaagcgtcaaaggattgcttgaaagtcttggcagtgtggtgatttgggaaatgttgaatgagtggtaccatcagcctacataattgtggcgttttcccagctgtgctttgcagcctgcgtgtaggagcacaggaaatggttgaattgattcaggatttgtcttcagggtaggttcagcaaagtatggaaaaattgagcaagtgaaggtcaaaatgagctttggagtccagtgaagactcttgggaattggagagcttggtgaggtcaaggagaaagtgtcctgggagtgagagtaagagaatacaggttggggttggagcaaaagtaactagagctttcagatttcagaagtggaataattccaggagattcaagaccccagtggagcttgaagggaagtggttagaggtggaatggaggtgaaggtcgttggaggagaaggaaaggaaaaggaatgaggaggctgggcctatagtgttgatgggctgcccatgtggacactgaaatcataaagatgtggatataaagtagggtaaagtggaatcctgggcatggtccagagagttcatgaagccaggggtcaggtggtctgtaaataacagcagtcatcatcaatcaccaatgaggcgtgtggctagaaagcaggggcctggaggaggagggccctggaaaagtgccactcattctacaagtgaccactaaccttgggaatttttttttggtggttggggggatggatcttgctctgtcgcccaggttagagtgcagtggtacaaccttggttcactgcaacctcgacctcctggactcaggtgatcctcctacctcagtctcccaagtagctggaactacaggtgcataccaccatgcccagctaattttgatattttttttttgtagagatggggttttgccatgtttcccaggctggtctccaactcctgggctcaagtgatcctcttgcctcaccctcccgtagtgctgggattacaagcatgagctaccacaccaggcccctgggtcacctcttacaccagagccagtgggttcatttgatcaatctgagcagtactcacaggattcaattgtcttctcacaccttttccccaggtttcaaagtcagagccacttgctgacttgagtgattatggcagggccccatctaatggcctttttgcaaagtacagctggagcaagcaggctcgcctgtgccccttttctcatcaaaagcaaggcaaagagggtatagattagactagcaggccccggctaggaagtaacatcttcaagagtaagaagtaatcatgatggcagccatgtggatattgactcataataatggtgatggtcagacggatattggcaggaatatttacatgagcccagcatcttgccaacctgtctttagatagccacagtctcatgaaatcttcacagatattaatatccccattttacaactgacactgaggcttagtgagagccagcggtctgcacagcctcacagctagcaagtgtcagatctaggactcaattctaggttagtttagccttggagcacgtgctctcatgtaactaatctgctgtctttggctctaaaaatgaaataagactgtaggtagagccaggcgcggtggctcacacctgtaatcccaacactttgggaggctgaggcggacgaatcatttgaggtcaggagtttgagaccagcctggccaacaaggtgaaaccctgtctctactaaaaatacaaaaattagctgggcttggtggtgcatgcttgtaatcccagctgcttgggaggctgaggcaggagaatcacttgaaccagggaggcagaggctgcagtaagccaagatccaagatggtgccactgctccaacctgggcaacagaacgagactctgtctcatagatttaaaaaaaaaaaaaaaactgtacatggagtcagctgctctaaagtctggttgaaagtttaaattttcacagtgaggaaagggaaataagtcactcccatcttaaagaagcattgtcaaaggaatatttttctccttccaagttttacagggaggcaaatattctgaaaggaattatcgtggtaataacatcccttacctgatttttttcaaaaacttttattactaggaattttctcagatgtaatgccatataatgggtgtttatcaactggaatagtgagggaaaatggctttccagccatgtgtctagtttttacacatcttcagacatggatggaaggcagagctgggttgcctcaattctgggtcaagtcagcttcccctggattagaaggggaggctggtaggctaatagcaggatgctggtgacatatgaaggaggggttgtttcttatgaaagcagattctcagagaaagaggatctgcgtaggaacaccagagagattggcctcaaagacccaaaagcaaaagaaataagttaaaaataaaacagtcctaggccaggcacggtcactcacgcctgtaatcccaacactttgggaggcccaggcgggtggatagcttgaggtcaggagttcgagaccagccttgccaacatggtgaaaccccatttttactgaaaatacaaaaattagccaggcgtgaaagcatgtacctgtagtcccagctacttgggaagctgaggcacaagaatcacttgaacccaggaggcggaggttgcagtgtgctgagaacttgccactgcactccagcctggacaacagagtgagactccctctccaaaaaaaattaaaatatgactgggcatggctcacatctgtaatcccagcactttgggaggctgaggcggacggatcacctgaggccaggagtttgagaccagcctggccaacatcatgaagccccatctctactaaaaataaaaaattagctgggtgcgttgggatgcgcctgtagtcccagttactcaggaggctgaggcaggagaatcgtttgaaaccgggaagcagaggttgcagtgagccgaaatcgcgccattgcactccagccagggcaacagggtgagattctgtctcaaaataaaataaaataaaacaaaacaataaaataaaataaaacaaggctaatgataaacccaggggctccttggcaggagcaaagctgaaccgagagctctattcctagagccctatgtctgaataatttatttttcctatctcatagtccctatgtgccttcctcagctgagatcaagtgccaaaggacatctcaaaatacccacagccaaaacttctcagcatagctccctgcatggagaaggagacagctctgcaagtctttgtcctgaaccgtttacggattttccatggtctgcaagaccttggactcacgccgcctgccagctggcagccgctgtccagcctgggaacagagcttgctccggcctgtggcgagtcctcccggggcttatcgtgaatttccccggttttgcatcttcatcctgaaaacctcccgacctttccttaatgaagattttagctgggggaaattgcattagtggctcgtgtttttctgtcaaccttctaaattatgttagttgtaagtaaaaagagtacagtaagtccttttatccgttgtgggctgttcctgggaatcataatggacaataaaataataagtaatggacaggaagatgctcttagaaccagttcggaaaactcttccagtgccagacagaaaccagccacctgcgccgttatcaggacatcaagtgaagccagtaaacacttgtggagctccttttaagtcccagcaccaaagaataatacctaacacttctagttaagagagcatcgtactgagtattatctcagttaatattcataacagcacataagttcaatgctcagtttgcagatgagggaactgtggttgagagatgtttttaatacactgcccaaggccacacaatgaatagctgacaaaactgagatctggggtcttttgattgtgtgtctttctctctccacactccacctcagctgctcagaagcagatcctggggccagaatggacctctgtaggaagcctcagagatggaagctttctgccctcaactggctgactgaattgatggaacagtgggtgataagcgagggaattatttcgtagtttggttgaaaaaaagtcttcagcatgtaaatatgtcttacataagtcatgaaaaatgggactgaaagaaatgagagacaagagggaaaagacagaagtattttctttatcaaaccttggggaaaagcatcttttcctcaaatacccaatgcagtatgtatggtttttgttgttattattaagacaagggaccctttttttacccagacccaaattcaactgccttcaaagagatgggacaatgttcttagagagtgaagtttcgcactgaaaaccagcttttccaaagagctccaaagagcacgtttaaattcggctaagtcggagacgtttgcagatgcaggcctgagacccctggcccacacttggatgacgaggcgtaaagtgaggaccctttgcctgtaaggctgtgtctccatctcagaaacctatttaaagccgaactttataatggaaacacagccacaacctgctatcagcaaccacgatattaaacaggcatagagccaatagcagtggcgtgaagccagcgaggaaagattagcatcacaagtaagagattttaggctcagggccagaagagggtttttttttttcttcttccctttttattaaaaaataataataaaaagggagagagaaagaaataaaaagaggtggaaaggtgcaaaagaattcctgtttagccaccctccctgagattgttctccttggttatccagataagtacagaaacaaaccactgcctgtctgaaaacctggcagtcgcttgaccttaaaatggtctctgcaataacccttccaacctgctccgctctcctgtccttggctggcccatgtgcagaatggagcgtgtgacctccagcacggggaaagtaataatcagtaaggttcatattttccacttggagttagaggaaagaccatgtgagcacaactttgggttgctatctttttgccctgcgctgctgtaggaagagacatgcagtggttggaagtctccctactggcagagcgtcgttccagcacccagtttgactttgtgcaagatggtgcttttctgactacctcctccctttaagctgcagccttctgaaatctcagctttcaggaaaggatgccagccccaggagttataggatgcagcagagcaaaggtggcattttccaggtgagcttcgggactgccccccttgggctctcccatccaggccatgcagtgctgactgcccatagcttgaccgctgcagatggacagggggtgctctgttgtaagcaactctcagaggctaagtgacgtgctcaatcttgctgcttgctccaaaccagcacaagattttttgtagccttcttttacacttcttatttggaaaatttcaaacctacagagaagtttgtaagaagagtgcagtgattctggattcaccaattgttaacatttttctccatttgctttgtctcttcctctccatacatatttacatcatttcccccaaccccccagaaccctttgagagtcatatacagacatcatgactccttaacttttttttctttcttttttttttttttgagatggagtttcactcttgttgctcaggctggagtgcaatgctgtgacctcggctcactgcaacctctgcctcccgggttcaagcgattctcctgcctcagcttcccgagtacctgggattataggcgcccgccaccatgcccagctaaatttttgtatttttagtagagatggggtttcaccctgttggccaggctagtctcaaactcttgacctcaggcgattcacccacctcggcctcccaaattgctgggattacaggcatgagccaccggccccggcctgaccctttacccttgaatacttcattgcgccctaagaacaagggctttcccttacgtaaccatcgtgcagtgcttaggttctggaagcttaacattgatacaatactattatctgatagagaggcatatttacatcttgccgattatcgcaaaatgttttttcaatagcaaataaaaactttaagaaattactaaatgtcaattaaaaaaaaaaaacaaaaaaaaacaaaaaaaaaaaaccacttcctaacttgcctagctactcaggaggctgaggcaggagaatggcctgagcccatgtgttcaagtccaacctgagcaacatagtgagattctatctcttaaaagttaaatcagtaaataaataaacattcatgattcatgttccagtagaggctcacacattgcatttaattgtcactttctttagtctcctctttaatctggagctgtttctcagcttttttttttttttttgagacagagtttcactcctgttgcccagtctggagtgcaatggtgcgatctgagctcactgcaacctccacctcttgagctccagcaatcctcccacctcagcctcccgagcagctgggactacaggcatgcaccgtcacacctgtctagtttttctagttttttttttttttttttgtagaaatgaagtcttgctatgttgcccaggctggtctcaaactcctgggctcaagtgatgtgcctttctcagcctcccaaagcgttgggaggcatgaaccatcacgcccggcctgtttctcagcttttctttgtctctcgtgacactgacattttgcagaacactggctggttttgtgcatgtccttgttgctgggttttccccattgtgttctcatgattagattcagactgtgcatctttggcaggaattctgtattagcaatactgagtcattgtggactttcagaatatcctttccccaacatgcatggcttccctgtgattttatttatttatttatttatttttattttttgtagagacagggtcttcctatgttgcccaggctggtctcgaactcttgggctcaaactatcctcctgcctcagcctcccgaagtgctgggaacacaggcatgagccactgtgcacagccttccctgtattttattttctggcctttgagaagactttagcctcccctggtttcccaagctgtgttcatcacagagctggtgtcggaggcctggtgggagagttggtcatgttcttcttcttcttcctttttttttttttttttttgagacagagtctcactcttgttgcccaggccgggtgcaatggcgcaatctcggcttactgcaacctctgcctcccgggttcaagtgattctcctgcctcagcctcccaagtagctgggattacaggcatgcgccaccatgcccggctaacttttgtattcttaatagagacgggatttcaccatgttggccaggctggtctcgaactcatgacctcaggtaatccgcccacctcagactcccaaagtcctgggtttataggcgtgaaccaccgcacccagccagtcatgttcttctaagcactggagaaaaaaggacagctgcctgtgctgaaaagtcaccccaagagagagcaggaagaatcccaaagcagaggcgacagtggactctttctatcctgtgctctgagtccggcaaactgttgatgaagccctcacggggtcattcacagcagaattggatctggttagatccaattccaaaaaaaaaaaaagccacatcccttggatccaggtttgctttttgtacccaagcttgggcattccatttggatggttttacctcttaaatattacatccatcctacttctccattccggctaccatggccctagttaaggtgtttatttcttttctagagcaatctcacactaaacccatatctcccacagagctatctgcccagggaatccacgtagacttcaaatctgatcattttcacagtgactggcacccaagaccttctgtcgcccggccactactttcctctgtcgttccgctattccatgctccctgcctcaaacataatatgcccaaaatatcaggtcaggatacgagagtgttaagtgccagcattacctgggagcttgttaggatctcaggccccaccctagacccactgaatcggaacctgaatctaagcaagcaagatttcccaggtgttgtgtgcgcatgaaagcaccggaggcactatctagaacctgctggaagggcctgttctgtgcaaggaacttaagctgcccctcaggctctgtggtccttggcactgaggcaagattctcaaaataatctctgattcaagggattccgctccgaaaattacattggaaattgtttttcctaatttgcataaataaataaacttagtaaatgggcttcatctgatttttacttttttctcttacaaattcttttctaaactttgggccaggcgtggtgccggcacacatcagcattttgggaggctgaagccagcagatcaccttgaggtcaggagttaaagaccagcctggtcaacatggcaagaccctgtctctactaaaaatacaaacattagccgggcgtggtggctcacgcctgtaatcacagcactttgggaggccgaggtgggcagatcacaaggtcaagagattgagaccatcctggccaacatggtgaaaccctatctctaccaaaaatacaaaaattagctgggcactggggcatgcgcctgtagtcccagctactcgggaggctgaggcaggagaatcgtttgaacccgaggggcggaggttgcagtgagccgagattgcgccactgcactccagcctggcgacagggtgagactctgtctcaaaaaaaaaaaaaaaagaaaaagaaaagaaaaaaatattattttctaaactttgacatctgctgctacttgttggctaacaagatgtcatctgctggcaaacaaaatgagtaaactactaggaaataaatggtaatgttaaaattcaacatacctggtgttcagtctaacagttcagttcaacaacagcaaaaaataaaaattaaaactttgagtgttaagcttctattaatgtatgagatactagaagaaggtctgagggatgcatagatgaatgagatatattgtatagcttattccccatgactgtaaggccacatgtgcctgtagtactggggcactgaatggtacttcagcaatgaccatccttttattagaatccttgggatgctactagtctggatttgcagaattcaccaaaatgaatgacttttgctattacctgtcaagttgatttcatcttctgtgtccagacagctatccaaaccaatataaccaggaaatttactctggattcctcagatcaatagatgaatggttttgttgttgttttgttgttgtttgagacggagttttgttcttgttgccctggttgcccaggctggagtgcagtggcgtgacctcagctcaccgcaacctccgcctcctgggttcaagcaattctcctgcctcagcctcccgagtagctgggattacaggcatgtgccaccaccacacccagctaattttgtatttttagtagagacggggtttctccatgttgatcaggctggtcttgaacccccgacctcaggtgttccacccacctcagccttccaaagtgctgggattacaggcatgagccacccggccaatgaatggtttttaaaacaaaaatcacaatgagcctgttgccttttattggctttggttttaggaggagaaactttaaaagcttggagttgaaggataatggttcaacctttcttggcgtgtaagtgatttatgacctcctaatttaacgaaagtaacaacagcgaagacaagccacttattagcgtttcctggcaattccatcagggagataggggttggggccttgagagcccaagaattaaacaacagctgaatgttattcaaaatctaaattcattatacacattgttgctttactaaaatctttactaaaatgtgatcaagaaagccttggcagggcacggtcttgaaagatgagtaccaactcatcttgggcaggcagatatcttgccaggcagatagggtggggagagccttcagggcaagggaggagcaagggcaagagtcttgaaggctgaagagtgagcaggatgtggagaggaagtttcaggctccacagggtcatgggggcaggcccagagcaaggaagagagaaaggagggtgatccagggaggtgagttgatgagaggaggcagatgtactaagtccatacatgagtgcagtatttgacagtttgcaaagcaccttcatacccactatctcaccaggtcctgctagctcagtgatgaggtgggacacctaacgtcctcacttccaggtgatgaaatggaggcctggaggagtttctaaagtcgtacaactcctaagtggtggagccaggattagaatgagatattttgacctctggacactgctctttccaccataaactgatatgttccaggagcattgaagaaagcttcctagcatattgggaagaaaactcatggttggggtgtggctgggtggatggatgggcggatggatggatggatggatggatggatggatggatggatggatggatggatggatcaatgggtggatgtggagatcagagtctcaagagaaaaagagttaagagtccagcagttgtgcaggtgagatgggggattcaaacgtctatcaggaaggtggatttgtgagatacagaggcagtggagtgaatagaacttcatgtctgaccacatgtgagaatgagaaagaaataagagtgtaatggccggacacagtggttcaggcctataatcacagcacttcgggaggctgaggtgggcagatcacctgaggtcgggagtttgagactagcctgaccaatgtggagaaaccctgtctctactaaaaatacaaaaaattagctgggagtggtggcgcatgcctgtaatcccagctactcaggatgctgaggcaggagaatcacttgaacccaggaggcagtggttgcggtgagccgagatcacgccattgcactccagcctgggcagcaagagcgatcaaaaaaagaaataagaatgtaggataacacccaagttttgaccttggatgattaaaggaccacaaaggaaaacaaacttaaaccttacagccaaagtggtaaaggtagagatgatgaatgttaacttcgaatatgtctaatagtcagttgatatcaatggatctggaattcaggaaaagtgtctgagatatccaggagattcattaggtcatcagcgatcaaaggttagcattttattatagatgttcactgtgttattataaataacgttaaaaaagagaaaaataaaaaggaaaggtcttaaacatgtaacagttgcagattggctcatttatgttacagccatatattgaaatgcaattcagaccttaaaaatgagtgctggctttgggaggccaaagtgggcagattacttgaggtcaagagtttgaggccagcctggtcaacatggtgaaacctcatctctaccaaaatacaaaaattaaccaggtgtagtggcatgtgtctgtaatcccagctgcttaggaggctgagtgaggcaggagaattgcttgaacccaagaggcagaggttgcagtgagctgagatggtaccactgcactccagcctgggcaacagagtgagactccgtctcaaaaaaaaaaaaaaaggagtgctggtttaggaggtcaatgctggaggatcacttgagcccaggagttcgaaaccagtctgggcaacatggcaaaaccctatctctacaaaaaaaaaaaaaaaaaaaaaaaaaagtagcctatattcccagcaactcaggagaccgaggtgggaggatcacctgagcctagggaggttgaggctacagtgacccatgatcgcgccactgcactccagcctgagcaacagaacaagactctgtctcaaaaaaaaagaaaagaaaagaaaaagaaaaaagagcgctaggcttgtgggtgctttcccttccttggtgatactaacatctgtcgctggcagggtacttcccagcccagatcaaaatgaagtgggctttccctactttatgtcctcagatcttctctactacccagtgagggacgaactgacactttattacggaatcacagatgagattccagaataaagattctttattctttccaaaataaagaagtagtatgattgtgataagaaaaaaggagaaaagaaaatgttattaaaaaaattggccaggcacggtggttcacgcctataatcccagcactttgggaggccaaggtggggagttttgcttgagctcatgagctcgagatcagcctgagcaacatagtgaaaccgcatctctactaagaatacaaaaattagccaggtgtggtggcacatggctgtagtcccagctactcgggaggctgagggaggagaatcgcttgaacctgggaggcagaggctggagtgagctgagattgccccactgcactccagcctgggcaacagagtgagactccgtctcaaaaaaaaaaaaaataaatatataaaataaataaaaataaattaaaaatgacatcacagcccaggcacaatggctcatacctgtaatcccaggactttgggaggttgaggcaggaggacagcttgagccccaggagtttgagagcagcctggggaatatagtgggaccccgtctctactaaaaaaaaaaaagtttttaatgacatcacagacgccagaattgattcacgagagtatatgtgagagctggtctatgaaggcaagagtggcgggtttctccccattggggaaaaatagaaacaacaggcccacccaggggcctcatacctaattctaccacaaccctgggaagggctctggaagccaaaccctccccacatgctagccccagcctgtcttacccgtgcctggagggttccttctggagtcttctgggcagctgccctggggagcaggggcccgtggagctcagccaggaggccttgcgtagtttgccttgggaggttattacagccaatccacatagatgcgaaaaccaaaccaaacacagcctaccaggaacaagtaacgatttgttcctttcttttgctttttctgacagtagatgcaatctatcgtgattcttaagtgtttttgggctagtgcccattccattgtttttgcccagagaggctcaccaggaatgagctggaaggagacacaagcccctaagtacctcgggacgcttgcttggtgaacaagaggaggaaactcagagagcagggctgccggcctccttgtctttcgatgcctcgtgtggccaccccaccgcacgagccatagccagccatctgtctcagtatttcattctcttgaggctgagctagtgtagtggctgtgtcaggaaccctgcctgtttgtgcaaagaattcattcttccaagaaggatgaggatcaaattcacctccacatggcacacaccgaacaccgaggctgtgaaaggctggcccgtgagtgtctccaggttcaatatcgatttgtcaattgtagagaaaaccagcagttctagttcccagagaccaccctgtgaattgaaataagaaggaacggggagaaattggagctatttttaagctcagcttctgaggcttattttaggaggcattattgatcatacttcggggaaaccgttctgcgtcgctggtgccagtgtctacatgtgcacatgtgaagtgttggcctagactcctgagaccatctgtgtgcccaagggaggctgcagcccagaggagaattcggactgaggctactttgcaccaaaattaggccaaactcatgaaagggccattgttgcagctgccctgggaactgtaacttagaagtgattttgtgcccttacagcctctttagtaaatgaattgagtcatagcatttgtgatccttccgcatgtactttggtacttttctgtacttttctgtcctcttttttgtttgtttgtttgtttgttgagatggagtttcattcttgtcgcccaggctggagtgcaatggcacgatctcagctcactgcagcctcagcctcccgggttcaagcaattctcctgcctcagcctcccgggtacctgggattacaggggtgcactaccacgcccagcaaatttttgtatttttagtacaaaatgggttttaccatgttggctaggctggtctcgaactcctgacctgaggtgatccaccagccttggcctcccaaagtgctggggttacaggcatgagccaccgtgcccagcctctgtcctcttaatgagttaccatgatctagggcacctgattagaacgttgtttttccaaacagcatctttttctcatcggtcactgtatcactctgatcactgccccttgaatcttcttcctcaccctttatttcacccagatgagccagggtttaccgtatgtgggacttcaggtcatggcacaaaatggttctcaacccttttgttgagcaccggtttgctggtgctctttttagacacaaaccctggaataaacgtgccctttccctcaaagggaccccactgtggattcctatccactttgttatcctttttactcttagatctctgcctcaccactttcccaggcagcctctgctttttcatcttactgttctcattttcgcctggtgcgttcgtcagcggctttttatgttaaacttcgcagatgagccacgcctgaagttattcctgtccttctttctctccggtgtattgttgttgacaggtttttatctgttgttttgaattttctgtgacctttggggtgggcagagaaaaaaaaggacaaatgtccaccatcggccggtctgaacgccacatttaatgtgttctttttgagtgttctaacccttccttcttcctgcacacatttaataacagagaaccaaaaaaagcctagttgccttcattcatgaatatttgggacagtgaggcctcagggaaggccagcttttctggctacagggacggtcttaatctggagaatggaagaaagaggtcctttaaaaaccagagagttggctgggcacagtggctcatgcctgtaatcccagcacttcgggaggccgaggtgggtggatcacttgaggtcaggagtttgagactagcctggccaccatagtgagaacctgcctctaataaaaatataaaaattagccaggcatagtggtgcacacctgtaacccagctatttgggaggctgaggcaggagaatcacttgaacccagctgcagagtttgcagtaagctgagattgcaccactgcactccagcctgggtgacagagcaagactctgtctcaaaacaaacaaacaaaattaaacccagagagttgtaatagtttcccagggccgccaaaacaaatcatcacaaattgggtggtttgagacaacagaaattgattctcttgcagttctggaggccagaagtcccaggtcaaggtcaggctcttggggatgatccctccttgcctcttccagcctctggtggctccaggcgtttcttggctcagggctgcaacactctaatctctgcctctgtctttacatgactttcatccccctgtgtgaactgccctgtgccttaatcgtatctgtgtcctctcctcttcacataaggataccagtcgtcagatttaggagccaccctaaatccaggatgacttcatctcaagatccttaactaattacatctgcaaagaccctatttccaaacaaggtcacattctgaggttcctgggagacatgagattcggggggacactcttcaacttactataggagtattgatgcctctgcctatagaggagaatcaatatataccatacaacccagcagtcctactcctgactattgaccctatgaaaatgaaaaccaggccaggtgcagtggctcatgcttataatcccagcactttgggagaccaaggcggggggtggatcacttaaggtcaggaattcgagaccagcctggccagcatggtgaaaccctatctctacctaaaaatacaaaaattagctgggcgtgatggtgcacacctgtaatcccagctactagggaggctgaggcacgagaatcacttgagcctgggaggcagaggttgcagtgagctgacatcgcgccactgcactccagcctgggtgagagagcgagactccgtctcaaaaaaaaaaaaaaaaaaaaaagatatgtataacttttattggtggttgccagtttcttccttgtatttgactgcatttttcgaattaaaaacatcttgttcctggctgggcatagtggctcacgcctgtaatcccagtactttgggaggctgaggcaggtgaatcacctgaggtcaggagttaaagaccagcctggccaacatggtgaaaccccggctctactaaaaatacaaaacttagctgggtgtgttggccagccccccataaacccagctactcaggagactgaggcaggagaatcacttgaacccaggaggtggaggttgcagtgagccaagatcatgccactacactccagcctgggtgacagaacaaaactccgtctcagaaaaaaataaaaataaaaacactggccgggcgcggtggctcatgcctgtaatcccagcactttgggaggccgagacgggcaggatcacgaggttaggagatcgagaccatcctggctaacatagtaaaaccccatctctactaaaaatacaaaaaagtagccgggcatggtggcaggtgcttgtagtcccagctactcgggaggctgaggccgaagaatggcgtgaacccgggaggtggatcttgcagtgagccgagattgcgccactgcactccagcctgggcgacagagtgagactctgtctcaaaaaaataaaaaataaaaataaaaaataaaaacatctagttcctgagaaactttttaaaaaagaaagaaaagcaaccaaccctagaggatatgctttatgccttctaacaggcatgtccatgaaggggccagattgaacagtttaggagtccaccacttatttctgtgtgctcaaactgggaatgaccatgatgctgaatttccctaaactcctatcttgccagccttcttggcaaagagttctatctggaagtttaagtagtttaatttaatagagagaaatattattcagtgactcggaaaagaatcaggcaagcctcccttcccgacaccatgaatacccacgttttttaatcggctccctcaaggtgacccaagatccaggggctcttttctacttgtgcttcttggccccccaaggacccccacaggcattctcactctactgccaatcactccaccaggggctcaacatccctctctggagccctagccaactctgtgtgtgccagcgtcctcgcttactgccggggatccaaggacaacatgcacagtgcccgcagatgatgctgagggcagccgccttactccaccccaccttcatctctgatcaaagcttttccaccatcaggtgctcctctgagagctttctcctcccctccccgctcccagctcaccccccacccccacccagtgccatctgcagtgccatctgcccccagtgccatctgcaggcttgtgggtgtgtgtcaatatttcacccagcttgtctgcagcggtgtgccactcttagcctcagaggagtcctcacatcgccagctcacacccctgagagcttgaccatgtcctcatgaactcaccgtccttcccaaaatcccataactaaaacagcctggaagtgtcaccaaggcccaaagacagccttctgaagattacttctcagtctcttagcctcccttttcctctcctctgcttcaagccctttatttatttgtttttgttgttgttttttgagacagggtctcactccgtcttccagactggagtgcagtggctctgtcacagctcactgcaatcttaacctcccagactcaaaaggtcctcctgcctcagcctcccaagtagctgggatcatagatgcttgccaccacacctgacgaatttttaaaatttttgtagagacagggtctcactatgttgccccggctggtctcgaactgctgcacgtaagcaatcctcctgcctctgcctcccaaagtcctgggattacaggcgtgagccactgcacctggccttagaaccctttaaaactcacacccagtacactggagggtaactgagctgtcactgaaaggacacaggacagtgtgaggaaaacagaagggcacagcaagccagtctcgcggagatctgcagaggtgttctctggagctccccttccaacccctcacccttctctatccctgctgcataggcttgtcgccacctcactggggacagaattttctcagacactctcaggcctgaaacctttgccttcagtttgctttacaactccctgctggctctggaaaaacaattttcccctctgcgccaaaggcctaatgatattgtccaccagaaagggttctccagagaagcactgaagtttacccagcagctaagacgatccggcctaaccctgatggatgagtttcctttactcagccttaatacccctgaaatcctgtggcaagtggagcgtttgatggggattaaataaaagcagtttacctcccactgtattaccaaatggggtttcaattccattctaagaccaaggtcagtacgggagtggatctggggtcatcactgccctagagccccggcaccagtaggcagttctctggggcccccacatggaaacctcagcagccctgagctatattcctggcctggcgtctctggaccacactgcaggcacgatgtggggttggattctttcttcacgacaccaattggccagtctcttgtatcacccctgctggccaaataatcatcttggaccccgaccattatggacctatattgagttccctccttgctgaatttggactactagagtactcttgtctgaagcacattttattttattttattttattttattttattttattttattttaagacaaagtttcactctgtcacccaggctggagtgcaatggcgcgatctcaggtcactgtaacctctgcctcccaggttcaagcgattctcctgcctcaacctccctagtagctggtactataggtgtgtgctgccacacctggctaatttttgtattttttgtagagacggggtttcgccatgttggccaggctggtctcaaactcctgacctcaagtgatccacgtgccttggcctcccaaagtgtttggattacaggtgtgagccactgcagctggcctgaaacatatcttttagtactttagtaatatatggattatatgtcatataatatcgattaaattgtgtattaaatctagtctccacaaaatcatagcccctttgagagtggaccttctcttacacatttttccaaggcacagtgttgaacacacagtaggtgcttaaccaatatttgccaattcattgaatggtgggcattcggcctcttcatctctagagtgctgtccttaagtacagtaattctatcttaagaacaaataacagttacccaactctgtcttctgcaaaacagaaaaaagaatagagaccaaaaatggttctgaggccaggtgcagtggctcacacccgtaatcctaacaacactttgggaggccatgacaggaggatcactttagccaggagtttgagacgcacctgggcaatgtagcaagaccctgtatctatttgcaaaaactatgattacttttgcaccaacctaatatttaaaaaaagactcactcctgtaatcccagcactttgggaggccaaggcaggcggatcacgaggtcaggagatcgagaccacggtgaaaccccgtctctactaaaaatacaaaaaattagctgggcgcggtggtgggcgcctgtagtcccagctactcgggaagctgaggcaggagaatggcaggaacccgggaggcggagcttgcagtgagccgagattgcgccactgcactccagcctgggtgacagagcgagactgcatctcaaaaaaaaaaaaaaaaagaaaagatagtggttttgaagagacccataaagagtatcttttttattcctatcttaatgaccatgtagaagacaagttgaaatactcttgggttggattgtatattcatatatatatatatattcataaatagtcatgtatatatttatgaaacagtcaccactgaattgtgtagctgggataatgttctcagtgagatgacccatagagatggttttcatcattggtggtagcctggacttttttttttttttttttttacagccattagtgcttttcaggctctctccaactgaatatgctgctattagataataatcaataaaccatgaactggccaggtgtggttaattccagccctttgagaggctgaggcagttggatcacttgaggtcagaagttcgagaccaggccaacatggtgaaaccccatctctactaaaaatacaaaaattagccaggtgtggtggcgcatgcctgtagtcccagctacttgggaggctcaggcaggagaatcacttgaacccaggaggcagaggttgcagtcacgccaatgcattccagcctgggtgacagagcaagactctgtctttaaaaaaaaaatagcgataataataataaaccatgaaccaacactagacccatatgcttaaagtattaactagcagccagtataccctccctccaccaaaccagtagccactttgccggtgcagagcatgagcgggacaacattgttaaaacatgaattctgcttccagtgttcctgctggctgaacctgtactttgttggcgtgtcttcctcaattgcttcctccagcgagctcccaaaagccaaaaaaaaaaaaaaaaaaaaaaagttatagtagagaggatcagtggtttggctaggcttctctgtctctttaatcgtatctgaagcataaaacaagatgactggtagacttttctcaaaatccctcctaatcagccacctctaccttgtatcctcagtagcttgtacagatggcaggaagataaaaatctacacagctactaggcttgcaccttccccaccacctgcccagcccttcaatttttagaggataatagattttcttttcttttcttttcttttttcttctgagatggagtcttgctgtgttgccctggctgtagtacaatggcgtgatcttggctcactgcaatctccacctcccgggttcaaacgattctcctgcctcactgagccttcccgagcagctgggactacaggcatacgccaccatgcccagctaatttctgtatttttgtagagacggggtttcatcatgttgaccaggctggtctggaactcctgacctcaggtgatccacctgccttggcctcccaaagtgctgggattacaggcatgagccaccttgcccaccttagattttattttctagagcagtttaggtttacagaaaaattgtgcagaaagtacagacatttttcatctaagcctggatcttaaaccatcaaagtttctgttgtagagaaaagagctgcagaattcatgattcccaaaattgtggatttatgaagagccaccctacatcgtgatcttggtggattttatctagagaaatcaccaaatctagaaacaaatctagaaatgaagcaagagcaattgcaaaatttagaaaaacacttctgttcaaagagaaatctaggctgataagacacattccatgcttatcagtgtacctgtccctactcaattatcaccacacagcacgtaatagttcatgaaatggatttaccttaatttatttggcaattctcccatagtaggatatttaaactgttttcttcctttttcaatcttatttttcttgacattataataatgttgcaataaaaatatttgtgcgtaagtcttttcctttaagattattttctttttctttctttcttttcttttttttttttttttcctcagggtttcactctgtcacccaggctggaatgcagtggcacactcacggctcattgcagcctccactgcctaggctcaagcagtcctcccacctcagcctcctgagtagctgagaccacagatccatgccaccacacccagctcatttttaaattatttgtggagacaaggtatcactatgttgtccaggctagtctcaaactcctgggcttaagccatcctcacaaagtgctgggattacgggtgtgagccactgtgccttgccaagattcttttctttctttctgttttgtttttttgtttgttttgttttgttttgttttttatttataccgagtcttgctctgtcatgcaatcttggctcagtgcaacctctgccttctggatttaagtgattctcctgcctcagctcttgagtagctggactacaggcacccgccaatatgcccagctgatttttgtattttttaatagagactgggttttgccatgttgcctaggctggtctcaaactcctgacctcaactgatccacctgtcttggccttccaaaagtgctgggattacaggtgtgagccaccatgcctggccaccaagattcttttcttaagataaattctcaaaatgtaagcttactaggtcaaagtatatcaagatttgtaagacacttgatacttattattcttaatactttacaaaaaagagaaaattactcccttttaattttggaatctataacatggtaattattcagatttgccttccccatgtagcatttctaggttcatatttaaaggaatttttcctactgagcagttattcactctctagtgtgtgtatggcgggggtggccacgggagtcaaccagattgacaccaaaatccactgcagatgatttgtgggtagaaagtagaagggaaagaggataaacacttttccttctccctgtctctgataaatagccaaagacaggaacattattacaggtgatataggaaaagtgcctccgtgacctcccacacccaggtcccatctcaggagacaaattcagcccaaggagcaaacgagaccatgaagttcacagcactccagtgtcaggtgcccccctgtaaagctttggcttgatgcaacaacaaaaggcattcgcatcctaacgtgacctcagcagatctcttcctccacctccaagagccgggagttgtaccagagctctggcagctgcacctgccaccaccggggagcccaaatgaatcattgctgtggctgagtgttttcctttggggcccggtgaagccactgcttgtttttaatggtgttggcttaattctggctcctgccctgaactgagtgtgacgataagaacatttcaccttgtccctgctctccaattacaccacatcaggaccgctgccacttcccactgctccgtggcagcccctctatgtaccacccaagttggctgactgtgggatgataggacagagaaggaacaagccaaggagcaagacagaggagactaacaggacgcagaggccactcttaacaccacaggctttttaactgaaaggaatgttaatggtcacctgggtcacttgatctcagtctccttagggccacagatctctgatgatcagatgaaagtggtcgaactctctttccagaaaaatacgccttctcaaatttcaggatgtctcccagaatccctgaaacccattcatctagactaagttgtggtttgtttgttgtttttttttttggttttggttttttttgagacaggatctcactctgttgcccaggatgaagtgtagtggcgtgatcttggctcactgcaacctctgcctctcggctcaagagattctcatgcctcagcctcctgagtagctgggacaacaggtgcacatcaccacgcccaactaatttttgtaatttttatagagacagggtcttgctatgttgcccaggctggtctcaaactcctgggcttaagccatccttgcactttgacctcccaaagtgctgggattacagggatgagccgctgttcccagttagactaagattttaatttacaaacaaggacatggaggcccaaagaacatgcaggaattagcccaaggttacacagaaaatttactgaatttacttatttatttgagacaaagtcttgccctgtcgcacaggctggagtgcagtggtgtatctcagctcactgcagcctccacctcctgggttcaagcaattctcctgcctcagcctccctagtagctgggattacaggcacatgccaccacacccagctaatttttgtatttttagtagagatggggtttcaccatgttggccaggctggtcttaaacttctgacctcaggtgatctgcccacctggcctctcaaagtactgggattacaggtgtgagccaccatgcccggccagataactgaatttaaactcagctctcctgattgccaatgtaggacccatcagcccatagtaggaggctgtcaccctgcactgagccctgtggcagcaattgtgggaaattagggtgcttacaaccaaggaaacaggatctcagactcatgaaaaaaaaaaaaaaaacctaagatcaatgagtaagcaatattcctgccatagagtcctctttggaaagtagatgctaatgccttctgttagttctccaggcacttattgagcacctatgaacatctcttaagctctaatcactgggagattcattatttattagaaattaaaactcgcctgtaatcccagcactttgggaggccaagatgggtggaccatctgagttctagaccaccctggccaatatggtggtaaaaccccatctctactaaaaatacaaaaattagccgggcgtggtgacaggcgcctgtaatcccagctactcagggggctgaggcaggagaatcgcttgaacccaggtggcagaggttgcagtgagccgagatcgtgccatcgcactccagcccgggggacaagagtgagacttcatctcaaaaagaaaagaaattaaaactcatcatctcaagcctgaagaggatgttgggttcctcaatgtgattttttgtgatttgttcagatggtgggtaccccaccctgaaatatttactacaaagttcaagtaaaggagcttcctcgtgcttgctattccatggactttggcatgagaattaggcacgctgttaatgaaggagaccagtggttggactaaaggatgccttggtggcttctactgcagccttagctattcaacagaggaacagaagactcccatgttgctgggaggttctcagtgacagtttctcaggacacacactttttaagtagcaggagactcagattctgaatttttctttctagaaagatgcaggtagcagttttgattgatgtttatcttagcggttggatgctaagaggcggttttgtttttgtttgtttgttttaatcatggaaggacctggtgaagcctacagacttgccctccagtctgagcttctctgctgactggccatgtgactttgagcaagcctctttacttctttcagccttggttttctcatctgaaaagcaggaataatattaatatgggcataatgttcttaaagcaacattaatagttcccttccctagttttacagcctattcttttctttttcttcttcttcttttttgttttttttttttttgagatggcgtctcactgtgtcgcccaggctggagtgcagtggcacaatctcggctcactgcaatctctgcctcccgagttcaagcgattctcatgcctcagtctcctgagtaccagggttcacaggcatgtgccaccacacccggctggggtttcaccatgtggaccaagctggtctcgaactcctgacctcaagccatccacccgccttggcctccctaagtgctgggattacaggtgtaagccactgcggccagctgacagcctattcttttctttcttttgcagcacatactccattctgccttgtatttttggtgatagctccccagtctgtctctcctactagatggtaacctctcaagggctatctttgtagtccctcaagcccagggcagcactttgtatgcaatgggtgtatcagtcagggcccaatcaggagatagaaaccatgcagtaatttgaataggagaaatgtaatagaaggaattattgatctctgatgggagcaactataaggatgtaaagggaactccaaaggataccctaaggctgagagagaatacccaggaaggacaaacttggcaggggcctctctgcatggctggggttcagacttcattggagaagcaggatggtggggaagttcacgaggttgacctgagccagggctggttcacagtggttgagcagcagagcgccctctggggtgcaggccagaggaggttggtggacaggggtgtgtgtggagagagagtcggggcacgctgccagtgcaaggcctgcagcacgcagtgcctgcagcaggagggccaccgtgaagtggttactgggcccaggctagggctgcaaggtcactgagcaactatgcactccaggcttgcagctggggcagagcatgaccgaaagtccccacaggcacactctgcagcccaacaacatccaaatctgaagaaatccccttcctcttgcagtggccctttagggccccctactgatgaggctcactgtaaaggagaaatgcttacagggtccagtccatgatctcagagcagaggcataagggcgactttggagctaaggcaatactatgaaaactgcaatgggtgcaatgagggatcaataaaatgtttgaattaaatcggagaaagctacataacctgtcatgcccccccttcatccgtgcttagttccctttctttgagtcctgtagattttgccaccaataaatgtcaaacctttttaactacttttgtaatttactctctggaagctcatttccctctggggtattctgtgtgtgtgtgtgtgtgtgtgtgtgtggtttttgttgttgttgttgtttttgagacagagtctcactctgtcgaccaggctggagtgcagtggcacgatctcggctcactgcaatgtccacctcccaggttcaagtgattctcctgcctcaggctcccaagtagctgggattacaggcacatgccaacatgcccagtagggacggggtttctccatctcatcatgttggccaggctggtcttgaactcccagcctcaagtaatccacctcccccaacccgcccgacatcagcctcccgaagtgctgggcttacaggtgtgagccactgtgcctggcctctgtgtgtcttcttaatgaggcatgtgtctctcttctcttagctcatacttaaaagagatttgcagaaagaaagaaggagcgggggggactggctctcgcaaacagtgtgagacccagtattttatttcacaacttatttctccacttgaacttgaacttgtttctccactgtctgtttcatttcgaggcagttcacttgtccctcccaaatgctttaggagtgtcctgaagcacttgacttcaagtagcagtggaaagaatcagagccaatccaagaaccaatctttctctgacttggagaagtcagtggccacctcgggtcagactagggagttaatctccttggacaaatctgaagagtccagtctccaaatatttagaaaagaataggcaagaagagaagaaccaccagccgacttggaggataattacaacacaaatattattcagaaagcatttagaaaggactaatcgtttcaagtaacttgagaatccaaccgagatgagttgagcctataaagagcccttcagatgccctcttgtgggagactgtgttaataggcaccaagtttgggttaggacagtgttcttgggtatcaaccaccctgttcttccaaaatattgcattctctcccgaagagtcagatgtaattagtgttaactgttgattccctccaggaatgagctaaacagtgggatgtggctacagttaagacttcctctaagaatgaagtggttgtccaaacttaaatctgttggccgggcatggtggctcacgcctgtaatcccagcactttgggaggccaaggcggatggatcacttgaggtcaggagttcaagaccagcctggccaccatggtgaaacccccatctctactaaaaatacaaaaattggccgggcttggtggtgggcacctgtagtcccagctactcaggaggctggggcagaagaatggcttgaacccaggaggcggagattgcagtgagctcagatcccaccacttcattccagccttgagactccgtctcaaaaaaagaaagctgtttatcatcctgcagaaggatgattatccctttagaccagaaaaatgacagtgagaagaactagaagaacttaatttttccactgaaatttagacttttttttttttttgagacagtctcactctgtcactcaggctggagtgcagtggcgcaatctcggctcactgcaacctctgcctcctgggttcaagtgattcttctgcctcagcctcccaagtagctgggattacaggtgtgcagcatcacgcccggctaatttttgtatttttggtagagacagggtttcaccatattggccaagctggtctcaaactcctgacctcaagtgatctgcccacctcggcctcccaaagcgctgcgattacaggcatgaaccactgagcccaggccgacatttatatctatatattgcggctgtgttgttgttgttgttattattattattattattattattattattattattattattttgcaagtgatgtgcattctgggccagtgaaacctagagcagattggcaggaaaccatctcagtgtcttaccaagctttaccttgttacctttatgtgtacaaaggaaattgtgcccttaaatgatcaagaaaaacaggtgtgtttcccctggataatgagattgtggtttattttcttatttttgcttatctatattttctgcaatgagcatgttttatttgtgaaactaaatatatataaaaatatatggccgggcgcggtggctcacgcctgtaatcccagcactttgggaggctgaggcgggcggatcacgaggtcaggagatcgagaccatcctggctaacacggtgaaaccccgtctctactaaaaatacaaaaaattagccgggcgtggtggtgggcgcctgtaatcccagctactcgggaggctgaggcaggagaatggcatgaacccaagaggcggagcttgcagtgagccgggatagcgccactgcagtccagcttgggcgaaagagtgagactccgtctcaaaaaccaaaaaaaaaaaaaaaaaaaaaaatatatatatatataaaatatatatttttaacatatatataattttaattttaaaaaacacacacttttctaactcttggcctatatccctgctttttgactcaaatttagccagaccctttccaacctctttactcctcctgttcaggtgaactgccaaaaatcagcagacttcagtttgggaagagattttttttttttggaagagattaatttcctcactcttgaactcctaaaaacagcccagtttttcttctacctctcaccaagcagtgattgatgctacacctgcctctgatgtgacaaaaccaaagccatgaatcaaagccttctatgattcttgcgcattctgaggctggtgaaagcactagccgggggccctgagacgtgtgaagatgctctgtgtgggggttattctgcctcgggcactttggagggtaacacctgctatcactaacctttgatatgttgctctgctttttcagattttcgacaatgaagccaaagacgtggagagagaagtttgctttattgatattgcctgcgatgaaattccagagcgctactacaaagaatctgaggtaagcaacagttgggatgagatgtggaagattcattcattcattcattccacaactatttcttaagtgcctcctaacttgggaggatgccatctctcgtcgtgtggattcaatttgctttcgtatcttgctggttctttttgcaagtctcaaaattaagtctctaactcttcagggaccatcattggccctggctgttactcaatctccacttagttttcctgtctcccaactctgccatcatttttggcaacgtcagtatccatagggctggaccatccaacacactggccttgctgaaaaacaacagtctccccaattacatgcgctcttttttttttttttttcttttttttttttgagatggagtctcgcccaggctggagtgtggtggtgtgatctcactgtggcatctgcctcccaggttcaagccattctcctgcctcagcctcctgagtatgtgggattacaggcgcccaccaccatacctggctaatttttgtatttttagtagagatggggtttcaccctgttggccaggctggtctccaacttctgatctcaaatgatcagcccaccttggcctcccaaagcactgggattacaggcatgagccacctgtgttttatttgtatctgaatcaatccttgaaaactttgatagctcattccagcacagctcctttctctcaaaacagcaagcaccttaatgaggacatctcctttgttcttggctgagaataaatttcagagaacttctttctgtctggttttcaacctaccaggatccatcctttgccttagttctaccttcttgttatacggtttgtgcaagtcaccatttatatcccattagtattttattaatggctgctgacggaacttgggtgacccacttgtaaataacatcccagccctgcaatgacagcagatgcagggctatttttgttggttagcgacatgccaccaatcccaatatgtttggaatcagggccccagactcgtccttgagccgtaacacgtggaccttgaaactcttctcccagagtcatcaaggctgatgggagacacaataaataaacttattcaaaatgaattctgtcgttacgcaaataaaccaggctcccgacgtggttcagatttcttttgcctccacattttggggttcatttcggtataaaagtcttacctgatcttagcaaatgctcggctgcttaattgcaggcgcttatgttcagctgctgtccctgaaagggctggggagaggctgatgtggatcactctgtgttgctcatctccacccaaagggtgagcgttttaacatcatcagctttcattatgctctgtggccaaccacacctatgcattttaagataaagaaagttaaacgctccctacgtaactgtggacccgccgaagagggaaataaacagggccactgaccttccccttgtctcactccacagaaatcctatagtttcatgtcaagtccgccagtgcttaatggggctctgatgatgcgcagagcattgtgcaaagcactcctgtgacgcctcgggcccccccgggctgctgtcctacctggacctcccggcctctttgggagctctgggccttccaggaaagcagggttgccagaaaactctgaactaatttcagcttttcctcccagtgtgctttggcgtggctctgcctggacttcagggagttccctcctgattcagtaggaagtcttgatacaaatatagaatattaatgaagaaatcaagtctcatttctagtcaacgtgcctgactcatttccctgtgctctgtgcccccaaagaacctccactagaaagcttcctttcattcacacagacattcgaggagcttttccttcatgcttcacagggtcactcatgggcacgtccgtacctccttccctgggtcctagagtattcttccctggatgcagcttggccaaggagatgagtggtaaagagtccagtaattattcatccaataaatatttatggagtcctcactgagtgtcacatacaatgttaagatggggatgtctgggcatggtgcctcacgcctgtaatcccagcactttgggaggccaaggcaggcggctcacttgagttcaggagttcgagaccagcctgatcaacatggcaaaaactctactaaaaatacaaaaattagccggcagggtggtcagctactcgggaggctgacgcatgagaatcgcttgaacctgggaagtggaggctgcaatgagctgagatcacaacagagtgagaaactgtctcaaaaaaaaacagcaatgagccaaagagatgcttagggtccctcccttcaggacacttccaatctaacaaataccacgcagagagtatttggcgaacagtagagaaatagtcacacagatacatatggagttcagagtcacacgtgcaggaaggcaggtacggggagagactgtgataaggaaactgaatttaagaggataggatcaggagacatgctatggaaaaaatgacatttcaggccgggcgcagtgcctcacgcctgtaatcccagcattttgggaggccgaggcaggcagatcacctgaggtcaggagtttgagaccagcctggccaacagaatgaaaccccaactctactaaaaatataaaaattgcccgggcatggtggcatgcgcctttagtcccggctactcagaagactgaggcaggagaatcacttgaagtcccagcgactcaggaggctgaggttgaacccaggaggcggtggttacagtgagccgagatggcaccactgcaatccagcctgggcaacagagactcggtctcaaaaaaaataataataaataataaatgaagctgaggtgtcataggatctaaattatgcttttaaaatattgttctggatggagaatggactggagaagaacagagtcaggagaccaccaaggtcactattgtgatttatattgtcggttacttaggttctgtcgtggcttgcgctagagggctggtggcagagatggacaggagcagatggtttggaggtatattttgaagatgagttgacagggattgctcatggattggatgtggggatgaggttgaaggaggaattgggatggccttaaggattctggcttgggcaactgatagatgggggtgctgcttactgaaatgggaaggtgagaagagaggtatacgttggagaaagatgagtggattttgtgatgtcagtgaggcatctaacacagacagaaatgagtctggagcttaggtgagagatctgggagaccaatttgagagtatttggcgaataggagatttaaaaatcctggggatggatgagaggaagaaagcatgaaatataaatgggaaaggggttcaagtctgagccttcaaggatggcagcatatggagatcaggttgaatctaaaagaatcaggagtctaaaagaattggccagaaagttaggaggaaaacacagaaatgcaccaaggaatgcaagtttcaagaggaggagagtgaccagaggtgctgaatgctgccaagagatcgagtaggaagagaatggaaaactgtccgctggagcagttctcaactgggggtgattattgcctcacgaggatgcttggcaatgcctatagacattcttggttgtcaaaacataggaggtgctactggtatctagagtgtagaggccagggatactgctaaaatcctctacagcacagaaagcccctcacaacaaagaattatctggctccagctgggcgcggtggctcacgcctataatcccagcactttgggaggccgaggcaggtgaatcacaaggtcaggagttcaagaccagcctggccaacatggtgaaacctcgtttcttctaaaaattcaaaaaattagccggccatggtggtaggtgcctgtaattccatctactcgtgaggctgaggcaggagaatcacttgaacccaggaggccgagattgcgctactgcactccagcccaggcgacagtgcgagactccgtttcaaaaaaaaaaaaaaaaaaaaaagcattatctggctccaaatgtccatagtgccaaggctgggaagccttgttctacaggaagaggtgattgaagatggatggaactctggattcagctttgacgctcagggccacccctggcccgccctggagtcttacggttactaaatggatgcgggagaaggggccccatagggctgagccctgcacattcatcatccattgtgtgacctcccaggggatctgctggcatctggaacaggtggaattcctcctccgtggacctggcagccggaccacaaagggctataggtaccactgggagcctgcaataaaatcttagaaaaagcattcccccaggggcgactccctcgtaaccccagccccatcaccttcaacaggccagaatacagactgcagtctgaacccacccaaaggaagaggggtgagtttcctgggctgttttggtggttgtgtctactgtaaacacaccagggactgggaataagaggaacaaccgattcagaaggcaaaccatttccaaacaaatgtctaactggcacactgtagataattaacaccctccaccccaccacaggagtttccttctaaaatgaaatctgaccttgttctttgcttgaaacccctcactggccctcctttagagttcagctcacacaggactccccctttctgagttttcctgggcatgcccccaccactgctggtctggaggcagcaaagttctggtccgtggcttctagatcatgctaggttatgctagctcatcactatggcatgagctctgcgaagacaagagctggctctttcccagccgctgccacagcaccagtgcttagcaggcgctcactcaatggttgctgaatgaatgagtgaaggcaagggactttgctttttttcttccagcagtgacaatttcagagcaaccgctatcaaagaaaatgaattcgttgccattaagcaagcagttgtgaatcagagttcctttttttttttaatcggaggcatccagctccatgggccttttcttcccatccatctttgtaagttgacgatgtcagcgtcctaaatagaaacgctctttatgtgaggaagccggatgctgatgggccgaatctgttcctggatttttttgatgctgatgaacccagaccagggttatctgggttgctcctctccactcagctactgttgcacacacacacggccatccaggccaaaggaggggatgaaagcactttcctttctttttccatttctccctggaaacctttgagccacacaatcaagactgcctctctcatgaaggtgaccagagcttggagttttccactgggtgccctctgcccgatggccctcgtgccatcgccactaaccggggactcagaagcatgctttggggattcaggaccagctgatagcccagctctgtgctttccttattctcatttttgctgtgttgctgtttcctgttagggcctgaacttcagctctcaaaaacctcttagcttcaagtttgttctcatagtcattaatggactctgcagggcagtgccgtattgtggggtgggggtgggggaggaattagtgtgatttttttcaggcagagagagcccctccattagtcacacagaccactgagaccctgcccgcccataagagtcataaagctgtttgcaccatgtcacatgtaaaatgaccatcatcaacaccaaagcaggaaaaggggtgaagccaaaagctgagcaggttggactggttatgtggctgatacatagtgtcttgccgctgccaagattttcatcccagctccttgatgctctgccaagatttcaaggtgaagatcccagcggaggaatgaggaactctgcacgataagttggagcatgcctgcagaggccacaggcagtgcggccatacccgcaaggctgagttggcagttttggggtgcaagaacaaacctcaacttctagcctgcaggactagcccaggctggagaatctgaaagccatgctgggagagatctaacccagaggcctttgatattggcttctagtcaagttcaagtccagtactttctcctccattcactgcagtagttcctgaggtctggcttccatcatgagatggggagtgaccaaagaaaatggcatctatactggcctcctgggggctgccacctgcagcaatctcccctagacacaaatgtgtagggcgcgtgcagcttctcaatcttcagacatacctccagggcaaaggaagggaaagaaaaaggaatgtctttcctagtcaaggaagtagaagtagagggttttgtgtgtgtgtgcttccttttttaaatcttcattgattcatgtaatgaaaagcaaaggagtctctagcccagaggttctcaactacaggcaaatttgtccctcagggccatctggcaatatctggagacatttttgattgatgaaagtggatacggcatgttatgaatccagtcggtagaggtcagggaggctactgaacatccaaaatgggccaggtgcagtggctcacacctgtaatcccagcactttgggggaggctgaggcgggaggatcacttgaggccaggatttcaagaacagccggagccacacagcaagaccctatttctacaaaaaaaaaataaaaataaaaataaattctctgggcatagtagcatgtgcctatagtcctagctactcaggaagctgagatgagaggatcacttgagcccagacgtttgaggctgcagtgagccatgatcatgccactgcactccagcctgggaaacagagcgagaccctgtctctaaaaaagaaaagaaaagaatccaaactgcaccacaacagagaattatccagctccaaaatgtcaagtatgccaagatcaataaaccctgacatggaccaatccaaggaaagaaaacttagtaaaacctactggtatcaagactcattaatgaattcctttagttagcatttactaagcacctactgagtgccagctccacactaagcattgagggtacaaaaacaagattatgtcagccctcaaaggtcctgtcttctactgccttttgaattgatcatcttgttacagatgaagcaatttctcatcccctttattttggaggatataaaggccatcttactagtgataaatacagcatagtaagttgaataggggaaatttgcaattgtttgtactcagatagcaacaaaggagaaagaataacatgaggctgtcctagaagcatgggcccctgacgtggcataattaaatgtttttcagacagaatttgattttgaactttccccttaagttgggtgactaagtctccaggtccctgggtcatagccttcctggaccaagaactccttggcagccagttcattggtccccacagatctaaatatctgttgaattctctgttaagggagagagaacagaacaaaaggagatacatctagcttttccaataactgtcaagggtgagagattaaatgttgtttgctaaggaccggccctcagaaagggaacagagagatcaactaagtaaatattgtcatatttagctgtacccttcggtacaaagagcttcatccaaatcactcggctccctcaaatgaaaaatattttcattctggtctacatcttggcctttgagggtggtaaagattttccgttacctctaatggccagatttaacacagctgcctcatgccggggtacatcgttaagttcacttggttgtgctgttattatctttttttttttcccgtttccctcaagtccatctgtttctttctgagagtaacgcagctgttttgcagtgggttccaacttactggggcctgcatgcttcttggaaaataagaggacttgatgacatcactgggatggggagaagtccctgctgccaaaggggtccctggtgggagcctctaaaactggagggagagggaggaagcctgcaaaggagacacaagagaagggtcctcagcagctgccgcatcgcgggccctgagccctctccccttccagggtctggatgatgccagtgctgttagaaattgagagagaaggccaggcacagtggtccacacctgtaatcccagcactttgggaggccgaggcaggcggatcacttgaggtcaggagttcgagaccagcctggccaacatggtgaaactccatctctactaaaaatacaaaaattagccacgtatggtggcgggcacctgtaatcccagctactcaggaggctgaggcaggagaatcacttgaacccaggaggcgaagcttgcagtgagccaaagatggtgccactgtactccagcctgggtgacagagcgagactctgttgaaaaagaaaaaaaaaaaaaaaaaaaagaggccgggcacagtggctcacacctgtaatcctagcactttgggaggccgaggcaggcagattgcctgagctcaggagttcgagaccagccaggacaacatggtgaaaacccatctctactaaaatacaaaaaattagccgggtgtggtggcacatgcctgtaaccccagctactccggaggctgaggcaggagaatcgtttgaacccggaaggcaaaggttgcagtgagctgagatcacaccattgcagtccaggctgggtgacagggccagaccctgtctcaaaaaaaaaagaaacccatgatctggttgggaggatatggtataatgacacaaatgctaagtgacagtacggagcaaggcagcaagagaaatacattcacacagtcatgtgtgatctactttcctcaaacttgtacacatagtcatcctcagaggattcccaggactagtcagggaagactttacagcagagatggaatctgagctgggccttaaaaacataataggtttatgtttattttttgctcataaattaatacatgatccttgtaaaaaaaattccgacatgatacaaacacaaaacagagcaaatctcctatgatccctcatcacagacatcgctgttaaagttggtgtttatacttaaacataatgcataaatagtattattttataaaactaaactcacactatgcacaccatctcgcaacatgcattatttcactaaccacataagcttgccatttttctgtgcagcacacgcctgtctagtgagttttaggtggccggataatatgccagtgaaggccaggttcagtggctcacgcctgtaatcccagcactttgggaggccaaggcaggcagatcgcttaaggtcagaagttccagacccacctaggcaacatggcaaaaccccatctctataaaaaatacaaaaattagccgggtgtgatggcacatgcctggagtaccagctactctggagactgagggaagaggatcacttgagcccaggagtcggaggctgctgcagtgagctgagatcccgggcagcagagcaagaccctacctcaaaataataataataataataataataataataataataataagcgagtgtacggtggtgccatgtgtacatcattctccatttgatggacatttagggtgtttccattcttattatggtactgcaagaaacagccatagatatattttgagagttgttctaacgtctctgtagaataaatctaaaagtgaaagtgttgagtcaatggacatatgggttgagattttcctagatataacaaaattgcccacaccctgcggctacattaaattgcccctgactcacacttggatgggagcaaactcaggtctgaagatgtgtgagatggaatggacagtgtagtgaatggctgaaaatgaggagtctcagtgcatggtcaagggtcagtgaggcacaagggaaaaacattgagtaccaagtcaatgaatttggactttattctgcaggtcgcagagagtcttcaaagcaggggtcaccaaaaataaaaaattccgttggccaagaaaaaagaaaaagcaggggttatcagcaaccgtgcaaggggactctacctgtgacctcaccagaggggctgactgtcttgtggggatggtgagggcaagctcctgggtgcccagaggtttaggacccttcaaatccatcaacctacatccttccctcttctgctaccccctttcatgaacaaattgccctcagccatcttgacaacaataagattttattaatgaataggaacatttggaaataaaaaggtgttaaacagtagtccagttctcaacaaccctggctgcaccattttcagaccaataattggcatggcaactcacttcccaaggaacaatgaggtgttctttttcagacctcattccttccaaacccgggaaagataagacgccaagtctcgctgaagcaccgtgcctagtgctgattttaaaagccactgctgttctcttggcctaataatgcgaagctacctcagcatttggatcaaaccccatttttactgggattactacaaaaaatgatagtgcccaacttcatcctagagaaagagttttcatttttttttttaatttttcaaggggaaaaaaaccatttaaactgctgcagtaattggcatgaatgatgttccccagaactcagtgttcagagcagcagttgcaaatcctaccaattgaatttggtagtgaaatgccagaccaagtaggtcaaacaaaatcaaggcatatgaattcctaaatgccagatcaaaagcagagaatctaagtctctgccaggagtgcagttgctgattgtggcattgtgggtcattgaatcaatagaaagagcccttgggggccaggtgcagtggctcacgcctgtaatcccagcactttgggacgccaaggcaggcagatcacttgaggtcaggagttcgagaccatggcaaaaccctgtctactaaaaatacgaaaattagctgggcatggcggcacgcacctgtagtcctaggtactagggaggctgaggcacgagaattgcttgaatccgggaggcggaggtggcagtgagctgagatcgcgccactgcactccagcctggacaacagagtgagactttgtctcaaaaaagaaagaaagaaagaacccttggggaaatcaccctatcaccctatatcccaaaaggaacagaccagggagggaagaattcatccaagcaaaacattcatggaagggagaaacagttgggcttttcatagagggatctgtgcaaaagataacccctagaacctatgaattgggattcccaacttgtgtgctctgtgtctagatgattcagccctaatgtggtgagggccctggctctgggagcctcccaggcggtcacagccactgcatttgatcatcatcaattctgtgtctgagtccctccctcccttccaaagaatggacagatggacagatgggatggagaagtgagatgacgtcaaaggcaaggcatggaaagtgaccagcacagtccctggcacacagtaagcatttcataagtgttcccttctctctgctttgaccctggcttcgagctctgcagatgggttgcaggaatggtggctccgtggaaaccatgtgtctttggaaagtggccaccgtgagtggcgtcacaggagtttgtttgcgtgtcgcttttcccttgtcggtgtgagtggagaacaggagcagaggtgtgataccaatagctccagctctcaggatcatgggatcctccgccggctcagcaagatcctgcagaagttacagccatttgtgctgctgagacttttcaaaaaaaatgtgttattgcctctgttatggtttaacctgaattccggatggcacgtgtctctgctacttcacctcgaagaaaccttagaagttacatttgctgtttgttttgtgccaagtctgggccatctgtggcactgcagtgccgggatggtacccaaggcagtattgccatgctatctctgtctgccacgagccttcttacagctgtactatagaaaactaacatttaagactttcaaagaaggaagcaagagctgaagggcccaaggctctcagccaggagtgaacagatacaacaagctcttcttcagttccatctcatggagaacttccctctgtaatttttttttttttttttttttttttttgagacagagtctcactctgtcacccaggctggagggcagtgtcacaatttcagctcactgcaacctctgcctcctgggttcaagcgattctcctgcctcagcctcctgagtagctgggactacaggtgcacgccaccacgcccagctaatttttgtatttttagtagagacagggtttcaccacgttggtcaggctgctctcgaactcctgacttcaggtgatccactcgccaaagtgctgggattacaggcgtgagccaatgcacctggccctgctctgttctttcaagaaaacaggcaatgagtccacacaagttgctcataactggggccagccacatcagcccctgctgtttttagtcttattaaagtaaaacaccagaacttcttggcccttagaacagagttcccaaatcaggtcagcatcacccagggaggttttgaaaactggagatatccgggtcccaccttagaccaacccaaccagactcaactggtctgggacccaagaatcagtgtgtaaatgcaccaggtttgggaaaatggcctcagagcagagcttcccatcttttttcatgccttgacaggtaggaagtgtttcgttttggccaggcgcggtggctcatgcctgtaatcccagcactttgggaggccgaggcaggcggatcacctgaggtcgggagtttgagaccagcctgaccaacacggagaaaccgcatctctactaaaaatacaaaaatcagccaggcatggtggcgggcacctataatcccagctactcgggagcctgaggcaggagaatcacttgaaccctgaaggcggaggttgcggtgagccaagatcgcgccattgcattccagcctgggcaacaagagcgaaactccatctcagaaaaaaaaaaaaaaaaaaagagaaagtgatttgttttgattgacacattgaggaggagctcctggttaagatgaccaacccctgagctcagaaggcccagtctgttactcaagggctgcgggagcaatatgccttatcacatctactatccattcaccatagggaagctttgcctaagagagctcaacttactgaggtcaaggttttaaaccactttattgttacttaatttgggggaggagggatgcaggggggttagcaatgtaagcctgtaagcctgcccattccccgattgtgagagaggtcagtgcctttgaattttgttctgtctgttgggaatctgacgccatctgtagaatcagatccaaagtcttccttgacagctactagcgttaattataacataagtttgtgcagtttttttcctaagttgcttctgatttgggggtggcttcagattgacattattgaagtttatttcctccacccaaagactctaggccggctgtgattgttcacgcctgtaatcccagcactttgggaggccaaggcgggtggatcacttgaggccaagagttcgagaccagcctggccaacctggcaaaagcctgtctctactaaaaatacaaaaattagacaggcgtggtggcgggtgcctgtagtcccagctactctggaagctgaggcaggagaatcacttgaacctgggaggtggatgttgcagtgagccgagatcgtaccatttgtactccagcctgggcaacaagtgagactctgtctgaaaacaaagacaaaacaaaaaaaagactctggtagctgtccaccaggtcctctggctaaatcttctccaagccctttctttgtttagcactctaagaatctgcaacaatgactatgatgtttgaggtggcatttttctccttgagaaataagacctgacagagcgattgtctgctccacatctagttattcagactccaaatacaactgttcagcttctgttccaaaaatacccaagaaagaataagtgttattaaggtgcttgtcttcatcttttattattaagaggcccagagaaagacttataattactagctcattagcttgggccttagaattttcaacgaaaatttctcacaaaattgctaaacctggttttagaaggtatggaactaacttttgagaaaaataaattccaccatttagagtctcactgtcgcccaagctggagtgcagtgatgcaaccacggctcaccgcaacctccacccctccaggctcaagcgatcctcctaccacagcctcctgactaccagcacatgccaccacaccagctatttgtgtgtgtgggtgtgtgtgtgtgggtgtgtcgtgatggggatcttgcagtgttgcctaggctggtctcaaactcatgggctcaagtggtccacctgcctcagcctcccaaagtgctgggattacaagtacgagccaccactgcacccagccaacattgtctccattttatagataaggaaactgaggcttagagagtctaagtaactggctggaagtttcaggaagcctggattcaaaccccaaagtgtcctaccccaaagattatgcttcccctacaccaagtaagattccttcaggtaaagctagacgtacaaacaactgttgtctttggaaatcactctaagaaatagttcccttcttaaatatatcttcccaaccccgagtctcagtgactaaatgatcttagggaaagactggtatgtagaaaaagaagggcctttgagacggttggttacctgatgtgatagaattccactcctcatctttggggagaagtttcctctttacaaacattccagaacatagtggattggccaaaagcagcttgggtctgtaaaaaaaaccaaaaactaaaaactagccatcctccattagagaatagaaaccttttattattttttttcttttacacaaggtctcactttgttgcccaggctggagtgcagtggcaccatcacgacccactgctgtcttgacctcctgggtttaagccattctcctgccttggccccctaagtagctgggactacaggtgcacaccatcacacccagctaattttgggtttttttttttttttttttttttttttttgtagagacggggtttcaccatgttaggtttcccaggctggtctcgagctcctcagctctaaccatctgcccgcctcagcctcccaaagatgacaggtgtgagccaccacacccagcccaggaagctatttttaaaaagaaaaaaaaaagccattagtcaccaaagaacccatctacagaccctaattcagaaatattccttttctcactttagcatccacacgatagtcttagagttaaataacttgcccaggttcacacagtagttactggagctgaaattcaaacctgggggcagggcatgtgttctctcacttcaaagcctcctcagttcatctctcagttctgctccacagatctgaggaccccacaaggtgctcccgggcatggtaaacagtgaaatacattgtatcaaacagtgaagggagaaacagcctgaagaatccactcatcacttttacctgctttatatactgggattccaaaagtgcatttggagaaacaaaatgagttctgaagctcaaataagtttgaaatctaaaagtggaaatattttattgtcttcaaattacagactgattggcttattgaacatctctaccctggtttctgttcgacaagttggaggcctaaatttcccaaaataatacagtacacaaggagcaagctagacttagggacagttaatctggtgctgatcactgttggcatgctgcaactcatcgagatatttgtcagcctattatcagcttttgatttaataaacttaagctatctctaggccaaattgtagatcctcggtaggaatgcaggctgttaatgcctccccatagccttcgtctaaagagcactgctaaaatcagagtggagaacagcctcaagttcaaaggctgcaaaccgagccaggttctaataagctccctttatgggaggagctgggttcttggcctctcactgtctcatgtattaaggtggggtcctctccagtgtgcccttgaatgaccttattgcttttgattagaggttaccttgaactatactcatattgccaaacggaacaggttagtgttctgcaacaggatgttagggagacagctcttgttgctctggaactgggaaccaggcccaaagctggggacaaagaggaattgggactccacattcaccaggcagctgctaatcaccagtggcccagatgaccctcttcccacagctctggttgcccctatcttccccttccctaggccctatgtggagatgaaggaggggagtttgtagtcattgggagtatacttcttgcctcaccccaatcccatgtgacaggagtagtattctgagagaatcaactacagtagctggggcatctgcaaaaaaaagctggctataggcccagtgcagtggctctaatcccagcactttgggaggccaaggcgggaggatcacttgaggccaggagtttgagaccagcccagacaatatagcaacagcccatctacaaaatatttttaaaaattagctgggcccagtggcacatgcctgtggtcttagctactcaggaagctgaggtgggaggattgcttgagcctaagagttcaaggctgcagtgagccatgattgcaccactgcactccagcctgggtgacagagtgagaccctgacacacacacaaaaaatagttgactgtttgctgagccgggaacttgcaggcccaccctcaatgctgccatcctgcaagacttgggtgatactaataagtgtccccaaaagcttgcagaggaacgtagagattgcacctgctgcccatctggaaatttctaaaggagtttttgaaggagcccatggctagggctgagatggaaccatgggagtgtgagcttgggaatagcacgggggcatccccttgggcattattgaaaatgcaggtaatagtgggctacttttagtagcttgcttatgagaattctggggtgttttctgtgtctccaaccagttcaattctccagcaccagctatgtgtccaacaattcaattcaattagacactgtctatctggagttagcatcagatcccagtcccacaaagctgccccacttctcactgacaggctataggccgggcacagtggctcattcctacaatcccagcactttgggaggccaaggcaggtggatcacttgaggccaggagttcgagactagcctggccaacagagtgagactccatctctattttttttactaaaaaaaattttttttttaatctggggtctccacgactccttcctcaggctcaataatttgctagaaaggctcacagaactcaggaaaacatttacttagatttaccagtttattatcaaggatatgactcagcagcaggtaaatgggagagaggcatcaggtgaggtattggggggtggggacttggggcttccgtgccccctctgggtgtgccatcctcccagcaggtcagtgtgtttaagcgtttatggagctcaatcccagcaccccctccctccctagaggtcagtggatggggctgaaagttctaaccccctaatcacctggtgtttctggtgaccagagccatcttgaggccatctagggcccctcacctgtgtatgtgatctgaaggagcttgttatgcatcccaaaagtcacccccatcactcaggaaattccaggagtttttggagcattgtcttaggaagcagtgacaaaaaccaaatctattttgtattacatcacaaggatgaaatgagaaagcgaatctgaagtgcctgacacagactctggtacggagcaagcacttgaaaacgttagctcctagggtgatttttcccagcttccttccttgactttcctctggccacctctcttgcaagttctcatttgctttcatcttctccccagttcctaaaaggcatcctgggggctagaaaccataggctttttttttttttttttttttttttgagatggaaccttgctctgtctcccaggctggagtgcagtggtgcgatctcagctcactgcaacctctgcctctcgggtttaagcgattctcctgcctcagcctcctgagtagctgggactacaggcatgcgccaccatgcctggctaaattttttggatttttagtagagacggggtttcaccatgttggtcaggctgatctccaactcctgacctcaaaagatccgccctccttggcctcccaaagtgttgggattacaggtgtgagccacggcgcctggccaaaaccatggactattacattgttttgtgtgatgtgctcaaatttctcatttgcctcgtccctcttcttaaagcaatgagtttcaagtgtttgtggcactgaactataactgagaagggtacaaaacagaaacattccccttgccacagctgcctttcagtgcctttctacacatcagatgcaccttatgagtcaaactcctttaagagagtcattttgcagagaaaaaacacaaaccgctcagggtttgcggtgcattctagtgccaagagcaaatgctttaaaaatagcactttaggtattaactgctaacaaagcaagaattgactgcttctggcatgatttgcatttagggttttggtttgtttttttttaagttgatgcatagcagttgaccttttaagtcaagttttaggtcagttctccagcacattctgaaagctccttagttttgtctcttttttaaaaaacagctttattggctgggcacaatagctcaccactgtaatcccagcacttttggaggccaaggcgggtggatcacctgaggtcaggagcttgagaccagcctggccaacatggcgaaaccccatctctactaaaaatacaaaaatcagccgggtgtgctggcacgtgcttgtaatcccagctacttgggaggctgagacaggagaattgctggaacttgggacgtggtggttgcagtgagccgagattgcaccattgctctctagcccaggtgacagaatgagactccgtctaaaaaaaaaacccaaaaaaacagctttattgagatatagatcacataccatacaattcagccattttgaatgtatagttcagtggattttactataatcacatgtttacctcaccacaatcaaatgtaaaacattttcatcaccccacaaagaaacctcatatgttttagctatcatctccctaccctctcccctcacccatctcccaagcctcagcaaccacactgatctactttctgtctccatagatttcccttttctgggcatttcatatgaatagggtcacttaataagtggtctttggggactagctgctttgaaagctccttggttttatgtgtatccctcttaagattcaagttcaaggaatcctacattaattcagggctaaactttactttcattggaggggaatgagaatgagatctgcaacaccttggagtcttcaggagaagttccaggatggagagaaaaaaatctgacatgtgatatgtgttgttcatccatccctattttagggctgagggttatagttacataatgtagcaattcctggctggagttcctgcttagccttttttcatttagcatttatcaaaaacttctcatttcaattaacagggcaagcccctgttggctattgccctttgtggttcaaattgagagtgtaattaatcatggagacttcatatctcagtgaacgtcagctaataagattgcctccaagatgcaagctcagccccagctggaccaagctctcctgtgggcttctccttgcaccttccaggtgggagactgattctatccaaaacgaggacgcagttttacacgggctgctcaaacaagccctttgctctgccttgtcccagtgcgagatggatgaggcctgcaggtgtggctgatcctatagagtggacgccttctaaagatgtgccgaagtccatctggccccagggaaacagccctggcaccagctcaaccccctcgatacagatgggctttaactacaagggtccaatttgccatctgccaagcctggagagaatcggtagcatccggagccagagatctcattgtggatgaatttataaaaccctggctagaagaacttgcagccccacgcgttccccaccagccagctgccgggccgagaggagctgggcagggcccttgaggcaagagcatcgcttgcagagaagttccacatcccccagcggagccagatgccactactggggttcggtgctccgtgaccacatgagtgagctggaagagtgaccgcggaacctagaagacttgccttgtaaaaacctctctgactcatgttatgggtttgtgtccccccagaaagctaggttgacgtcctaacccccagaatgtgaacttacttgggatagggtctttacaaaggtaatcaagttgaagtgagatcattagggggaccctaatccagtatgatgggtgtccttataaaaaggagaaatttggagctgagtgcagtggctcacgcctatggtcccagcactttgggaggtcaacgcaggcggatctcttgaggtcaggagttcaagaccagccaggccaacatggtgaaaccccatctctactaaaaatacaaaaattagccaggagtggtggtgggcgcctgtagtcccagctactcgggaggctgaggcaggagcattgcttgaacccaggaggtggaggttggatggcaccactgcactccagcctgggtgacacagcaagactctgtctaaaagaaaaaaaaggttggggggaatttggacacacagacagacaagcacagagggaagacgatatgaagatgcagtgagaatgtgatgacttcactccagtgatgcttctacatgccaaggaacgcccaggggaaaggcatgaaacagattcctcctcacagcccttggaaggaccagtcctgatgacacctcgatttggggcttctagcctccagtactgtgaaacaataaatttctgatgtttaagccaccagtgtgtgattatctttttgttgttgttgttgttgtctgtgatacttgatacagcaggaaacgaatagactagtggaaccaaccctccaccctaaataggtacgaatgaaaaacacatatcacatgttagatttctttctctgcattacggaacttttcctgaagcctccaaggtgttgcagatctcattttcattcctctcccaatgaatgaccatttcaaccaggtaaaatttagccctgagttaatgtaggatttcttgaacttgaaccagggaggaagagagccctgccctggcttggaagattactggaaggaaaggacagcgtatgcctctgtatgcctttcagcccttcacaaggagagcttgtaagtcacctttaagatgcgtgaaggctgccggactttgaggctcacccatcctgccattgggaggtggctgcccagtacatgcaccgttcaaggagggccccctgcttggctgggaccacgaggttccagaggcccccaggtgaaatcgcctaagggagcggcccatgacagggacaatctgctctgctctctgctttcgtccacttggaacagagtgttcctgcctctgaaacataagagaaagggggaaagacattggtactgagcactgaagactgtcggttcacctggacccagaacccagtcataacatcccacagaacaagaacccttctctcgcaattcctccaaccaccatacttacggacactggcatgtgacagcttccagaaaatggaaatgcccacccaggctttcactcacacaaggaaacctgcatgctgttgggcagtcatattttttatttgagatgatcagcatttttctgtacatttgactacaggataacaataaactcatagtaatcctacagcccctgggacattcccactgcctttctttggaggagcttaataagatttgaacaaagtgcactacagcatctctcagggcatccttgtatcatgtgcttatcactttgggatgtctcctgtgcatcacgcaccttctatgtgccaggctgggctggggactttgcctaccttatccaatttaagtcttgcaacaacccgcaaggaagttttttgattttttttgagatggaatctccctctattgcccaggctggagtgcagtggtgcaatcttggctcactgcaacctccacctcctgggttcaagtgattctcctgcctcggtctcccgagtagctgggacaacaggagcgcgccaccacgcccaactagtttttttgtatttttagtagagacggggtttcaccatattggccaggctggtctcaaactcctgacctcgtgatctgcccgcctcatcctcccaaagtgctgggattacaggcatgagccaccacgcctggccaggagttcttaacaccattctacagatggggagatggaagctctcctctgatcaattgtgccagaatttcagacagaatgtcctgtccacatggtgtaggggtgacgtgttaaaccatttgggctgcaataacagaataccatagactgggtagcttataaacaataaacattgattttttacaattccagaggctggcaaatccaagatcaaagcattgacagattcagtgcctggagatggctcgtttcttggttcatagatggcgcccctctcactgtgtcctcacatggcagaaagggtgaaggagctatccagagtttcttttataagagcactaattgggccgggctcgctggctcatgcctgtaatcccagcactttgggaggccaagatgagcggatcacgaggtcaggagatcaagaccatcctggctaacacggtgaaaccccatctctactaaaaacacaaaaaaaattagccaggcgtggtggcaggcgcctgtggtcccagctactcgggaggctgaggcagaagaatggcatgaacctgggaggcgaggcttgtagtgagctgaggtcgcaccactgcactccagcctggacaacagagagagactcatctcaaaaaaaaaaaaaaaaaaaaaaaagcactaattgcctcccaaaggtccccaccccctaataccatcacactggtgattaagtttcaacatatgggttgggttcggtggttcacacctataatcccagccctttgagaggccaaggcaggaagtgtgcttgaggccagaaatttgtgaccaacatgggcaacataatgagacctcatttccacaaaacattaaaagaattttttaattagctgggcatggtggtgcatgcctgtaatcccagctaggtgagaggatcacttgagcccaggagctcaaggctgcagtgagctgtgatggcaccactgcactccagcctgggagataagagcaagaccctgttgcaaaaaaacccaaaaagtttcaacatgtgaattgggggaggggcaacaaacgttcagaccaaacgttcatgggagcccgggtcggggtggactgtggctgagttgctgattacttctcagcttcaggttcctcatcaagagcatggagataatatgtgtacttcatagcagtgactggatcttgactgtacattcaggtcaccacctgttcagaccccacccaggaccagttaggtcagagcatgggggtctaaccttgctcttctgtctggacctcatcccgaggtttcagtcacagttctggaggccggaagtctgaaatccaagtgagagatttcgaggctctaggggaccatccttcctttcatcttccagcggctccaaaatttccttggtttgtgactccttaactcccatctctgcctctgtcctcgcacaaccttctcctctgtgtcttctcctcttctgtatcttataaggacacttgtcattggatttagggccctcccacttaatccagcatgatctcatctcaagacccttaacttaattacatctgcaaggacctttcccaaataagatcacgttcatagatagatactaggggttaagacctggacatatttttggggaggatttatttaacccacagcagacatcttgcactctgttttctgattgcactgagttgggacccagcaggggtttcaagacacgtaatctcggtcacactaaagtccagccttatgacgttttataattggccagaccttgaaacttgcctgtggaaaggcccaggggatttttaacatcggggatgaaggttgaggtttataaacctctttttaaaataaggaaacctggaaatggaggattaaaatgtaaaataattctgttcttttataaagaataagtgctataacaagagtttgaatcaggcccaaaacactacagacattctagaaatacaaaacagaaatatatacatatttggaaatgttgtaagagaggtcaaccgatgtgtgaagggggcaatttagatactgaatgttcgtaaacccaagtgagaaaatgagaaagaaaatgacttcataaagaatgggtcttgggaggtgttaaggaggacagtgaggaggagggggtagaatgtgaaaagagaagtttgcagcaactggactatttcagataagaccagataatttggttcccttcccctccccacccccgttttttttgttttgttttgttttgttttgttttgtttttggctcatcttcattcaaaagcatttacctggatgttcatttctaatcttgagttttgattaaaggagtcctttcccttacctccctctagctctttgaaagtgaatccttaattataggccatgtttgagattgactagatgaaatcaacagctgtagatatgacaccagactgcaaaatatcgacacaatgttgccataaaaagcccaattgttaattgcttatttggcactgggctataacaaaaacaccctttttctgtttaatattaaaagtaaatgtagtggaaagaacatcgagctagaagtagggtaggctgggattctagtcccagccctattgccgagtgcctgtgatttgggggcaaagcattttatttttctcaggccccggtgtccttatctataaaactgagggcatgaaaccaaattaccactttcagcttaaaaattatattcttaatcatgaaaatacagcatacttctcatttctatcctttttccaaaactttatttcacaatacccaaatataattctatacttttgtcacgcaatcaggaaccacacattgatttaagcatctacatcgtttttgctgtgcaagcaatacttttccagtcttattctgaactgaagtgagctgtcagtcccgacaattctcaactgctttggaaatgcaatccactggtgttccatttttaataccgtgaagtcttgttttattcttgaagaatatgaatctgaaatgtacatgaagatgctggaatagataccatctcaaactcagctgtcattgactgaagaaacaagccaagggcagtccatgaatcagggagggagggcaaggtcgggcacagccaactggtccaggttcctcttgctcagtcagacccactgtgcaggacctgaagggcaggaaggcagctcagactatggccctggtgacagtgacaggagggcagccaaatgcctaggcagataggggtgggaccccagtgaaaccccacttccaagccaaagacagtttaaagcctgaaagccaagctacaggttaaatcctcagaccagattgagaactggcctttcctctgattgatccccacccttcacctattttaaatatgcctactctttcctaattggttatctacactgtcgtgcccacttttgagtggtatcttcactttaaccttttttgcatactcacaaaccaatcagcatgcgctccctattgttagcccataaaagccccaggctcagccatattaggggactttcccactttgggataggtaaccaccccacccccagtatcctctctttgctgagagcttgcctttcgcataataaattatactccactcactctctggtgtctgcatgcctaattcttcctggttgtgagacaagaactcggacctagctgagctaaggagcagaaaaaatcctgcatcactggtttttattttatttccctgcctctggtgcctgcccaccttgctttgtttgctgggttgtctcctacatctctgggttaccaggagcttggactcctgctttcctctacttgccgtctttgtcctatcctttacttactcagttgcttacccaagcaggaagacctccacttaggttctcgagggtttgcctgtccatattctggtcaactgcaggggggaagccatgtcttctaagcctcaagatagttgtttacgtgcaactatcagaggtaaacacccatcatttacctctgttgggaggaagtcaaaagacagatggggaaagaaaccaaatttccctgtttaactccacctcctgtattttaactcatgagagcttcttgagaggtataaatttccttgttttcagctttcaggcttgtggctgattgtgtgaacttttggtgtgctctgggaaagaacaaagcagcattcattctcttcatctttggtaatccagttaatgcacctgttttataatatgcttgatggatgtgttttgttacctgttgctgagcaacagccccaaaatttagtggcttaaaacaatgagagtgcattgtttctcacaattctgcactcttgactgggtttagctggccagatctgctcttcatgatgtgagcttggattgaaatatctcagatggccctttcactcaacgtggtctcagctgagatggctggagcatctgagacctggttgagcatgttgccacatggtctcaccacatggctagcttgggcctcctcatatcatggtgctctaaggtaatcagcctagtcttcttacattgtggagggttccggtttctggcttccagcttctcttgaaaggctaaactgacacaatgtctcttctggtacattctgttggtcaaaacaaataacagaccagtctagattcaaggggtggggaaatggtgaggggaacagcatgtcagcacagtgggggaaggaattgatggtggccatctttggagatgtatggtagataatctctcaatttattggtcttctcttttctttttatttttttccaaattcaacattatttcttattttattttttaaacatacaaaaagctgtacacagctttttaattaacacatacagcttgatgattttggacataagtatacacctgtgaaaccatcaccacaatctatgccataaatctttttttgttttttgttttttttagagacagagtcttgctctgtcacccaggatgcagtgcagtggcgcaatctcaggtcactgcaacctcctccccccagggttcaagcgattcttgtgcctcagcctcccaagtagctgggactgcaggcacacaccaccacacccaactaattttttgtatttatagtagagacagggttttgccatgtggcccaggctggtcttaaactcctgagctcaggcagtccacctgcctagacctcgcaaaagtgctaggattacaggcatgaggcactggctgctatgccataaatctatccatcacctccaaaagtttcctcctgccctgttttattattttattattatctttttactctcaatggcatgatatggtataggaacacagagcaggcaggaactagtcccatggcctcaagcagcaaatttcccagcaattccggggtgctatggaaaagcatgttgtctctgccctggactataggattggatacattacttaaatgctcctttgactgccttgggaaatgcaataatggctaacatcaattgagcacttgctacgggccaggccctatattagtctttttcatgtatcatatatattttattttattttattttatttatttatttatttatttgtttatttatttatttttgagatggagtctcactcactttgtcacccaggctggagtgcagtggcatgatctcagctcacggcagcctctgcctcttggattcaagcgattctcctgcctcagcctcccaagtagctgggattacaggcacatgccaccacacctggctaatttttgtagttttagtagagatggagtttcaacatgttggccaggctggtctcgaactcctggcctcaagcaatccactcaccttggcctcccaaagtgctaggattacaggcatgagccaccatgcccagcctcatgaatcacattctcttttttttttttttgagatggagtctcgctcggtcacccaggctggagtgcagtgatgcgatcttggcttgctgcaacatccacctcccaggttcaagcaattctcttccctcagcctaccaagtagctgggactacaggcgcccgccaccacgcccagctaattttttttttttttttttgtatttttagtagagatggggttttactatgttggccaggctggtctcaaactcctggcctcccaaagtgctgggattacaggtgtgagccaccacgcccagtcgaatcacattcttaaattagcatagtctttccaggcctatgcatatgatttcggtggtggtttccgggttggtttaggcaatggaaacacaacctggcaaaattaatagagaagattcagaaatgtcacccacagtcaaggtcacgagcccctcccttcagactcacttactcccttcagatacttattattcattctcttttccttcccccttcccagaatctcttttgtcaatattgttctactccattagcaaaacagactttatatcctattaatcaaatatttgtcccacttgagtccctttctcccctcacccccaggcccactgtcttcctgcaacagagaccaagaaggaaggaccctgaaggaagctcagggaaccctgatcttcagtgtagggttgcgtctgttctgagtggagggaagtgctctgtgaccacacatgcccctcctacacccccagggcaaagaaatgtggtcaaggtggaaggcagtgcagtacctggttctcatggagcacactcaagaaacgtgctcaggatcatgactctgataatatgactttaggctgggtgcagtggctcacgcctgtaatcccagcactttgggaggccgaggcaagcggatcacgaggtcaggagttcgagaccagcctggccaacatggtgaaaccccatctctactaaaaatacaaaaattagccagtgtggtggcacgcacctgtcatccagttacttgggaggctgaggcggaagaatcgcttgaacccgggaggtggaggttgcagtgagccaagatcacgccactgcactccagcctaggcaacaaagtgcgactccatctcataataataataataatagtaatatgactttaggtaggaccatcagcaaacccagagccagtacatgccctgaaaaacccaccgacgcaacatagcatttttcagattgtattttttaaatgtttataatatgtcatttacataccataaagctcacccattgaaagcgtacaacttggccgggtgcggtagcgtatgcctgtaatcacagaactctgggaagccgaggcaggtgtatcacctgaggtcgggagttcaagaacagcctggccaacatggtgaaatctcatctctactaaaaatacaaaaattagccaggtgtggtggtgcgtgcctgtaatcccagctacttgggaggctgaggcagaagaattgcttgaacccaggaggcggaggttgcagtgagctgagattgtgccactgcactctaaacagagtgaaactccatctcaaaaaaaagaagaaagtggtgtataattcaacgtttttttcatatacttatctagttgtgagccatcattttaatctaattttagaacattttaatcaccccaaaaggaaattttgtttctgtttgccgtcattctgcataccactcccttcccccagctttaggcaaccactaatctgcttactttctccatagatttgcctcctctggacatttcatatccatggaattatacagtgtggcctttggtggttggcttcttctacttagtagcatgttttctgaagctcatctgtgttggtgcatgtatcagtacttcatttcttcttttttttaaatttcaacttttagatacagggggtacatgtgcagaatagttatatgggaatattgtgtaatgctgaggtttggagtatggatcctgtcaccctgtggtgagcatagtaccccatggacatgatttcattcttttttatggctgtgtagtattccatgggcacctagattgatttcatgtctttgcttttgtgaatagcacagtgatgaacatatgagtgcatgtctttttggtagaatgatttcttttctttgggcatatacccaataatggggttgctgggttgaatggtagctctgtttcatatgtttgttggccacctgtatgtctttgagaagacttcatttcttcttatggcacagtaatatttcattgtatggatataacacatgttgtgtatctgatacaggcaagcccctaaatgggtgcttagcccaggaggttcttggcttcacccaggaaagaattcaagggtgagccggtggtgttaaaagttgaagcagtaggccgggcgcggtggctcctgcctgtaatcccagcactttgggaggccgaggcgggtggatcacgaggtcaggagatcgagaccatcctggctaacacagtgaaacccccgtctctcctaaagatacaaaaaattagccgggcatggtggcaggtgcctgtaatcccagctactcggaaggctaaggcaggagaatggcgggaacctgggaggcggagcttacagtgagccgagatcgccactacactccagcctgggcaacacagcgagactccatctcaaaaaaaaaggacaaaaaaaaaaaagttgaagcagtagcagcagaggtgctgctccttgcagagcttgactgccccctaagcagtgtgcccagaataacagcacagaggcagtgctccactcattttatagtcacttttaattatatgcaaattaaggggtggtttatgcagaaatttctaggatgcgggtggtaacttccacgttgtcaggtcattgccatggaaaggggcagtaacttcacagtgttgccacagtgatggtaaatgacatggccgcttcttatggaaacctgcttccgccctagacctgttttagctagccctcaatttggtccagtgaccgagcgagcttctagaatcaagtcttcatttctcagtgtttgttttgttttgttttttgtttttttgttttgagatggagtcttgctctgtcgcccatgctggagtgcagtggcgtgatcttggctcactgcaacctccacctcctggattcaagcagttctcctttcccagccttcccgagtacctgggactacaggcagatgccaccacgcccagctaaatttttgcatttttagtagagacggggtttcaccatattggtcaggctggtctcgaactcctgacctcaggtgatccacccacctcggcttcccaaagtgctgggattacaggcgtgagccactgcacctggcctcatttcttcctatggcataataatatttcactgtatggatataccacctattctgtatccattcatcagtaatgcagttgctgggtagctctgttttaagttctttgagaagtctccagactgctttccacagtgtggactaatttaccctcccacctacagtgtatcagcattccgttttctccacggcctcaccagcatctattgttttttgactttttaatgatagccattctggctggtgtgagatggtatctaattgtggttttgatttgcatttctctgatgattagtaatgctaagcattttttcatgtttctcggcgacctgtatatcttcttttaagaagacttcatggtcaggcatggtggcttacgcctgtaatgccagcacttcgggaggtcgaggcgggcagatcacttgaggtcaggagttcgagaccagcctggccaacatggtgaaaccccatctctactaaaaatacaaaaaattagctgggcgtggtggcgcatgcctgtagtcccagctactcgggagtctgaggcaaaagaattgcttgaacccagaaggcggagattgcagtgagccgagatcatgccactgtactccagcctgggcgacagagcgagactccatctcaaaaaaaaaaaaaaaagaagaagaagactttgtttctttgtatgccagaataatatttcattgtgtggatataccatatattgtgtatccatcaatcagttcatggaaatgtgtattgtttcccttttttgtggctattatgaattagaacatccatgtacatgttttgttttttggggttttgtttgtttgtttgtttgtttgttgagacagggtctcactctgtcactgaggctagagtgcagtggcatgtttacagcttaatgcagcctcaatttcctgggctcgagtgatcctcccaccttagcctctcaagtagctgcgactataagcatgtgccaccacacctggctaatttttgtattttttgtagagaaggggttttgccatgttgcccaggctggtcttaaactcctggactcaagtgatccacctgcctcagcctcccaaagtgctagggttacaggcgtgagccactgcacccagcccatgtacatgtttttgtgtggatatgtgttttcaagtctctcgggcagatatctaggagtgaaattgctaggttaaatggtaaccctatgtttaatcttttgatgagctactgaaatgttttcaaagtggccacactatttatatttctgtcacaatgtatgagggttccagtttctccctatctttgccaatgcttgttattgtgaacatagaatttaactagtctttcacttaggtatttaccaaattttggctaagattctgatgtcccagccacatgtgtgtgatacgtcgaatagggttgaagcattcactcaacaagcatgtattcaacatctgtgatgtacccacctgccagacccatgacaggggaagcttcagaagcagaaaggaggagccctcattctgagccacccaggaaagggtccttggaggggatgacactgaagtactttttttttttttttttgagacagagtctctgtcacccaggctggagtgcagtggcacaatctcggctcactgcaacctccgtttcctggattcaagcgcttctcttgcctcagcctccctagtagctgggattacaggcatgcatcaccatgcccagctcatttttttatatttttagtagagacgggcttttaccatgttgcccaggctggtctcaaactcctaacctcaaatgatccacccaccttgtcctcccaaagtgctgggattacaggcctgagccaccgtgcctggccaagtgtttttttgttttgttttgttttgtttttaatacagctgggatcttgctatgttggccaggctggccttgaacttctggcctcaagcaatcctcctgccttggcctcacaaagtattgggattaaaggcgtgagccactgtgcccggcccctaagttaagtcttgaagcaaggaaaggagaatcaggcagagtgcaggacttggtgggggagaaggaacttcaggaagggggaccagtgcctacctaggaggttccagactcctggggctttggagaatgaggccagcagaagcttcttaaggctcacgagagaggtgtggctttgggaggctggtccggaaaagatgccagaaaaataagtaataacatcaaaggccttgtacctccttcctgccagggcatattacttttatgctacactcatggtgccatggacagattttgaggaggggagtttacatctgggaggccaccgtggcagcagagtggggaatggtggatggagagattgagaagaggcaggagggcaagcattcacccgctactttgatgaaggcctggcgtcagctggcatggaagttggccctgggagtgcactgtgttttttaggggagctacagttgtggaagtggtcaccatagcaaaaaggtcctaacagaggaggcagatctgtaagggaagtcaagggcagcctgaaagccctctttagaggccagtgccagatggccttggcggagccacggccagatctgagagaataaacctgtctttatttgtaagcagcctgcttttacctcccaagcccacccctgagacacagtctggtctgcattaaaagggctggggctgtcccagccaatttgattttgtgtctcatcctatctacttctcaacacaggaccccttgactgccaggtttctcctgggaggggagatgccaattttctgcttcagcctgtagactccgctgtgtgctgtgaggttctttcccttcctggggtccaacatccccgtgaacaggaccaggactagccccaaacccacagctggacagcagatcctggagcagctgcacgtcttctttatgataatgaaaactggctgggcccggtgacccacgcctttaataccagcactctgggaggccgaggtgggcagatcacttaagcctaggagcttgagactagcctgggcaacatggcaataccccatctctacaaaaaatacaaaaattagccaggcatggtagtgtgcacctgtagtcccagctacttgggaggctgaggcaggaggattacttgagcctgggaggtcaaggccgcagtgagccatgatcctttctcaaaaaaaaaaaaaaaaaagtactgaaaattagctcatacatacatatttaagcataattactgggttttatatagtttacatgttctaaggtatctctgaaaaaaataatcttctaatgaaataatcagcaaatgattggctaatggcaatcattagacaaatattggatgattaaacttaaaaaaaaaaaaaaacccttgctgggcacagtggttcatgcttgtactttgggaggcctagcactttgggaggccaaggtgggtggatcactcgcgttcaggagttcgagaccagcctggccaacatggcaaaacccggtctctattaaaaatacaaaaattagctgggcatggtggcgggtgcctgtgatcccagctacttaggaggttgaggcaggagaattgcttgaactcaggaggcagaggttggggtgagccaagatcaaaccactgcactccagcctgggtgacagagcaagactccatctcaaaaacaacaacaacaaaaaaacccttttacctgtttttttcattcttgtaattgaagtataatacaaatcttaagtgtaaaactcagtgaatgtgtacacgttacatccaggtcaacatataatcatcccagaagtttccttcatgtccctttgcaccaagcccccacccccaaagagattactgctcatctaacttttatcaccatacataaagttttgcttgttcttgaacttcaatttgaatcatacaatgtatatgctattgcatttggctacttttgcttaacatagcatcagtgagagttgtacacgtttttgcatgtatcagccatttgttctttttcattgctgtgtagtattccattgtgcacctagaccacaatttatctgtctagtttcttgcttatgaacatttggactgtttccagtttttgcctcctgtatttaaagctgtcgtgaggccaggtatggtggctcacacctgtaatcccagtactttgggaggccaagaagggaggatcacttgaggtgagaagttggagaccagcctgggcaacatagtgagacccatctctacaaaagaagaaaagaaaaaattgaggccaggcacggtggctcacacctgtaatcccagcactttgggaggccgaggcgggcagatcacgaggtcaggagatcgagaccatcctggctaacacagtgaaaccccgtctctactaaaaacaaaaaaattagccaggcgtggtggcgggcacctgtagtcccagctactcgggaggctaagacaggagaatggcgtgaacccgggaggtggagcttgcagtgagccgagatcgcaccactgcactccagcctgggcgacagagcgagactccatctcaaaaaaaagaaagaaagaaaaaaagagaaaagaaaaaattgagacacaatataattcacccttttaaataaatgtgcaattcagtggtttttcgcatatgcacaaggttgtgcaactgtcaccactgtctaataccagaatgttttcatcactccaagaggaaatgttatatccattcataatcactctacatcccttcctttcctcaatccatgtcaactactaatctactttctgtctctatgtttgtttgtttgtttttgagatggagtttcgctcttgttacctaggctagagtgcaatggcgcaatcttggctcaccacaacctctgcctctcgggttcaagcaattctcctgccttagcctcccgagtagctgggatgataggcagtaggtgggattaccaccatgcccagctaatttttgtatttttagtagagatggggtttctccatgttggtcaggctggtcttgaactcccgacctcaggtgatccgcccgcctcagcctcccaaagtgctgggattacaggcgtgagccaccacacccagccctatttctatgttatttaatacttattcctgacatttaataatgatggtcaaacttttaatatatcaatttctttgatttttttttttctaggatcctaagcacttcaagtcagagaagacaggacggggacagttgagggaaggctggagagatagtcatcagcctatcatgtgctcctacaagctggtgactgtgaagtttgaggtctgggggcttcagaccagagtggaacaatttgtacacaaggtaagtggtccaacagcagttcctgggctgtggacaaggtaactgtctatattgccaaattggagtccatgatacacaacaggtgcacaaatacatcaggtcactgcatctcaaaaacactttttgggccggttggggtggccaacacctgtaatcctagcactttgggaggccgaggcgggtagatcacttgaggccaagagttcaagaccggcctggccaacatggtgaaaccctgtctctactaaaaatacaaaaacattagctgggcatggtggtgggtgcctgtaacccagctactcaggaggctgaggcaggagaattacttgaacccgggaggcagagattgcagtgaaccaagatcgtattattgcactccagcctgggcaataagagagaaactctgtctcaaaaaataagaaataaaaataaaaaataaaaaaataaaaaatactttttggatgaaaatgcattttatgcataggttcaattttcttccactaatagatgttttatgccccatctctcattctgtgacctccatgtctattaggcaagcgtatttgggaaacacacttctcagtttggtattggactcatctactcccagacagagaaacttgggaaacagccaaagggcttatctgtgagcacagcccctaaggttaattgccacccaaaagatctacaaatgtaagcacctaagcagaagatgcccagaggtagaacaagaaatcccaatagtcccattagacagtataccccagcatttctgcttctttaataattctgttactaaagtagccaggtgtggtggctcatgcctgtaataccagccctttgggaggctgaggcaggtggatcacttgaggtcaggagttcgagaccagcctggccaacctggtgaaaccctgtctctgctaaaaatacaaaaaaattagccgggtgtggtggcacgtgcctataatcccagctactcaggaggctgaggcagggagaattgcttgaacccaggaggcagaggttgcagtgagccaagatcgtgctgctgcactccagcctgggtgacagagcaagactccatctcaaaaaaaaaaaaaaaaaaaggaaataataagaataattctgttaccaaataattgttaacagcctcgggatgcagatttcaattgtaaacctactttggctaaacatgttcattttggttttttgttgttgttgctgctgctgttgttttgagacggagtctcactctgtcgccaggctggagtacagtggcacaatctcagctcactgcaacctctgcctcccgggttcaagtgattatcctgcctcagcctcccgagtagctgggactactgggaggtgcgcacgccaccatgcccagctaatttttgtatttttagtagagatggagtttcaccatgttggcagggatggtctcgatctcttgacctcctgatctatctgcctcggcctcccaaagtgctgggattacagacatgacccaccgtgcccggccggcatgttcattttgtagcagaatcccacttggtgaagagtcatattttctcagggtttctaacatgactctgtccctcatgggagaaaaaaatgggaaatgcaatgttgagcattgccctttgtagctgctctcattttcataagaataaatactacccaaattgtctctacattccagataggctggttatctgtttatttttccacttaaaaactgataagagtagcttgccaaaattattttggagtcactggaatttaaccttaatgcactgagctttttgttacttagatggatttgtctattgagattgggggccagttaacaataaaaagtttaattctggaatttaggtccaagaactagactgccagtctcttgaaccctcataactcaggctcacggtaatggcagactctggcacaaacatgagagccctgggtgttttcttgaacagagaagcatgccactcctttcccgtgctccagaacccagccagccagccaggagccagaatgaaatgtgatacgtagaaatcaagctccaggatctcctgttttcctcctgtgtcctgattattgcacaggaaagcaattgcagctcccaaagtaaatgttttccagcctcagctttgtgtctatctaaggcagtgtcttccttggtttcccacagcatccctttttgtgtgtggctttttaaggtaaaaagacttcctcttactagggccactatcatagtattattttgttttgttttgtttttttgagatggagtctcaatctgttgcccaggctggagtgcagtgacatgatctcggctcactgcaacctccacctcccaggttcaagcaattcttgtgcctgagcctcctgagtagctgaggcacaggtgcatgccaccacaccaggctaacttttgtattattagtagagacggggtttcaccatgttagccaggccagtctcgaactcctaaccttaagtgatttgcctgcctcggcctcccaaagtactgggtttacagtcgtgagccaccatgcccggcttcatagtgtgttttccactcacaaagcatatttaataaggcagagttgtcagttaaaaagagaataatacaaaataaaaataaggctgggcgtggttcacacctgtaatcccagcactttgagaggccgaggcaggcagatcacttgaggtcaggagtagttcgagaccagcctggccaacatggtgaactctcatctctactaaaaatacaaaaattagctgggcgtggtgacaggtgactgtagtcccagctactccagaggccgaggcaggagaatcacttgaacccaggaagtagaggttgcagtgagcctaggtcgcgccactgcactacagcctgggggacagagcaagactctgtctccaaaataataataataataataataataataatttaaaaggccatatttatattgccccagggtccactgtgtttcttttctcacagatgactcaggctagttttgagaatctgtttcctgaaaatacctgtaagatttatgccttgccctttccaaatataaggaagtgttattgacactccagaaacgcacctgctctcgcacgtgagtcgctaatgagtatctgaggctagcatttgcatgggttgaaggtgccagggatgcctttctctgaacacctttgtttttttaagaatctattcacagttaaggggaaaaaaatgttcgaaagcgagccatgagcacattattgaattctggtttccagccgacagctgtgttgtgcttcgtgtaatagggtacatttactgatgcctcgatgctgttcttttgatttccatgaatttgagacactcagcactcaagtgtgtatagctgtgtgttgtttcttgtattcattatgtgtttcctactttcaagtcataaaagcctcactagatatccagaggcctggagtcataaacacttcattataaatgctttccttgtttctgcaaattcactgaattaaaatccttcatttattgaaacatgcttgaaccttccacgagaggtttttcacaatcactggatttgtttggcaggaagaaaggaatgttacagggatactgtgagtatccaagaaatgtaaaaagacatatttacccaggatggaaaagaataccatgaaataaaaacacatgaacagtatctcacacacgcagacacacacacacacacaaatggtatatactattttccttagccttctattgccattatgtgtcaccataagaaacaatttcatcctttttgtgtccagtcaagcttgtcattcccattacgttctattctagttcaggtctcttttttcatcctttcaatggtaaacggcctttttccccctcttctattacatgaaagtcaaacctaaaaggatatttacttatcttgtatctcacacattcatttatgcttgtttaaaaattgaggccaggcgtggtggctcatgcctgtaatcccagcactttgggaggccgaggcaggcagatcacaagatcaggggttcgagaccagcctgaccaacatggtgaaaccccgtctctactaaaaaaatacaaaaattagccgggcatggtgacaggcacctgtaatcccagctactcaggaggctgaggcaggagaatcacttgaaccagggaagcggaggttacagtgagccgagatcgcagtgagccgagatggcgccactgcactccagcctaggggacagagcgagactccgtctcaaaaaaaaaaaaaaaaaaaaaaagataaaaagaaaaattgaatcaatatttattttttaaataattttttgtgggtacatagtaggtgtaaacatttagggggtacatgagatgttttcataaggcctgcaatgtgaaataggcacaatgtgaggaatggggtatccatcccctccagcatttatcctttgtgttacaaagaatccaattacactcttaagttattttaaaatgtacaattaaaaaattgaatcaggctgggtgaagtggctcacacctgtaatcccagcactttgggaggccaagacaggtgaactgctcgaggccgggagtttgagaccagcctggacaacatggcgaaaccctgtctgtactaaaaatacaaaaattagccaggcatggtggtgcgcacctgtagtcccagctactgaggaggctaaggcacaagaatcgcttaaacacaagaggcagaggttatagtgagttgagattgcaccactgcacttcagcctgggggacagagcaagactgtctcaaaaaaaaaaaaaaatcagtatttaggatatgtcatcagaaaagagggaatgttaagtgctgttcactttttaggatatgtcatcagaaaagagggaatgttaagtgctgttcactttttaggatatgtcatcagaaaagagggaatgttaagtgctgttcactttttaggatatgtcatcagaaaagagggaatgttaagtgctgtttgcttagaagtgacttgctgtcggccaggtgcggtggctcacatctgtgatcccggcagtttgggaggtcgaggtgggtggatgacgaggtcaagagatcgagaccatcctggcaaacatggtgaaaccccatctctattaaaaatacaaaaattagccgggcatggtggcccacgcctgtagtcccagctacttgtgaggctgaggcaggagaattgcttgaaccctggaggcagaggttgctgtgagccaagatcgcgccactgcactccagcttggcgacagagtaagactctgtctcaaaaaaaaaaaaaaaaaagtgacttgctgcctagaaaagtgttctagatttccaaaatttatgacctcctggcaccagtgagacacaccctcccacagatgaaaagtagatgctgttttagttaaaaataaatggagagaaaaacttcaaggtaattaacctagatatttatttgtatcactgctgtgtgactgtcaagtatttgtcattagtttgtacacacacccagccctactctcaaataagacaaagagatgaatatactgcaagtgtgtgtacaccatggggaagggctggaggtgtgtgagcactataggacctataggcagcctgtaattgtcatcacctatggacagagggattaagaactctgtaatcaccaagatccccagaattgttaacaacttgtcttccagatagttttcatcaaagatgctattatttcagtctccttcttttactttttaggtggtccgagacattctgctgattggacatagacaggcttttgcatgggttgatgagtggtatggtaagtcaatttctccaaaataacttgtagaacaacttcatgttgtctcgggctttctgtccatttggcttcaactgctacctagaaggacaacaacaaaggcaaggccgctgcttcctgtgttggaaatagcactgtctgccaagcataatgaagatgtaattatagaagcttggtctaaaataaccacagaattattgactaagtaggaacctcaggatgtttgatgcttacatagttgatacgcatggctccatcattctctgttagatgggtttcaaacccatcctaatttatcccaaacttcaagatcaaagctgtctgaagcatcctgtcaagtaaaagcagtcctttgattcagacaacatttgaaaccaccccttgccgggcgcagtggctcacgcctgtaatcccagcactttgggaggccgaggcgggcagatcacgaggtcaggagatcgagaccatcctggctaacacggtgaaaccccgtctctactaaataatacaaaaaattagccgggcatggtggcaggcacctgtagtcccagctactcaggaggctgaggcaggagaatggcatgaacctgggaggcggagtttgcagtgagccgagatcgcaccactgcactccagcctgggggacagagcgagactccgtctcggaaaaaaaaaaaaaagaaagaaagaaactacccctcaacaaatatatacaggttctgcaagaatttaagggcagacagaggcataggtgccccgttcatcctaattgaaactattgttctggcttttttttcatgatctgggaagagttaaacaatttctacacatttgcagcaaatgaaaacaaggttagcttcatcccatgatggatggaccatccttcccaggtcctcagcagtcttgttttgtccacatgaattttctgcactcccagaatcagtcatcagatggctaccgtccttggctataaatagaaaggaacacgccccaccggtgacttaggttagatctgattttcaggtcgattgtctaatgaaatgcccttctccttggccttttccaaagtcacattaaatttgttctgagtataacctagattgcattttggtccttttctgtcattgtttcaccaactccctcccttttctgagcagaaggtaccaaagtaaaaggacacgttagacggaaggggcaaagacagtcattattattaatattgttagctatttctgagccacatttaaaaggcatggttctataagctatgggcttttcttttttttttctttttttcttacctccttttgcagttttcccagatctgcaccttctgaagagcaaatgcaccttcctgggtttgtccaaatgcagatcatttatgctctcttatcacacacccacagaatgccgctctcataccgcaaaagcactggcttgccacattgtcatgtagtctcccagagacctgtctatttctagttgtgttttgtgaggcaggcaggagagtctcctgtgattacttcctctgatccttaaataaatctttctggttgtttttttctggggcgcttttctccgattctcagagggagcacagaccccaagaaaggataagaacttctggtctctcccagcttgtgctcctcagagctcatggtttccttgctaccaacaccaaggaaatatcaaaaggatatttaaagaatcataggtgcaaactgattagaagtttggcaaaaagagaggtacctgaagggccaaaaatctgccactttgaaaaccaacacacagggcacttggataggtttctctctgttgccagagtgccaaagaagatttttcagctaaaagaatagccgggctctgatcaagaggacagaataataaaaagggtttgattagaggcaggatataggaagaaaacccagtgtgggtgggtatctagtaaatgaaaggccaggaaggcgatggggcctgacttttccatctcagctgagcctagggcaaggaagagacttagggacttctttttttttttttgagacagagtctcgcactgtcgtacggactggagtgcaatggcacaatctcggctcactgcaacctccgcctcccaggttcaagcgattctccttgcctcagcctcccaagtagctgggattacaggctcccaccaccacgccctgctaattttttttgtctttttagtagagatggggttttactatgctggccaggttggtctcaaactcctgacctcgtgatccgcccacctcagcctcccaaagtgctgggattacaggcatgagccactgcgcccggccttagggacttctaataaaagacttagggacttctaataaaaattgaaagaaaaaaaaaaactgccaggcacggtagttcacacctgtaatcccagcactttgggaagcctaggatggaggatcacttgagcccaggaattcgagaccagcatgggcgacatagcaagacatcatctctacaaaataaataaataaaattagccaggcacagtggtgcatgtccgtagtcttagctattcaggagaccgaggtgaaaggatcacttgagcccaggagctggaggctgcagtgagctatgatcgcagcactgcactctagcctgggtgaccgaacaagacctcgtctctttaaaaaaaaaaaaagaattctgggattacaacaggagcccaaggctagaataatgtatcaaaggaaacaggagatctccccgaatctggagaccttcaaaagagagcacttatttacttaggatgagtgaagtggaggcatttaacaactaaggagtctattgtgcaaaaaaccttttccttatctgagcacaaaacaacactgtgggctttagtgaatgtggatcattaggacaccttgcactccccagagtgggtctccccctgcatacactgacatagccccagccaaaacaagcagccttttcactcagcagtggtctgagaactacaccgttaatttcatgtaagcttctgcaaccatcagtacccacagctgagctgctgaccaggaaaacagtggctccttcatcacacagatgcagacactcagtgaatcaaatgaatggaaatgactcctgtccacagagtgccttctcagtcccatattcaaagtaattctgggaactgtgggccatatgtgccactggtacccaggctaagcgcccaccagcattacccttccactccattttggggtacctgaagtggcctatttttatttgttctggacaggctcagtgagactctcatggaaacatggaaacatggaaacatggaaaagatccaaaataaatccttgcctatagctatagcgtctagcactggttctcaaagtaaggtccctggacctgcaacgtcagcatccctagggtacttgttagaaatgcatattctcaggccccaccccaaacctactgactcagaaactctgagggtctagcccagcaattgttttaacaagccctccagatggttctgttgctggctaaagtttaagaactactggcttatagcatgggctataaaccagactgggacattgggttgtaaggaccgtttaattgattcaatccaaataggttaactagagaatcatagctgtctgcagggccaaccacactccagcctgggcgatagagcgagcctttgtctctaaaaaacaaaaaataaaatcaattttaaaatgattgcaggaacccaaattcttacaactctgatttcttgtgagaattagaaaaaaaagcttccctttagacagatgaattagaaaaaggtgccccttctgggcagactcagcaggtgctctgggcttagggctgaatttgagccccatttgcctcctctgctgtgtgttcatacagtgcacaaactgtacacactgatgcatgggtagctctagatgtctttctctctaattagacacaccacctccagtgcttaattaagagtcaagaaaaaaggacattgttgagggtagtgatcatttgtcagccaaggatgaattttgtatctcttctgagtttcagcatttggctgtcacgaaactgtttccctaaagagattttattctgttcgtgttcattgtaaagtgtaaccatttccatattggaggagttgagtgtgtctttcaaagccgtgattggtctttatccatgagccttgggtctctctgcacgactagaacgctaatcagagaaataacaacaacgtatttcaggagatggggtgagagggaaggtggataaaaataggcagcccagtttcacaaaggcttggttttgctttacaaatctgacagtgttttgagaaaggaacacagaacattgccagaaggagcctatgattgaggtgaacctcacgaatgtctttgaaaacctgactctaaccaaaaagtatgagggagggagagttctggctgctgtagacgacactacctcatgaaagtgacttagaaatcagcctggagtccctagagcaggtctaacaatgagggaggcaagattaaaatggagaaagaagcctgctaggggttgcatgagctggttgagttcaccaagccagattttccaacgcaacattttatgtgtgtgtgcttgtattcgtttatctggggagagaatgaataactttccatcagattttcagaggaacctgtgaacccttcccctgcctactccctgctcccaattaaaaactacagaaaaaaatcacaactataaggctggcacggtggctcacacctgtaaccccagcactttgggaggccaaggcgggcagatcacctgaggtcaggagttcgagaccagcctggccaacatggtgaaactccgtctctactgaaaatacaaaagttagctaggcgtggttgcgggcacctgtaatcccagctactcaggaggctgaggtaggagaatcgcttgaacccgggaggcagaggttgcagtgagctgagatcgcaccattgcactccagcctgggcaacaagagtgaaactctgtctcaaaaaaaaaaaaaaaaatcacaactatagattacagttctagatcttagtggtctgaattatgtggaaaaggtatacaccacacttcgaggactggctactttcactacaaaaaaatggagtcaccctaagctttttgtaagaagcatgtattgaatttgtaatcattgtaaagggtttaaaaaatggcatttctcaaaggatggctaccattttgctggagccaaagaagtatccattcttatttatgatttctggggcctccctgacccaactacttgttcaagacttttattttgacttagaatgatgtaaaaatgacttctgttttggtgaaggaggctgaaagtgaacggaaatgtttgtagagggaaataaagtataatgtgccatttcacagatcattgaattagaacagaagactcccctttttaaaatgtttgctgctgcaactgtgtggtacaatgaaggaaaattcacgcttgcagatgctttgttcaagggcatttgtagtttccatgtgtgttcaactgacttctaaaggcctttcaaacatatgatcttgcctccacttcctgtgaaattaacctcctttctttaaaaatacaatgatttaaagaaaattgccaccataaacaaagctaaaagactaggggaaaatatttgctgcatatgtagtcaacaggattaccatctataatatataaagaggtcctataaattgaaaatttggccaggtgtggttgttcatacctgtaatcccagcactttgggaggccaaggcaggagaatcactcgagctgaggagtttgagaccagccctggcaacacagggagaccccatctctacaaaaattaaaaattagctggacatgatggtgtgcctgtagtcccagctgcttgggaggctgaggtggaaggaccacttgagtctgggaggtcaaggctgcagggaactatggtcacaccactgcactccagcctaggtgacagagcaaaaccctatctcaaaaaaaaaaaaaaaaaaaaaaaaaatcagtcactcaagaaaatggtaaaggatatgaataagtaaatcatagaagaagaaatacaaatagccaataaacttactagtaatcacaagaaccgtaatgagaaaaacaagaaaataggacatttgcccatctgatagcaaaaatttaagagtgattatatccagttttcaatataaaatgataatccaatttaataaaatataccatagaaatgataagcacaaacaacttatgacccagccaatccacttccagaattttattctggaatacacatgaggccaggtgcagtggttcatgcctgtaatcccaacactttgggagaccgaggcaggcagatcaccttaggtcaggagttcaagaccagcctggacaacatggtgaaaccccgtctctactaaaaatacaaaaatagttagctgagtatggtgacacgtgcctgtaatcccagctactcaggaggctgaggcaggagaatcgcttgaacctgggaggcagaggttacagtgagccgagatggcgccactgcactccagcctggggacagagtgagactctgtctcaaaaaagaaaaaaagaaaaagaaatacaaattgcccatgaatacatgtacaacaagtacaaagctattctgtgtggtggtgttcatataagctaaaaattagtctcagtgtaaatgtttactaacaggattatcaattaacaaatcccctgagaccagagcctctttgccaaagtggagctgatggttgaggaggagattttggcctcagcccagtcactggcagaggagaacgttctactcaggccccatgcagtatgacctcacgccctgagataagagtctgggatctgatctctcctcacctgaaggagagcaagaaagagaagaaaagaaatggcctctccagagggcaaggaaaggaaatattgtcccactgaagtacagtgagcagggcatgtgtgttcccaaaatacttcccagggctgtttaacctctgatagcagagtctcaaagatattaggatgcactttctttatcagaagaaataccgtaccagttgcaatattctcttaaattaggcaattatccccagtattgctggcttaaggagtctttatgtaggaaaccttatttaggaagagtaaattatgacctttcacaatctataagtgaagggctgactgtttaccaatgtatttgcaaagtaattgacatgggcttcctttaattaagagtttgggccgggtgtggtggctcacgcctgtaatcccagcactttgggaggccgaggcgggtgaatcacaaggtcaggagttcgcgaccagcctggccaacatggtgaaaccccgtcactactaaaaatacaaaaattagctgggtgtggtggcgggtgcctgtaatcccagctacttgggaggctaaggcaggagaatcgcttgaacccggaaggccgagtttgtggtaagccaagatatcacaccattgcactccagcccgggtgacaagagcgaaactgagtctcaaaaaaaaaaaaaaaaaaaaaaaaagagttgatacacataagcatttgtttgctggaagcaaagaagtctgaacctaaattgtttgaagtcactctgatcattgaaaatcaatcaataataaagatgaatcatcattactgtataatctgtcattgggcacatgtaactgaatttactaaaatattgatttctacaaagattttgaggtcatatatgttgcaaaagctagacagtgcattttaccagctaacctgaacaggagcattttcacttgattaggatttccataaatttctgagaaatactgaaaatatttacatcatgttcatacacatttatagtctgtgaggatatttcaggatttagacaaacatattttccttcacagcagggaccatattatcaccatcttttagagaactactctactaggaatgttcattcctatgtggcaaaattgggagattttcttttatagaattttctgaaatttcatttcttaactctttgtttaaaaaaaataataggggatggctgggcgtggtggctcacacctgtaatcccagcactttgggagggcgaggtgggcggatcacttgaggtcaggagttcgagaccagcctgaccaacatggtgacaccccatctctactaaaaatacaaaaatcagccgggcgtggtggcacacaccagtaatcccagctactcgggaggctgaggcgggagaatcacttgaacccgggaggcagaggttgcggtgagctgaaattgcaccagtgcacttcagcctgggtgacagagttagactctgtctcaaaaaaaaaaaaaaaagaaaagaaaagaaacaggggattatgtttctagagtgaacagaaattctggaaaagtctatcttctccttaccaattccaaattgacggtatccatctcataatgatccaaaataacaaattttttttttttttttgagacagagtcttgctctgtcgcccaggctggagtgcagtgacatgatcttgactcactgcagcctccgtctcccaggttcaagcgattcttgtacctcagcctcctgagtagctgggggttacgggtgtgtgccaccatacctggctaatttttctatttttagtagagacagggtttcaccatgttggccgggctggtctccaactcctggcctcaggtgatccgcccatctcggcctcccaaagtgctgggattacaggcataagccaccctgcccagcccaacataacagattcttaaataatgtttttttttttcttttccacaagcaacgcatatttgatgtagaaaatttcaaaaatgtagataagcaaaaagaaggaaattaaaattacctgtaattctaactcttcaaaataatcactgttaacattttgaaatatatcctttcagtgtttttttaatgtagataatggttttctgactaaattgatttcatatgctatatacagttctttttacctattttttatttaacaatagattaaggatatctctctaggattaactattcttctacctaatttttaacaattgcatagtgctatcagtcccctgggttgttttcaatttttcattattatgaacattgctgaacaaggcagcaatgaatatctttgttgttaaaccctttttcacatccataaaatggatacatctttgaaagcccatagtcacaaagtttaagcccctatcttgacgttgagctaattcaagatgaagtatgatttctgtggggattcaatagaacaaaaaaacctataactccttggcttttgttttccaaattactgtcatgcctgttgggatggtggggggcaccccctaatgacatatgtgtagagaaacttctttaaattttcaactcctagctaaaagtgatcgtctagtattatttcagatatatttgtgtttaagaaatgttgataagcagccattgaaagtgattgtactgaaagaatgtgttgttattattaactaagatgcatttgttttcatcataaagcagcatctctttattgctttttggttacctcgattttctaaaagaagagcatgctccttgcttggccaagctgctgcttagcattcttgatacttacattgcttatggaccgcatttgcgattgaggatctccaggtatacctgggaatgatcttctgcataaaatagaccaggtctggatttagaggcacacagcatcttggtcccagaccacagtgaattaaatcataaactcctggcaaatctgccctttggaaatgaagaggatctcacatgacacatggattgatataaaaagacaccaaaccacatgatgcagaaaatacctaaggaaaaattccagctgtgaatgcccactctaaatccccactaagccaattagtggtcagggtggcagaggaagcactttgttcggcataccatcattggtaaagagcatgaagttccgctctgccaagagagtaacagaggaatgcctacctgggaatattgctgataaaatgtaaaataaccaaggagccgggtaggggtgggggtaaaatgacagaagtatttgaagtgagactaattgttatttatatgcatttcacatactgaaggtggatgggttccttatttaagttttttttgtttggttggttggttttttttgagacagggtctcactctgtcgcccaggctggagtgcagtggtgtgatctcagctcactgcaacctctgcctcccgggttcaagtgcttctcctgtctcagcctcccatgtagctgggattacaggcgccctccaccatgcccagctaatttttgtatttttagtagagacggtgtttcaccatgttgtccaggctggtcttgaactcctgacctcaattgatccacccgccttggcctcccaaagtgctgggattacaggcatgagccaccatgcctggcctgaacatttttatcagttggattaagacagggtttctcaactttggtactattgacattttggaccagataattttttgttgggggctgggggtcctgtgcattgtaggatgctccatagtgtccctggaatctgcacactagatgccagtagcaccccttccctagttctaacaaccaaaaatgtcacaaaattgtcccccgttgagaaccactagattaagagatcattatcctgaaatactgaaaaactgcagacttgggccaaaaatcatgtcatgtgccattttatttttagatcagtgtgggtggaagtagtgccagccatcttcaagctgttagccaagacttgaggttcagtatagacctgcactctctgacgccatgcattctgtgcaaatttacatctgtgtgcaagttgcaccaaatctcaattgtaccagtgaatatcattgctctgccttctacatcctgcctcctataacagcaatgaaagtgtcctttctgttgttgaatgcattgatttaaacaacctctaaatctattttgaaagctatgtggaaggtaagtattaaaccaagcaaaactgaccctctgtccccaatgggatcttctaatgatgctttaggagatctcaggctatggtactgcccacatgctaatactttctacccaaacctagctcactttacaagaatcacccctaaataatttccactcttctctgttctaagactattttgacttaacttccttgccctcactccccctttggttggtttagctaactttatgacttactcatcataaagttagacaagtctctgcttttttaaacctccttggctactgctcagctaccatctttccctaaagtgtccccattgaaagtttgcatctaataacggaagttgccaacatcttgacctctttcagatatgacaatggatgatgttcgggaatacgagaaaaacatgcatgaacaaaccaacataaaagtttgcaatcagcattcctcccctgtggatgacatagagagtcatgcccaaacaagtgtacgtagaatttttaaaacatgttgcccaccctttcacaaatgcacatgtaaactgatctgggaaatactgcagatgcccggttcgcaaccttccatagaaacatgtcgtcacccagaccctgttgctgcagaacctgagctggatctaaattgggcagtgtcacctctctcttccagacatttcgatcccttaaagttgcttgacgtggaggttatttcggtcataaaaccaagaacatggagagtggaaacacttttgtgggactagtaaaacggcctgcaccataaaagagcagaggagtgaaaatcgatgtcatatgtaaactagaataacatgtcagtaacttttaaaaacatagctaacactcacttattcattcaagggagggcttctggctcatcagctattttaggtttctttacatttgctttgaaaagctttctgtggctctttatagctgttttacccaatcagttcctttttacttaggataatctcaagatgggctgcagtctgtgcagacacacaggctgagcagtgaaggggtgtgagctggggatgtgctgagctgcctagcagatccctgggacttagggtaagccttagagagcctcagttatttcgttgcacactggaaattgagagctgactgtatattgtatgccagcattttaagtatcgtaatctctcaatcattcatgctaatgaagggtagctagagataacaaagaaaagtgtaatcaccaaatcatttctttgcatcttcagccagagctgtgatctctttgggttccgccttgagtcctcatgtccattagcccagtctccagaataatacatagtaggtgttaaaaaaaaaaaaaaaaatcagctgggcgcggtggctcatgcctgtaagcccagcactttgggaggccgaggcaggtggatcacctgaggtcgggggttcgagacaagcctgaccaacatggagaaacctcgtctctacttaaaatacaaaattagctgggtgtggtggcgcatgcctgtaatcctagctactcaggaggctaaggcaggagaattgcttgaacctgggaggcagaggttgcagtgagccaagatcgcgccattgcactccagcctgggcaacaagagcaaaattctgtctcaaaaaaaaaaaaatcaatgctgtagttctaggaaatttagatgtggctgttgtcataaatggatcctttagaattgtgaagaccttctgattgcactttggaaatttttagttaaatttttggagcatgtctttggaatgtgccctgcaagtctcatgtgctgcaactggttgcatgtgattgcccttgaggttgcaagggccctaactcttctcccattttgcatgcagtgatctgatttgcaggaaactgttggagcaagaggcgtttcctctctatgcacagaccaattccagtaggacttccccctagaagtgctctttaaggaaactctccttgaatttctatcactttcaattaccttttcttttagaaatgttgggccccagttccccctcagccactctgaaagccattcactataaatatgaccaggcaaacaaaggaagaagccacaggtaaagaggagacaccagatggctaaaagatgctaagctcagtgattttctcacagcttataagccccttggcttggctttctttcagttttactgtgattattactttataattaaagtccatggctgggtgcggtggctcacgcctgtaatcccagcactttgggatgccaaggcgggcgtatcacctgaggtcgggagttcaagaccagcctgaccaacatgaagaaaccccgtctctactaaaaatacaaaattagctgggcgtggtggcgcatgcctgtaatcccagctactcgggaggctgaggcaggagaatcgtttgaacccaggagatggaggttgcagtgagcagagattgtgccactgcactccagcctgggcaacaagagtgcaactccatctcaaataaataaataaataaataaagtaaaataaataaataaagtaaaataaaaaataaagtccacttactatgtagaaggtgataacgtagagtggttcttcccatggaaaagcccacataatctctggctgcccctcagcgttgttcccgtgacttcagggtgaaagatgcctgccaccggagaagttacacaaagtggttattttgaatgcttatgacatttccattatcctttggaattccgtgaaattggagcacatttatttttccttagtctttctcctgtatcataatgaaaagcagtgaaaatcaggaggtggctctttgtcacaaataaaaactgcatgggtgctaaatgaattttagatcatcaacccaagcagggacaaattagattgaaattaggcaaaattaacatccatgaacacagcagtgaggaaataagtcttttcaattgagcaggttcaaagccttcaaggacgggaacttctaagagcctctgggagtggaaaatcaaaattctgtgctttagattatttctgccccctgctggctatgtggagtagaacaatgtattcagccacttgattaagaaagtctgctttttcaaagataatatccatttatcatagcaaaaacataacataccctgatacactaaaatttttctcagtctcaactttattgtgaaataaatgcctctttttatataaccttaatctcacttcttagctcatttaatagtcttccatgtttttaaaaattggtaagtttataggtacaatttttcttgatatatgctgaattttatatcttatccacatagtcataatgacttatatcctttgtaaaaactttccctttcagaaaattttaataattgttcccaggaaatcctcttaaggatttcattttgtgaaaaatacttctggtttgctcagatgttataaaacctaaagattaagctgggcacggtggctcatgcctataatcccagcactttgggaggctgaggtggacggatgacctgaggtcaggagttcgagaccagcctggccaacatggtgaaaccccatctctactaataacacaaaaattagccgggcgtggtggcagacgcctgtaatcccagctactcgggaggctgaggcaggagaatcgcttgaaccccggaggcggaagttgcagtgagccgagatctcgccgttgcactccagcctgggagacaagagcaaaactctgtctcaaaaaaaaaaaaaaagaaaaagaaaagtcctaaggattaatactgtgttatgaatattcattacatactcagtatttccaaagtggctatattgtttcctgctggttattccctccaatattatctaatgaagtttcaactgctaagtacatggcagtggacaagaaacaatgaaaaatgggtctctggggggccaaaacagatacagaaaatccgcgggcactaaattttgcattttgctccaggataagccttgggccttgactcagtctttaataagcccaggttcctcttttccctgttcccagcaagtaaaaatggcaaaggataccagggatagccagggtaacaataattaataataacagtaataaggctgggcacggtggctcaggtctgtaatcccagcactttgggagtctgaggcaggtggatcacgaggttaggagttcgagaccagcctggccaacatggtgaaaccctgtctctgctaaaagtacaaaaattagcagggcatggtggcacgtgcctgtagtcccagctattcaggaggctgaggcaggagaattacttgaacccaggaggtggaggttgcagtgagccaagatcacgccattgcactccggcctgtgcaacagagcaagactctatctcaaataaataaataaataaataaataaataataacagtaataatagagtttctgagcatgagagaagagatatcaagccataaagagcaaatagaccctgagaaggaactaaggaactgtatttttgcacagtgatatatcttcaacatattatgtctcaaatgtaggaagtatgtataatacattaaacacattagggaaagatttacattttttaaatactgtttttactttctcacttaaataagaacatttcaggtatttggaaaacctacattatccaacaatgattattaacagtggtatcactgtcttatttgttgaattccaagtcatgcttttttttcttttaaatagaatcctcactattaaatgatcctctcctttcattctctattctttttaagtttcctcaagaaatggttttattttcttggctttggaatgattagcagggtgtggtgaaattgttgatttacgtgtttttgaaactgaatttattaaaacacaatctctgaaccttcttaggatcgacacacagtcaggaaaccagaaacaacagcatctttgtggcccctcagaataaaaaagtatatgtattgattaagaagatagcatgttggcctgagtacagtggctcacgcctgtaatcccaacactttgggaggcttaggcaggcggatcacttgaggtgaggaattcaagaccagcctaggcaacatagcgagaccctgtctctacagaaaatacaaaaaaattaaaccaggcattatggcatgcacctgtggtttcagcctcacggggccctaatgcaggaggatcacttgagcccaggaggtcgagactgccgtgagtcatgatcgcaccactgcactccagcctgggtgatgcagtgagatcccgtctcagaaagaaaaaaaaaaaagaagatagtatgttgaaaaatcctgatgatttacctgtttaccctataaaggtatactttcatgatctaaagttgacaataatgacaataatatgtgtcatttcagggccattgattgttttaattaccttctctttatgaaaaatatgaccagttaattatagctccaaataccccacaccagacccacaacaacacagatgcacacgggtgcacacacatacacacacacaggcacatatttcccccgtctagttctgtattctactgttaagtccttattgagaatacttaaaatactcactgtgaagagtgctttggaaaatcttaaatggataatcataaagggatattgttttcagggtgtagcttccaatagaaaaaattgggggtttggtatttcaatgatactttgggtgtataatcgggagaggcccctttatgatagggttcccatagttcctgtaaaaacaagggtagtgatgaatctatttgcctctcttataaataactgctcgtttttctttctgtttttctccttgaagacatgacaatggatgaagtccgagaatttgaacgagccactcaggaagccaccaacaagaaaatcggcattttcccacctgcaatttctatctccagcatccccctgctgccttcttccgtccgcagtgcgccttctagtgctccatccacccctctctccacagacgcacccgaatttctgtccgttcccaaagatcggccccggaaaaagtctgccccagaaactctcacacttccagaccctgagaaaaaagccaccctgaatttacccggcatgcactcttcagataagccatgtcggcccaaatctgagtaactttatataaatatctcatggggttttatattttcatttgttgttgttgtttttttttaagaatcttctgatagagaaaaagactgctttgtcactcaaacatgttccttcgacctttcagtgtgcatgtgactcagtaacttcacatagaatatgattccctaagtatgctacacagcatcatattagatgtaagatgtaagacttgcaaaggacagaaggaatcttctgtaaccacatagctgtatgccagagaggaagccttgttattgggcatttgatgaggtttggcatggacttcaaggataaatgaatgaaaactttgcaccacttttgttacaaggtacggtagaaaatagtgaagtcagtttcctctcatcaaatctaaaattctccaaaatactctcaggcataacatacttagctgttaaattttgaactgctaattactaatacttgaataccaatagttactgagattcctattttgtggttagtctgactcaggatttggagcctaattaactctaaacttttgaaaattttaatcatcaagctatagaggctccaagtgcaattaataataactcatttataccttccacagaatttaataaagattctacttgtttctgtcttttaataactttccccttttgtgcccttgtggcctcagaaatccttaagaattgcatggatgaatgtgaccataactgattttggaatggttcagtttaggaaccaagaggcccaggtgaggcaacatcttttttctctacaggtaccaacaaaccttgacttgtcagcttccatcatcaattaagattctcagaatttgcaattaattgaatagaattcatttactatctgcccactcaaagaagtacaagggtagagtaagctaactgggctttaacatggtcagaatgtctggtgcatgaactataaaaaagagaactgtctcccatccccttccttgttttactcttagtaacatccagaattccctggaacagattgcctaccaccagaccttagaaaagactgtcattctcttgctccttacttgaaatacaaatattgggaatgtcacagacatcaagcaactactgtcaagtgggaggagagaatgagcagaattgctgactcctatttgtagagtgaaaaggaggagtgataatagatgcccttctgtctagctttcctttcttcaactagtggtaatgcaagattagaatcaaggttgacaggaggcaaggtcactcactgaagtgacagaaagacaattctcctttgctccaaagagagaaatctgtcacctttgcacctcactgcctttaaacacagacgggagggcaggccaaatctcagcattgacttttgtcctccaagagaggaagagaagaagtaattgggcaacttggaggcccacgccccagctagccttcctgatcgtaacctccaacctcaggaaagggaccttcccaaaacacagatcccaaaggaaacaaaatagaccaaggagcataatctgcttctctcacacagcctctctgccagtggaccctgcctgcttccctctcagtgctcagcactctgtgtagtgtctttcaggttgatacactctcccaaggtgcaggcgctggccccatgagcccagcaccaaagttttctaagtcataggtcagactgtcaagatcatttctttatctataggttgatatttagcttaaaaaaaaagaataaacctagaactcaaaggaaacctgttgcaaatagcttagatcaacagtgtatctcttccctaagaatgatagtatcttagtaagacaccttctatgcatggtatggaagcatgatttttgcttgtgggaaaacctaatattttatcagacccctcggacttctcaatccctccctctccacacagtagtacttaatgaaaatgttttgctttagagagcaaaatgctactttcagaagacactgaaatagtatatgtatttgcttaccatttgcaagctaaaatcaaggtgggatggggtcattattttcacatagaatgtatttattttgtgcaggctgttaaacacatctggcacctagtttttccattaagagcattgctattttccctttttataaagtagcttctgctgtcaaggttaacaattctatatgctttaggaagctaagttctaatttccttttgtgagtttcatttcttttataaccagtatgttaccacagacatcagttgcaaagctacgatgatagtgtgattcttagccgaaaaaaaagcgtgtgctcttaaagtatgttcagtttttctgtctacatatgctttgtgtgagttaaaaagggggtgggtggtgtaaatattcctttagctgctttgcatatttaacccagtcatcaaaaggcataaatgacttcaatattttatatatcttggttttcaagtatcatttcacattctctatacatgactttgttattgtggaatacaagcctgcaatggatgtatatatacagaacattaataattcttagaaggatggaagccaaatggctgcatgatggaaattagaagaaaaaaaaagcagaaacttgaatttgctaagcatgtttggggggaaatagaatccttaactcagtgcctctgtctgcgatatggaaaccttcaactttgttcaccaaaattgtattatacctgtgtatatatatatatatatatatatataaatataaatatagtatagtgaatcagacaccatcagttttaagtctctggtagccaaacttaaataaataatccatagaatatcacatacgttcactccatcttcatctctgaagttagtggagaccatcaaaatgactgtacatttcataactctgggaagatttcaaatgtgaagtgcccctgtgcattttcttggccatagcacggcattcttgctttagctgtgctttcctgggatgagaagatcttggtgtatttaacacataagctttgttagaaatcacctctgaagatcatttcattttctcactttgggttgttgcaagacaaagcaaaggaaaaggaacacaatgaaggaggccgtgacatttttagttgccaccgttgtaactcaaacaatatgggtttgttggtgaactgatttatcaaggcttctgttacggttttgcatctgtgtgtgaggaaaattttaatttatttggaagtatttattagccatgttgttggtcctgaaaataaatctctaagtagcacagttgtgggtatattatgcagacacttaccacaatacctgcaaaagtaactgtggttttctttcaagacactgtaataaacagtgaactaagagaatagattctgatacatctcgataaatcattctctgcaaaagtttcagggctaatgtatttatgtgtatttttaaattctactttctttggcatctcttcatggctcagcgacaacaaagtaataggtcattggctggcttacgtcgataggaattttactcttaagaagggccagtgtatagctgactctacatataatgtgtaatcagataatccaatagagaggaattgtccaaatagttttagtacctttctgatcatctgactcagtaggctaggagacaatctgtcatctgagccatagttcttgagatttaaaaagtctgtccagtgactgcaatctgattatgaataaactattttaactattcattcttgctgaaactgaagtgtacacaatagcacactgttggcatgctgaggcaaaacattgggttcttttgtgttctaccttcaaaacaatctgtttgcatttgaaatataagtgtttaagctttttaggagttagtgtaataagagaatgtgaatatgttgggaaattttcagatgccattaataattgtaattttgttgttaaattaacaaggactttaggataagcctcttgatgttttttgctttaaattgaaagcatgtctgtcaaattgcaagtctcccttcagtttctatatatcacccaggagagggtctctgagttggtgttgtacctgtaccactcacatgtagctcaagtgtaatttgtagtgtttacattcaagctgggatcttgattggttaaattaatccacataccactgccactgctgaaggaccaggtgttggaatacacagcattacagactataagcaaagcaaacaaaagttgatccttacatatgccatccttctgtgtcattttgtggctgttctgtgtttttcttcctagttatttattattgttaataacttactttttcttacattctgttgtaaataaaatacaaagcaatcttctttgcaa

SEQ ID NO: 553 - DNA, 319984 bp, Homo sapiens; identical to SEQ ID NO: 552

SEQ ID NO: 554 - DNA, 1984 bp, Homo sapiens
tgtgtgtgtgtgtgtgtgtgtgtgtgtgtgtacactgccagaggtttaaaaaggttaagattttatcagtaagaaaaaaccagtcacctctgccagcccatgcaccatgttgtcctgccgctccactgtcccactcctccaccagtcgcaatggaagaagagattgccgtactggtgattgacaatggctccagcatgtgcaaagctggctttgctggggacgacaacccccagccatgtttccttccatcatcggtgcccccggcaccagggcatgatggtgggcatgggccagagggactcctatgtgggctacatggctgagagcaagcacagtatcctgaccctgaagtacccccattaagcatggtatcatgaccaactgggatgacatagagaagatctggcatcacaccttctacaagggactgcacatggccttggaggagcacctggtgctgctgaccgaggaccccctgaacctcaaggccaacagagagaagatgactcagatcatgtttgataccttcaacaccctggccatgtacgtggccatccaggctaggctgtccctctacacctgtggttgcacactggcattgtcatgggctttggagatggggtcacccacatggtgcccatctataagggctacgccctccctgacaccattctgcatctggacctggctggccaggacctgaccaactacctcatgaagatccttaccaaggttggctatagcttcagcaccactgccgagcgggagatcagacactacgtcaaggagaaactgtgctatgttgccctggactttgagcagtagatggccactgccacatcctcctcctccctggagaagagatatgagctgcctgatggccatgtcatcaccatcggcaatgaggttgcagtgtcccgagacgctgttccagccttccttcctggacatggaatcttgtggcatccacccagaccatcttcaactccatcatgaagtgtgacgtggacatccgcaaagacctgtaggccaacacggtgctatctggtggcaacatgtacccaggcatcaccgacaggatgcagaaggagatcaccacccgggcacctagcaccatgaagatcaagatgatcgcatccccagagcacaagtactccgtgtggatcagcggctccatcctggcctcactgtcagccttccagcagatgtggattagcaagcaatagtacaatgacttggccccctccatcgtccaccgcaaatgcttctaaatggactgtgagcagatggctagcaattgcttcatgggttaattcagaagtaaaaatttgcccctggcaaatgcatacacctcatgctagcctcaccaaactggaataagccttagaaaataagttgtctttaaagcttgtatctgatatcagcactggattgtagaacttgttcctgattttgacattgtattcaagttaactgttccccttggtatctgtacatatctttgatttcagtctttagtacatgtggcttggtcacttcatggctaaaaacgtacttgtggaagacaagtctggcttggtgagtctgcatggccagcagtctctgatctgtgcagggtattaatgtgtcaggactgagtgttctgggatttgtctacaggctggtaagggctccttaaccagttgtttctgtcctgtcggtctgtcagggttggaaagtccaagccataggacccagtttcctttcttagcttctgttgtctgccagaacaccatgggctgttactcgccttgagttggaagcggtttgcatttatacctataaatgtattcatccttttaatttatgtaaagtttttttgtatgcaattctcgatctttaaagagatgacaacaaattttggttttctactgttacgtgagaacattaggccccagcaatatatcattgtgtatggaaaaataaaagtgctgccagaaccaa

SEQ ID NO: 555 - DNA, 24829 bp, Homo sapiens
aggaaaataaagggttggagcctctgtgtttctttgttgaaaaatctgctactattattagatctgtgaaaacaattgaaaattcggttattatcaccttaaaagtacaaaacctatagattttgaaaatgtaattatttttctgtaggcatagttaaaaagattttgtaaatgttataaatcagtttctttataagcggtttatttagataaattttgttatactgacatgattcactaattttctaaatataaatggttcagctcttagttatttttaaactaatgacctgtgttatacttcctatttttaatgggcttttatgatgttttaggtttttttgaatcccgtgtccttcaagtgctttctaactttgagaggaagaaattgaccacctggactatggaactgtgcgtaacagctttgaaagtgtatttaaaaattaaatctatatgcctttaaatcagtgaattggaaacatattacatgtattttaatgattttcctcaaatataataaattgtttcctttccaataaaatagtgtttgtattttttctttatctggtttaacacatctaggaaaacataatattataaaaaatatatataatttgtaatataatttttttatgattacaaatactgccttttaaaaattcttacctggataccaaagcactttcacattttttttattgtaatcttgttttttgtaattattttatatttgtctggctttgagttttactgggcttttggttttttggaaatgggggtttatcccaatttagaaatttgtatccttgctgtaatacagtcttccatttttgttcccccaaatctttcatctgtcagaacgtcactcaaaggtgaaaatatttcccacataaaattattctgttcctttaatgaaatgagtttcagctgtatatacgtaggaaaacattcttttttgtcaacttgacgttgacaaacttggtggatgtcaggagtaagggtattcaagagaattttgaagaagaatttaatatagtgagtatcgaagacaactcttaaagagtcttgcgttcaaggggttgtgagaaatgggttgttaatggagggcaatgtagtatcaaaaagctgtttaagattgatgatatagcaggtttgtatgctaatcagactgattcagtagagagaaaaaacataatgccggaaagagagggatattgctgaagccatagacctggtatacaaatagaagggttcgttttaaagataggcacacaaacagctcattagtaacggtaggatgaagggcagattatggagttctagatgtcggtagttcagtaaataggagcatgtcaaatttttgttatattttctcagagaaataggaaacaaggtcataaagagggaggaagtcatgaaggattaaggaaggaaaaggagatgtaaaatgggtatccaggaatgtaggaaagtaaacatactcttaggcaatctgtggtttatttaagtggtatcagtcaatgtggttttgtgtttttctccagttgagttcagcataggtgctatcactgaaaaagtacagaattcaatttaactaaagttgagatttccctaggtgaataagacagtgatgagatgttgttacatttaagagaaagataataaaagagagatatggaaagtaatctgggttaaggagtgaagtgagaaaataaagaaggttgagacagtggaaaatggtatcatcaattgtagattgcagtgtggttgaagatgcattggagttcttgaggtacaaactagaaatttgggagatttaaataagagtggggtggctgaaattgaaattagagtataataatatataatagtactaagtatagtatactaagtatagtataatagtactaagtatagtatactaagtatagtataatagtactaagtatatagtacttagtgattataagttttaggatgtgaggatgggagtagcatagaggcaaggtgatggaaggagatgaattcaagaaattgggaacctaggagattgaaagcattatctaaatgaattttgaaatctcaacaagaactgtgctgagtgctttttgtaattattttatctttactaccctgtgagaagacagcacttccttttgtgagtaatggaaagctctttaatgtgtcaactgtaagatactttattacatttaattatctttagtaattcatgctaacaaataatgacctcagtaggattattcagtagatatgtgagctaaccccctgtgtcagacacctaagagatacaactgatgattttcaagaagaatagagttctcatcccaagtacttaagctgcaaaatgtcccaccctatattttctgaaaacaaacggtatatagagcgtccatttaaaagctaataggaaatcttaaagcgtgcgcgcgcgcacacacacacacacacacacatacatacatacatacatacacacaaaacattgaataagcatcaggaaatatataccctgtacccaacatgcacaaggtctaagcaatgaagaaaaagccaggatatcaagtaagactggaacatctgtgactaatatataaagacttgaggtggttgtatctatttaaaaggttatcaattagaaattaagaaagaggccaggtgcagtggctcacggctgtaatcccagcactttgggaggccaacgcaggtggatcaacgtgaggtcaggattttgagaccagcctggccaacacgatgagacctcgtctctactaaaaatacaaaaaaaattgctgggcatggtggctcatgcctgtggtcccagctactcgggaggctgaggcaggagaatcatttgaacccgaaggtggaggttgcagtgagccgagattgggccactgcactccagcttcagtgatggagttagattaaaaaaaaaaaaagtattttacataagaaattttaattttttgtaaattataaaatagcacttaatatggtatttgtataccgtgatctttgaatatccaaaatttaagaagatgtgagcagttttatgaaacttttcaaagcttagaaaaaggtaactacataaaattccattatatgttatttatgggaacattagatgaagtaagtcataaaaacatgcatagaaatgatcatacaaacttggaagaaattgaatgtcttgctatcgaaggaaaggatggaggtgagaagctctatatattgtatttttctttatatatttaaactcgcatttcttatttttcaaatgttcactccaatgaaaattcttttatttttcctgttagtttttatttctgatctcatatatgcaatatactattgttcataaatattagtgatccgccctgcaaatgaaatactcccatcctgttgaatttgggaatgtccatgtgatttgttttggctgtgaaatgtgagcagaaagattgttttactttggggagttcccgattgctaaagcatgtgtcaaaatgaagtttttgtgacattacaaagggactaataagagtgcctttgttgatcctagttgaacatgagaaacttggttattgtaagccactgaaaaattttagtttcttttattactgcagaataacctattctgtcctgattgatacagccacaacatttccttaagctctttgattttcatatttccattaggatgtagaaagtcaagagaagaataaatcataggatcagagaatattaacagtgaaagagactattggaatgaacttgttcaatggtccagactttgggttctaaataatcagtaatatttcaaaaaaaagtattaaaagatatttcagtataaaaaatgatgacatttaactttgtaaacaacaacaacaaaaacctaccattgctgggcataattagtcatgcttgtaatcccaacaacttgggaggctgaggagggaggaccacttaagctcaggaatttgaggctgcagtgaaccgtgattgcatctctgcactccagcctgggtgacatagggagaccccaactgaaaaaaaaaaaaaaaaagctgtcattaatacatttttcctctgtctctcttcccatcctccttaccacttagtctttaatcttattaaacaagatctaaggataagacaagagaaaggatggttgcatctatactgaacatgtattgagtttttttcgtcattattttgtaaacaacataatataacaagttttgacatggcatttacgttgcattagttattataagtaatctgagatgatgtaaaagttacatgcaaatactacattgtatataaaagactcgagcagttgttgctttaagtatccatggtgggtcctggaaccaattcctcatggatatggagggacgaggaaccactgtagttaaacaaataatcactttaaaacttaaaaccttttgcatggtgaatacagtcgtgcaccgcatatatgatggtggtccagttaagtttattatgccatatttttatcggaagtttcctatgtttaaatatatttaggtacacaagtacactgtgttacagttgcctataatattcagtacaataacatgccttacaggtttgtagcctaggaggaataggctatgccatctacgtttatggaagtccattctatgacatttgcacagtggcttaattacctaagggctttctcttcagaacatactcctgtcattaagcaatgcatgactgtagttggacaaaaaataataatacaggcatacctttggcactgtcctaattcataccagcattcatgattacttagatttacactgggaagccttcaaaaagcagtgatatattaggaaaatatatttgcaatacatgacaaacgataataacataagaactggaaacattcaataagaaaaataataaaagcaaaagaagatggaaaaaggaagcaaatttcaagagaaaactcaaaaggccaaaaaatgtgaaatgatgttcagtcttgctagtaattgggaaaagcacaaatcatttttaatctattaggcaaaaatcagagcgataatatttttggtgggagtgtgacaaaaggtactataatatattgctactagagagtaaaaactgacaggtttgtaagggcaattttgcataatatgaaaatataaaaatgtgcttcaagtttcactacgtttagtctacagaattacctatgtgtaaacatgtatacagatgttcattataacacttcttataacaacaaaatatttggaaatgttcatattaacaagtgcatactatatgatcttagtccaattagaatattcttttttatttcaatcctttaaaagactcaacttctgactgtatatagacaattaaaaaaataatgtgttctccgtatgtgcatttggtcaggttaattaaaacttgttgaaatctgcctgctcttaataaggttgttaaaactctctcataattgtagatttccctattattgtactgtcaatatttttgctttagtaattttaaacatgttataaggtgagtaaacatatatttgttgaatttctagtcagagagtcaaacatttttaattataaatgtacaaccattttactgtggtattaattttgccttagatctttgtccaatactaataaagcctcactgtctttcctttggttagaatttacatcatttatttggttctagctttacctttaccttttttctatctgtttttaaaaaatctgtctaaaaatgcatttagcagaaacatttaatcaatttacattgaattttttttaccctataccacaggaattaggcacattttctgttttgttaatgattagcactgattatacccatgcatattctcacagtccaaagttaatgcctatgtccattgccaaagacaataatgtgaccttagaatacttgaacactgttttattccagtttgcagttgtttttatttttgaaattacttctgtatttttaatcctccaagacattatttttgcagaattttttctactgttaatcttttaaaaattaatcagattaagcagaactcaggttttaaaatattttcatataatattttatttgatttttctaacaatccaatgaaagggaatataagactgattagtaggtaagagctcactgtggagttaggcttcttggctttgaaattcagtcccaacatgtactacaatttgaccattaataaatcccattatttaattttttagtgtttttttctcattttaaaaatgaggataatcatatttctatcatgtagggtacgcgtgtgtgataagtaaaagtgataatgcatagaaatggcacatagtaactatatgttgttagtggttattttatttttatatttatcaacaatatcttcatttcctaattgagaacctagtatgaaatccatagactttaatttttttctaaggttcatacagaaaaaaatgtacatggtgaagcatctagtagatggtgatgcatggagttaatttttttttggttttttgtttgttttgagacggagtctcattcttgttgcccaggctggagtgcagtggcgcagtctcggctcactgcaacctccacctcctgggttcaagcaattctcctgcctctgcctcctaagtagctgggattacaggtgccagataccatgcccagctaatttttgtagttttagtagagacagggttttgctatgttggccaggctggtctcaaagagttaaatttttgatttagtgacactgcttacattctagtctcatttaactaatttaacccagccctatgccaatcgggtctttaaggttattttattttatatggttattttatttttaaggttattttattaagattattttattccctatatgtttattatctatatattccctatatattataaatataaatggttcagggaaaagaaatagagattgcgagaggatattgtagaaaaaggaaggaagacagaaagcagacgagatatagtgtagtaagaagaggtggcagggcagcaaactgagcagaggagagaagacagtggtttgcttaggaaacaggagtgtggtgatcaacctgttgtaatactggagttcagagaagattccttgtacaaatctgatttggagaattggagtaggactctagggccacatattgaaagtaagaggttatagaaaatctataagattctaaattcagcaattttttttccaactgaagaaaaagcaaaaccagaactgtgagatttttattttatgattgtaaaacactcaactgtgggtttgggagattgctgattgagagaagttaatgtggtaagttgttttaatgttttttgagtattatgtaagtcctcctccaactttttgtcttgaaataagtggtttctgtcacatgatttgatatagagtttcacaatctattttcagtttgttgacaaatcatgtttcagtgctgtgcagtacaaaatgtactatttatattgaaaatgtgtcttagccttggctcaaaaggtttctctgatttcagagatctgttaggcaaacttgattatctgtgctttcttttctctaacctttacattgcaacttatcctgagttcaggtttattttctttcttattttattttcaaaagaaaaacagaaaactgttgggggaagggctggtggttgaaggtttactattttgagaaaattgtacctaatttattgcaaaactcagaggaattaagactttattttttagtaagagaaacaactaacttgatcaagttcataaatgtgacattaaggtatttcagttgtaatttttaatcacacttaaattacttccaaagatatttataaggcatctaggctaagaactacgaatgacattaatagataacttgtcttttttttttttttttttgtcaatgttaattcatttgcatgttaaaaaactataatatctggtataaatgtgaggctactttggatagggggaaagaacttgtaaataactgatagttatataagtagaaagggagctctagaaagacaagttatttggaagttgctactttctgcttaacaatagagctctttcattttatttaagtcaaggctttggtgtgatttaagtaggctttgagctaaatgattaaatttatggtacttgatgtgtcaagagggatactgagtttacactagagccgtttccctataatgccatttatattatggatgtcaaaatagatacctcatatatgatattgattgaaaaaatacttttgagaccctcagaaactggctaattttgagttaattcttgataccggatatattttattttttatatgagcccaaatgagaagagagaatatgttttgacactccaaatataaatctttagtgactattgctttgtcgtcaggatattatcaaatgtcctatttcatattcttagggaattcccaagatatgtcatttggcacatgatagtaaccgttagagctttagagtaaagggaagttttctctttgtagagcattctaggaagtacaaaatatgggcaataatgccgtatattactaataactgaatagcttctctaaggataactcttttagaataactatttcagaaagtagatataacaactattttaaatccttatttttgtgtttttgatgccgaagatgctaagaattgtttgtgcagatttttatttcagaagacataaatatactttaattgttttaatgcttctcctatggggtatatagctcttcagattgcttgtttgaggtgaaaattaagatcaaatgagaaaatatatgataatgcctgactcttagtagaagcttattatatgtgtgtctaactctacctttcatgcagtgctaaattccctaaattatatctgcaaattatccctttttttttaccaacattccaaatgcattgtgaaaaatgctgatttgctattacaagaacagagttcattgatctggcattgttgaaaagtatatttcaaaactaccatggatctgccagaaatcctaagcgaataagcaagaagaatactgtgagggaaggaaggaaaaaattgcaggtagaaaatattggtgattctttttcatctctgtccattcctttactggaaatgaaaatacttctgagaagtagaaagtattagaagttaagaagggtagaatgggaagacagaatggccaagtgttagtagagcgaaggcggaaagacagtatgagttgataggatttttaataggaccaggtaaaaatatcaatacaaaaataacattatcaaccatattgagcttttaccatatccatacattgggataacagctttatttgcattattcgtttaatcacaataactctatgaggtaaacattactttttctagttaatagatacatttagagaagttattttccagcatcacacaggttataaatggaaaagtcaggatttatagtttgtcttaactcctaataattgcgttttcacatttggaaccttgagtcaagcatgaagttcaaatggtgcccctcttctctgtcaactctttacaccatcagccctgtatcactatctagtcagtcttctatttaaattctgatactcacccgtatccagttagtttgttgtactccctgcaaattttccttccctatttgcttttaaaaatcatctcgggtaataaaactccctttgctactttgaaggcacctctttattatctccttcctactccctgtaccccatcatttataaagcttggtgacttcatccaatatcttttttggtattttgtcagccctcaagggtacaactctccaggcctgataattcagccagtgtacactgccctctgtatagtagttgcttagggatagcatctgttctgttcagtgtctgtgttaaatcagttaagtattttttgttccatttcttagactgtcattgctttgttgaaaactaccaattctctgcttctttcttcatatctttttttaattgtttttatatacccatttgttttaaaaatggtacctctaattcaatatgtccccatattcatcggtttctctaaaccaaatctgcctttagattgcactatcagtcataaagacattgccattctaatattcacccaaagtttaaatcacagagtccccatttgactctttatattctctattctcttatatctgattaaccaccattttctgtacagtctccaccaagtctgttatatctcccctctctgttttacataaacatttcccctctattccaggggtatatgttccaagacccccagcaggtgcctgaaaccacagatagtaccaagccttttgcagtcatctctccagtatctgtgggggattggttccaggacctcccatggataccaaaatctacagatgctcaagtgccttatataaaatagcatagtatttgcatataaccaatgcacatcctcctgtatactttaaatcatctctatattgctagagatgtaatatctactgtaatataaatgctatgcagatagttacattgtttagggaataatgacagaaaagtctatatgttcagtacagatgcaactatccttctttaaaaatatgttcttccacagttggttgaatctggcgatgtggaacccatggatatggagggctgactatatacaccatgttttttcctggcacatcactcaactactattagctggcgagtcaactcacgttgttggaatgactagggacaactagacttcaagtgatctttcatcccaggtaggctcacaacacaatgtatgatctcagagttccaagagatcaaactcccttctgcaaaccccagtcaaactttgcttgtgtcttgtttgctgatatcccatcggataaaacaaatatcaagctaattccatagtctttgtagagagagactttatataggtatggatactgggaagtgtcattcattggatgccctttaatataactatcacacttccctaattttcattcttactgctgtaatcctaattcagatttctgtcactgctctgcttactaatgttcctatctctttgttttctggtccatctgatataattaaaagtttttattattactttcctgtttaaaacaaccaaaaaaccttctgaggtaagtacttttttcttctccctgattttgagtgtccccaatatacctttccaaatttaactgtcatgtctccctcacacttgacttgtttctaaaacactgtattgacttcttgccattttccttgctcttctacatgtttttcttacttaaaagcaattttacctatctcttttcattgatgtcaaacccattcttcaagtcaattttatctccccttattcccatctgtcagaaagaacttttcctaccaattaaatcctgaagcacttaatcgtaaccctcttaaaactatgttcatatctttcactttattgtttgtttttgtgtatggacatatcccttctctaactgaacataacttctagaacagctctgtctaatacaaatagaatgtaaatcatatatgtaatttaacgtattttactaactgcattaaaagaaaccaaaagacactagggaaattaatattaatggtaaattctgtttagcctaatgtatcacagtatgttatttcaacctgtaaacatcataaaaatatatttttttactttttattttcacactatccgagtgtgttttacacttactactcatctctgttgaaaccacatacatttcaactggttagtagccaattgtttctagtggctaccatattagacatcacaactctagaattctaggagaaacattagtgtagtacagagaatgttgacttgcaatcagacttattatcaaatcctgtctttgtcacttaccatatgagcctggacaatttacccagtctgtctgggccttagttccaacatgtgtacaacacttttgctaggattagagtcaagtttattgcacaatttctaatatagagttcattgatttttagaaaatcaatgaggacataacccatgttatgccaatgttttgcacaatacctggaacctagagttttcatgttatagccatttattgagcacataagacaatgtcaatcattttactaggatttggaaatactagatatgaagtctaacttcaagaagcttggtccagaatgacagacaagtaaattgttaattataatatacttacaaaagaagtcaaatatagcttaatgtcatataaattaagaagctttcatacaacagaggagctaactatgcttgagaatatgagggtaagcttcataaagttgtggtttcaacttaatgtggaaggaaaagtagttgcttccacactaagttggatgtggaaggggatgatatgggaaacaaaaccactaggaaattcatgaaggtatgatatttcatataaaatatgaggaacttctagttttgcaatgaacagagttcacaggattggctggcggaaggaccaaagggcagcatcaggatcgacagtggaatagttaagatccacagctctcctgatacccttcgtcaaagctggtacttcctcattttgtctcatgttaaaaaatggtatcatccccaaatacctatatctttaatatttttcctcatccttcagctctaatctattcataaatctactgcctgtttacctctgaaatataccttgtctatgccctagtccaagccactcacctctttcctggaccactgtaaaagtcttctaacatctacccctttccactcttatcctcctataatctggtttcttcccagaagcagggtgattttcttttaaagtttattagtctttcagttccccatgtcacagccttaacagctctctctttcttcatgttctacaaggttctacatgatctggcctacctctctgatctcatctcattttatcccaccctttatcacatgtgctctagccacactgatttctttttaatgtgtcttatgtactagctttttcctttcttgggacattactcttgctctttcctctatctgttgctctttctctgatctctaaatgactggacacttctaatccttcaaatcacatcataaagtcactcttttaagggatgtcttcccttaccatccagtctataataccctgatggaaaagtcactttctattttatgattttatactagttcttattgctatctgaaattatttttatcatcactgttagtactgttgctattactgttatttactaatatattttcttttctttccactagaatgtaagttctctgagaacagaaacctgtctttttcataattgtctcctgaacatcacctacagtgcttagcaaaaagcagacacacacttaacacttgttgaatggatggatgaagtttttcctacctgtactattactccctttcatagcatttcacttacattacattaagaaggaaaaattacacaaatttatttatttagcattttgtcaggtacaagaaatatttgcctacagggagaaaaccaccaccaccaccaatcctactactatatgcactatattaagcacatgagttgatcaaggggaaaaaagttagtttctccaattcatgggctttgagattttaaacgttttcttaaatcattaatggagaaatttaaataaccaaaactttgaattaaggatgggaaacagggctgattttaaaaatggaaatatcacataatatgtctgtttgaaatggaaacatgacaaaaatttgaaaatagttaaatattttgagaattcagttggcttcaattgttattttctattagtgacggatatcacaaacaaaagacagtccttatttgttattaggatttatatatatacacacatatataaagactatatagactatatatatatacactgcattatatatatatggaatatatatatgtttgtgtatatatatatgtttgtatgtatgtgtgtgtatatatatatgtttgttctcatgctgctataaagaagtgtccaagactgagtaatatataaaggaaaaagattcaatccactcacagttccacatgactgaggaagcctcaggaaatgtacaatcatggtggaaggggaagcaaacccatccttcttcacttgatggcaggaaggagaaattctgagcaaaagggggaaaagccccttatgcaaccatgaggtcttgggagaactcactcactatcatgaaaacatctgtatgggattaccgcccccatgattcaatttcagttacctcctaccaggtccctctcataacacatgggggttatgggaactacattcaagatgagatttgggtggggacacagccaaaccatacatatatacatatatacacacacgcacacacacacagagtctatatatacatacacacacacacataaggactgtgtagatatgtgtgtgtttgtgtatatatatatataaatacagtccttatgtgtttaaatatatatttactgtccttatttatgtgggtttgtgtgtgtgtgtgtgtgtgtgtgtgtgtgtgtgtgtacactgccagaggtttaaaaaggttaagattttatcagtaagaaaaaaccagtcacctctgccagcccatgcaccatgttgtcctgccgctccactgtcccactcctccaccagtcgcaatggaagaagagattgccgtactggtgattgacaatggctccagcatgtgcaaagctggctttgctggggacgacaacccccagccatgtttccttccatcatcggtgcccccggcaccagggcatgatggtgggcatgggccagagggactcctatgtgggctacatggctgagagcaagcacagtatcctgaccctgaagtacccccattaagcatggtatcatgaccaactgggatgacatagagaagatctggcatcacaccttctacaagggactgcacatggccttggaggagcacctggtgctgctgaccgaggaccccctgaacctcaaggccaacagagagaagatgactcagatcatgtttgataccttcaacaccctggccatgtacgtggccatccaggctaggctgtccctctacacctgtggttgcacactggcattgtcatgggctttggagatggggtcacccacatggtgcccatctataagggctacgccctccctgacaccattctgcatctggacctggctggccaggacctgaccaactacctcatgaagatccttaccaaggttggctatagcttcagcaccactgccgagcgggagatcagacactacgtcaaggagaaactgtgctatgttgccctggactttgagcagtagatggccactgccacatcctcctcctccctggagaagagatatgagctgcctgatggccatgtcatcaccatcggcaatgaggttgcagtgtcccgagacgctgttccagccttccttcctggacatggaatcttgtggcatccacccagaccatcttcaactccatcatgaagtgtgacgtggacatccgcaaagacctgtaggccaacacggtgctatctggtggcaacatgtacccaggcatcaccgacaggatgcagaaggagatcaccacccgggcacctagcaccatgaagatcaagatgatcgcatccccagagcacaagtactccgtgtggatcagcggctccatcctggcctcactgtcagccttccagcagatgtggattagcaagcaatagtacaatgacttggccccctccatcgtccaccgcaaatgcttctaaatggactgtgagcagatggctagcaattgcttcatgggttaattcagaagtaaaaatttgcccctggcaaatgcatacacctcatgctagcctcaccaaactggaataagccttagaaaataagttgtctttaaagcttgtatctgatatcagcactggattgtagaacttgttcctgattttgacattgtattcaagttaactgttccccttggtatctgtacatatctttgatttcagtctttagtacatgtggcttggtcacttcatggctaaaaacgtacttgtggaagacaagtctggcttggtgagtctgcatggccagcagtctctgatctgtgcagggtattaatgtgtcaggactgagtgttctgggatttgtctacaggctggtaagggctccttaaccagttgtttctgtcctgtcggtctgtcagggttggaaagtccaagccataggacccagtttcctttcttagcttctgttgtctgccagaacaccatgggctgttactcgccttgagttggaagcggtttgcatttatacctataaatgtattcatccttttaatttatgtaaagtttttttgtatgcaattctcgatctttaaagagatgacaacaaattttggttttctactgttacgtgagaacattaggccccagcaatatatcattgtgtatggaaaaataaaagtgctgccagaaccaaaaaaacattaatttctaaaaggtcatttagatgatttccatgagagactttttaatgttcttctcctgttaggattattattgataatccttttcagattatgagtaaacagtttgccctcaagtatttattcatgctaatatttactttgtaaaatgtgcttcttacaggaatataaatagtttctggaaaggacactgacaacttcaaagcaaaatgaagttctttctgttgcttttcaccattgggttctgctgggctcagtattccccaaatacacaacaaggacggacatctattgttcatctgtttgaatggcgatgggttgatattgctcttgaatgtgagcgatatttagctcccaagggatttggaggggttcaggtgggtatgattcatagtatcaattgcagaattcactatgcttgtagtaaatagtattctgatcttatccgtgaagcttaggcaacattttacttcacaggtaagtattctaagtaagagttttctgaggaaaaaacaatgtagtattcttggcaactttatattttgtttctgagataatctttcttcaacaagagccctccaatgtgctgttaatattttcaagagatagctgcatataccaagattcaagaattttttatattattgattagtttctagaacattcaatgatatagagtaagaatttggtagttatgaagactgtttaatttgtaggtctctccaccaaatgaaaatgttgcaattcacaaccctttcagaccttggtgggaaagataccaaccagttagctataaattatgcacaagatctggaaatgaagatgaatttagaaacatggtgactagatgtaacaatgttggggtaagtgaattctagtttccttgaaaaataacagataggaaaatgatttctctctcttctttcttgctccttttcagcagaaagttttccatattttatttttttaattttacttcatactttaaaactcaaaattaaccgttgccttatgttcagcttttgtaaatatttgtgtatgtgctctctatctaccaaagaaacaagtttaaagcagaatttacttctaaagcaaaacatcaaattttaacttttatacctatctatatttcctggaaagagttttctggttaagagttataattccagttacaatatttgctatcatttttaggtgacttgtatctccatccataattcctgggtttttcgtggtgactagctagcttctctatttaatgaggagcataatttgagactaatagctcccttatttgtcttcaaaagcttagtagagagtacaggctttctcctggtgaccgactgtaatttccaaaacagtaacctttccagtctcatctgagttttgtctccccgaaatgggctttttgcatttcctcctatttatggtagtttctggttctctcaatttaccattactataaatatttgaccaagtgtctagaaggcatgtaggtgtttagttcacattacttcttcacagttgatttttgatcttgtaggaaaatagttataagatatcatgaaatattttggagttttattaacatactataaacttgaatcaataatgctttaaatttctgcctctctgtaagtcacactgaagtagaaactttgctttctaggttcgtatttatgtggatgctgtaattaatcatatgtctggtaatgctgtgagtgcaggaacaagcagtacctgtggaagttacttcaaccctggaagtagggactttccagcagtcccatattctggatgggattttaatgatggtaaatgtaaaactggaagtggagatatcgagaactacaatgatgctactcaggtaaatttttttatgagagtcatctgaataaggggtgatatatgccttttcttgtagacatgtagctaattgaacttcattttaaatacgaatttagatctcttagggacacaggttaacaggtttgactactttaagaaactcaaatccatatttaaaaacttaaatatagatttaagatttttaatcaatacacatttgcccacttttaaaaagctcccaaccaattaaaaagctcgtcgactttatttcctaaattctctattttctattagaaaatatttccaagatacatctatagtagaatgtgagcatccccagcgcccaatgcaaggaagtcactatagaatatctcttgaggaatcatggaataaatgaataatcaaatggattctcatgtgaaaaatgaggttttatgaatcaatcataacatttttacctcaacaggtcagagattgtcgtctggttggtcttcttgatcttgcactggagaaagattatgtgcgttccaagattgccgaatatatgaatcatctcattgacattggtgttgcagggttcagacttgatgcttccaagcacatgtggcctggagacataaaggcaattttggacaaactgcataatctaaacagtaactggttccctgcaggaagtaaacctttcatttaccaggaggtacatcaatacatatatgcatataaaatatcatcttattcattagaaaataatggcagatttaattaaaaatgcaatttctataggataaggactgagtcatttatataaaatggtgttctttaacctcctcttcacatacagcatatctaattctttatcacaaacaaaacaaaacaagacaaaaagaaataataaatagcttaatttattaataaataacaaatagcttaaagctatcttttatataatattaacttattggttaaaatgctttaaagtccttatgcaaaatgttactttttcctaattttctactaggtaattgatctgggtggtgagccaattaaaagcagtgactactttggaaatggccgggtgacagaattcaagtatggtgcaaaactcggcacagttattcgcaagtggaatggagagaagatgtcttacctaaagtaaataaatacaacttttcccctgaagtatttcatagatttattagtcatagtaccccagtgtgagttatcttctggaacattctttttcagacaactatcaaggagtcaattgttaatgataagtattctagtgccctaaactctaatcaatcatcttttgtatttagagtgtctatcacaagtgagtatgcctaggaacgctaaacatatcctaggagtttccgtctaagtacgagatgaatatactggatttgactgatgtttgcatataatcttttaaagccaggttattattaaaatgatcctatcatttataaagtatgtacaaagtttccatactgtagaatttacatatattatatgaattaaaaatataaaaatatttatattataacaatacagtattgaagccttattttaacctagtttgacattccgtaaaatgtgatatggatattgatccttctggagtgcctctaaatgataatgtgctgaaacctctgaaaggaccttttttaataacaaaaatcttatatttgtaatatgaatataagtattccatacttgtatatacgaatatagactacatatgtagattacacacgtgtgtgtatatggtgtgtgtgtgtatatatatttgagtgtgtgtttgtgtgtgtgtatgtatatatatatatatatatatatatcttacagaataaccatttaattagagaaagaatttaatcttcagatgccatgccatgcagaaagagatgcacagttaagttactcgcaaactattgtgaaatgatacatcaacatatatcttatttttcaaaaataggaactggggagaaggttggggtttcatgccttctgacagagcacttgtctttgtggataaccatgacaatcaacgaggacatggggctggaggagcctctattcttaccttctgggatgctaggtagaaaaccaagttctctattttttttaacacatcttttaatgatggtaatgatattctgatattctgtgataatataattatgtaactttcaggctgtataaaatggcagttggatttatgcttgctcatccttatggttttacacgagtaatgtcaagctaccgttggccaagacagtttcaaaatggaaacgtaagttttgaaattgttcaaactatccttttctcaagaaacagaaggcaatcttgttctaacttaatatgacaactattaattatatattcaacaaataattgattagaaacctgatatagggctgcgattttagtaatgcaggttatattaaaggagtaaaatatatattttccattgacaaagagtatgcaagccttttcagacatatgataaacatccccctagcccacaggaaaaaaaaaaaaaccacttaaaaataagagctaggcacagggattaaaatatatacttcgaataagtacctacctcagggttaataggaagattatacatgccaacacttttagagaacttaaaacatcatctgcccacagtaagaacaatataaatgttcgttaaatatttttaaaaagttatatggaatacaaaaaaatgattcagttgagctgagttaaatagggaaaagtatctaataagaggaaggaaattatatgtactaaagaatggaaatttagagagtattccaagaaaggtaagaatgagaaaaatatttgggagtatggtaaagacatttatctgatgagtagtttcaaaaaggaacagagaaataagagtgtacagatatttggaaagctagtagaaggttttctttaaactaaagggttcagaaacagcatcagagacttcagatctaaagcagaaattcctccttcctctgagtcacacagatatctagctagctttttttagattcctttcagtttgagaagtctgttactttgtatagcaactgattctattgttaaacagctttaatatttaggtgtacttttatattgagccaacttatcatgatttctactaattggtcttatttctgatgttaagggtcacagagtatttttattttttctatcactataacttttccactttccaggactgctgcatgctaaaaactcttagttttgttcacttttcaccatatgacataattctaaggtcaacactgaaaaacttcctagggttactctggtttttttaattaagattttttaaagtgccaatcagaaaaacataatattaaaactggtgtcaatttataaaaaatgttctgatgtattgttttgtacaattatctaaacagaagcatgatggactctaatatttattgagcacatgtcacgttcaaggcattttcacatatattacttaatttttatagcaaaaaaacaatattcccattttacaaatgaggaaactgagacacagagaaattatgtatgttgattaaattttcttagctactgttaatagagcctatgttttaatcctggtgtttctggtactaatgcccttcccatttcaatgacattgcatggcttacagtgatgttaagaagcccttgcaggccaggtgctgtggctcacacctgtaatcccagcacttggcgagtccaggcgagaagatcagctgacctgaggagttcaagacctatctgggcaagctagcaagacctcgtctttactgaaaattttttaaaaattagctggttgcggtggtgcacaccaacagtcttagctacttaggaggctgagataggaggatcgcttgagcctgggagatcaaggctgcagtgagctatgattatgccactgtactccagcctgggtgacagagcaaagaagcctttgcagttccttggaatgaaaaggagaggataacaatttgttacctttgtttgaaatatggcaaaagagaaccagaggatagagagatgatgaagacccagtaaagggctataaaaattattgaaggcattggattctagataaagtcattgaatgcagagacacaagtaacaggataggttgggtttggtttaaaggagaaggaagaggtaaatatatgtatgttaaaatttggcttttcaccccctaattaaggatgttaatgattgggttgggccaccaaataataatggagtaattaaagaagttactattaatccagacactacttgtggcaatgactgggtctgtgaacatcgatggcgccaaataaggtgagaatatgtatttagacatgtcctctaatagtaaactttccattgcattttatttaaaacagttgaagtttaagaatatcaacgttttatatggtattgtgtttttaggaacatggttaatttccgcaatgtagtggatggccagccttttacaaactggtatgataatgggagcaaccaagtggcttttgggagaggaaacagaggattcattgttttcaacaatgatgactggtaagtacatatcaattaaaaataatattttgtacctgtatgctcttggtttattcctttttttctgttcattgacatttatcatatctgaaaaatcatgtagtcagtggagcaagaagacaatagacatcaaaattgggcagaagtaaaaagatgatggctgttactccttcattctcctgttttattaagggctttctgttgtaagcagagtcctttctgtgcacccttgcaatatcttatgcatatattgaatgcacatacatatgctcacctacacatgccacaaaatacacaaagtagttaatatgaggattgtgaaatcattaaaagaacatgtcttatattcctgtttttttaatcatggaaaaatgctgcctgagtactaatatatctttatttctaactctttttctcaatgactgctctatgtagttttttggtatactttcttcacttctctgtctccttgtgacaaataatatttttaaagcatatgcataaataatatgtatcttgtggttaatgattggcttcaggggatttgagttttagttccgaaacttctcattattggcctttcatctgtgattcttatatcctttactgaagtataaatgattccctaacctatagctcagaagacctcgttgcaaacagttgaattgtctctgtccaaagccaactgatactcatacttagctcattctagtataaattatatttcactgatgaaaaataaataaatacataaatacataaatctagttgatctctttcctgccaaaaaagcccatgtctagttctttaatttctttcttttgtggatgaaaataccaaaataaatttttgtgagaaagctttatatttcaaactatcacttcttcatagaaatgctagattgtttctatgtatgccccaaattcttttttaccttatggggaaaaaaggagattaaaaaaataaaaccctttaaaaatttttttttaaattatactttaaattttagggtacggggaggggggagggatagcattgggagatatacctaatgctagatgacgagttagtgggtgcagcgcaccagcatggcacatgtatacttatgtaaccctttaaatttttaaaagtaatttgtattaagttcagttgagaacaaatttgattttaacaagctagcacttttatcaaagtgtgaccattcctgccaatcttcagtgatattcttcaactttgattttttggtaatattttcactacggaccagggaactgctacattttctgtaaggttacttttggtcctagaaagctatttacaactactagggaggcatatgggttttcttcttaatgagacttcactgcttagggttctacaacataaagttatgctgtttagttgtgttagcctgtattcttgattttcagtgtattgaagttaaatctgaaattttattttacaggacattttctttaactttgcaaactggtcttcctgctggcacatactgtgatgtcatttctggagataaaattaatggcaattgcacaggcattaaaatctacgtttctgacgatggcaaagctcatttttctattagtaactctgctgaggatccatttattgcaattcatgctgaatctaaattataaaatttaaaattaaatgcatatcctcaa

SEQ ID NO: 556 - DNA, 8873 bp, Homo sapiens
ctggcttggtgagtctgtgtggtcagcagtctctgatccgtgcagggtattaatgtgtcagggctgagtgttctgagatttatctagaggctgggaagggctcctgaaccagttgtttccgtcttgtcggtctgtcagggttggaaagtccaagccataggacccagtttcctttcttagcttacgttatctaccagagcaccgtgggctgttacttgccttgagttggaagcggttcgcatttataccggtaaatgtattcatccttttaatttatgtaaagttttttagtatgcaattctcgatcttttaagagttgacaacaaattttggttttctgctgttatgtgagaacattaggccacagcaacatgtcattgtgtaaggaaaaataaaagtgctaccatatgcaaaaaaaaaaaaaaaagaaaagaaaagaaacattaatgtctaagaggtcattgagatgatttccatgagagactttttgatgttcttcaccagttaggattattattgataatccttttcagattatgaataaacagtttgccctcaagtatttattcatgctactatttacattgtaaaatgtgcttcttacaggaatataaatagtttctggaaaggacactgacaacttcaaagcaaaatgaagctcttttggttgcttttcaccattgggttctgctgggctcagtattcctcaaatacacaacaaggacgaacatctattgttcatctgtttgaatggcgatgggttgatattgctcttgaatgtgagcgatatttagctcccaagggatttggaggggttcaggtgggtatgattcatagtatcaattgcagaattcactgtgcttgtagtaaacactattctgatcttctacgtgaagcttgggcaacattttacttcacaggtaagtattctaagtaaaagaattttctgaggaaaaaacaatgtagtattctttgcaactgtatattttgtttctgatataatctttcttcaacaagagccctccgatgtgctgttaatattttcaagagatagctgcctataccaagattcaagaatcttttgtattattgattagattctagaacattcaatgatatacagtaagacagaatttggtacttatgaagactgtttaatttgtaggtctctccaccaaatgaaaatgttgccattcacaaccctttcagaccttggtgggaaagataccaaccagttagctataaattatgcacaagatctggaaatgaagatgaatttagaaacatggtgactagatgcaacaatgttggggtaagtgaattctagtttcctttaaaaataacagataggaaaatgatttctgtctcttctttcttgctccttttgagcagaaagttttccatatcagttttaattttacttcatactttaaaactcaaaagtaactgtcaccttatgttcaatttttgaaaatatttgtatatgtgctctctactaaagagataagttaaagtttatagcagagtttacttctgaagcaaaacatcaaattttaaccgctataactatccatatttcctggaaggattttctggtgaggaattttaattccagttacaatatttgctctcatttttagatgacttgtgtctccattcctaattcttgggttttttttgtggtgaataggtagcttatctatttaatgaggagcagaatttgagatgaatagctaccttatttgtcttccaagcttagtagagagtacaggctttctcctggtgacccactgaaatttcccaaatagtaaccttttcagtctcatctgagttgtgtctccccaaaatgggctttttgcctttcctcctatttatggtagtttccggttctctcagtttatcattcctatatatatttggccaagtgtctggaatgaatgtaggtgtttagttcacattactttcctttcacagttgatttttgatcttgtaggaaaatagttataaggtatgaaatattttggaattttattagcacactataaatttaatcaataattctttaaatttctgcctctctgtaagtcacactgaattagaaactttgttttctaggttcgtatttatgtggatgctgtaattaatcatatgtgtggtaatgctgtgagtgcaggaacaagcagtacctgtggaagttacttcaaccctggaagtagggactttccagcagtcccatattctggatgggattttaatgatggtaaatgtaaaactggaagtggagatatcgagaactataatgatgctactcaggtaatttttttacgagagtgatctgaataaggagtgatatatgccttttgttgtagacatgtagctaattgaacttcgttgtaaatatgaatttagatctcttagggacagaggttaacaagtttgactactttaagaaactcaaatccatatttgaaaacctttaaatattgatttaagatttttaatcaatacacatttgtccacttttaaaaagctcccaaccaattgaaaaactcatcgactttatttcctaagttctctattttctattagaaaatatttccaagatacatctatagtagaatgtgagcatccccagtgtccaatgcaaggaagtcaccatagaatatctcttgaggaatcatggaataaatgaataatcaaatggattctcaggcgaaaagtgaggttttattaatcaatcataacattcttacctcaacaggtcagagattgtcgtctgtctggtcttctcgatcttgcactggggaaggattatgtgcgttctaagattgccgaatatatgaaccatctcattgacattggtgttgcagggttcagaattgatgcttccaagcacatgtggcctggagacataaaggcaattttggacaaactgcataatctaaacagtaactggttcccggaaggtagtaaacctttcatttaccaggaggtacgtcaatacatataggcatataaaatatcatcctattcattagaaaattcacggcagattcaattaaaaatgcaatttctgtaggataaagactgagtcatttccttaaaacagtgttctttaacctcctcttcttcacatacagcatatctaattctttatcacaacaggttttatggaggtacacagaatgtaggatactgataatagttatgtctttattttctttggaaaatgaaatgagttaatatttatcaaaaaaagtcagtcagatagtaaatatcgtattcctgtgagctgttattattatcattgatgtacaagactaaaaattaggtaagtattctcacaggacaacaggtaactttgacattatgtttctttcaatattgtagtgtatactttatcaaaaaaagaatataagaatattaccgatgaagataataagaataagaaaacgattttgagcgtttcatataacaaataggaccaggcgtggtggctcttgcatgtaactcagcactttgggaggctgaggcaggagaattccttgaggcctggagtttgggaccatcctggacgatatagcaagaccctgtctctaaagaacaaagcacaacaagtctaaaataactcagaaatagctgaaagctaatttttatataatataaacttatcggttaaaatgctttaaagtccttatgcaaaatgtttttttttcctaaatttcttctaggtaattgatctgggtggtgagccaattaaaagcagtgactactttggtaatggccgggtgacagaattcaagtatggtgcaaaactcggcacagttattcgcaagtggaatggagagaagatgtcttacttaaagtaaataaatacaacttttcccctgaactatttcatagatctgttagtcatactaccccagtgcgagttatcttctggaacattcttattcagacaactattaaggagtcagttgttaatgataagtattctagtgccctaaactctaatcaatcatcttttgtatttagagtgtctgtcacaagacagtatgcctaggaacgctaaacttaccctaggagtttctgtctgcgtacaagatgaatatactggatttgactgatgtttgcatataatcttttaaagccaggttattattaaaatgatcctatcatttataaagtatgtacaaagtgtccatgctattgtatttacttatacgaattggaaatgtaaaatgatttatattataacaatacaatattaaagccttattttaatctagtttgacattctgtataatgtgatgtggatattgatccttctggagtgcctctaaatgataatgtgctgaaacctctgaaaggaaattttttaataacaaacattttatatttgtaatatgaatataagtattccatacatgtatatacaaatatggactatatatatgtagattacacacgtgtgtttgtttatgaggtgtgtgtgtatatatatgtgagtgtgtgtttgtgtgtgtgtgtgtatatatatatatcttacagagtaaccatctaattagagaaagaatttaatcttcagatgccatgccttacagaaagagatgcacagtagagttactctcaaactattgtgaaatgatacatcaacgtatatcttatgtttcaaaaataggaactggggagaaggttggggtttcatgccttctgacagagcgcttgtctttgtggataaccatgacaatcaacgaggacatggcgctggaggagcctctatacttaccttctgggatgctaggtaaaaaaccaagttctctatttttttaacacctcttttaatgatggtatgaatattgtgatattctatgataatataattatgtaactttcaggctgtacaaaatggcagttggatttatgcttgctcatccttatggatttacacgagtaatgtcaagctaccgttggccaagatattttgaaaatggaaaagtaagttttggagttgttcaaaatatccttttctcaagaaaaaagaggcaatcttctcctaatttaatatgacaactattaagtgtttatttattcaacaaatatttaattattgtaaacctgatacaggattgtgatttagtaatgcaggttatattaaaggaataaactttatattctccattgaaaaagaatagcaagctttttcagagatatgacaaacatccccctagcccgcagggaaaataaaaataaaaattaaaaaaaccacttaaaaataagagctaggcacagggattaaaatatatacttcgtaccttcctcaggtttaattggaagaatatagatgccaacccttgtagagaacttaaaacatcatctgcccgtagtgagaacaatataaatgtcttttaaatactgttaaaaagttatatggaatagaaacaaatgatccagttcagctgagttaaatagggaaagtatactataagaggaaggaaattgtatgtactaaaggatagaaatttatagagagtattccaagaaaggtaagaatgagaaaaatatttgggagtatggtaaagacatcactctgctgagtagtttcaaaaaggaacagagaaataagagtgtaaagatatttggaaagctagtagaaggttttcttttaaactaaagggttgagaaacagcatcagagacttcagaactaaagcagaaattcctccttcctatgagtcacacagatatctagctagctttttttagattcctttcagtttgagaagtccgctactatgtataacaactgattctattgttaaacagctttaatatttagaaggtgtacttttatattgagacaacttcttataatttctactaattggtcttatttctgttgttaggagtcagagagttcttttattttttctattactataacattcccactttgacaggactgctgcatgctataaactcttaagttttgttcacttttcaccatatgacgtgattttaaggtgaacactgataaacttcctagggttactctgtgttttttaatgaagatttcttaaagtgccaatcagaaaagcataatactaaaaatatggtcaatttataaaaaaaaaatgttcagatgtagtattttgtacatttatctaaaaagaagcatgacggcctccaatatttatttagcatatgtcatgttcaaggcattttcacatatattacttaatttttatagcaaaagaactcattattctcattttacaaatgaggaaactgagacacagagaaattatttatattgattaaattttctcagctactagtaatagagcctatgttttaatcctggtgtttctagtactaatgcccttcccatttcaatgccattgcatggcttacagtgatgttaagaagcccttgcaggccaggtgcagtggctcacacctataatcccagcactgtgtgcggccagctgagaaggtcagctgacctgaggagttcaagacctatctgggcaagctagcaagaccttgcctctactgaaaattaaaaaaaaaaaaaaattagctgggtgcggtggtgcacaccaacagtcttagctacttgggaggctgagatgggaggttcgcttgagcctcggagatcaaggctgcagtgagctacgatcatgccactgtactccagcctgggtgacagagcaaagaagtctttgcagtgccttggaatgaaaaggagaggataacaatttgctacctttgtttgaaatatggcaaaagagaaccagaggatagagagatgatgaagacccagtaaagggctataaaaatcaatgaaggcattggattctagataaagtcactgaatgcagagacacaagtaacaggataggttgggtttggtttaaaggagaaggaagagataaatatatatatgctaaaatttggcttttcctcctgtaattaaggatgttaatgattgggttgggccaccaaatgataatggagtaactaaagaagttactattaatccagacactacttgtggcaatgactgggtctgtgaacatcgatggcgccaaataaggtgagaatatgtatttagacatgtcctctaatagtaaatttccgtagcactttatttaaaacagttgaagtttaagaatatcaacgttttatatggtattgtgtttttaggaacatggttaatttccgcaatgtagtggatggccagccttttacaaactggtatgataatgggagcaaccaagtggcttttgggagaggaaacagaggattcattgttttcaacaatgatgactggtaagtaaatatcaattaaaaataatattttgtaccagtatgttcttggtttattcttttttttttctgttcattgacatttatcatatctgaaaaatcatgtagtcagtggagcgagaagacaatagagatcaaaattgggtagaagcaaaaggatgatggctgttactccttcgttctcctgttttcataagtgctttctgttgtaagcagaatcctttctgtgcacccttgcaatatcttatgcatatatagaatgcacattcatatgcttacctacacatgccacaaaatacacaaagtaattaatagaaggattgtgaaatcattaaaagaacgtttcttatagtcctgctcttttaatcatggaaaaatgctgcctcagtactaaaatatctttatttctctttttctcaatgacagctctacctagttttttggtatactttcttcacttctctgtctccttgtgacaaataacatttttaaagcatatggataaataatatgtatcttgtggttaatgatttgcttcaggagacttgagttttagttctgaaacttctcattattggcctttcatctgtgatttttgtatcctttggctgtagtataaatgattcccgaaactgtagctgagaagacctccttgcaaacagttgaattgtctctgtccaaggccaactgacactcatacttagctcactctagtataaattatacttcacttatgaaaaataaataaatacaaaaatatataagtcaagttgatctctttcctgccaaaaaaatgcgtgtctatttccttagtttccttcttttgtggatgaaaataccaaaaaaatcttttgtgaaaaagctttatatttcaaactatcacttcctcatacaaatgctagactgtttttatgtacaccctaaattctttttgacctcatgtagaataaaagaaggttaaaaaaataataccctttaaatttttaaagtaattggcattaagttcagttgagaaaaaatttgattttaccaaggtagcactttatcaaaatgtgaccgctcccgccaatcttcggtgatattcttcaactttgatttttcggttatattttcactactgaaaaggaaattggtaggttttctgtaaggttacttttggtcctagaaagctgtttacacctactagggaggcatatgggttttcttcttaatgagacttcactgcttagggttctaaaacataaagttatgctgtttatttgtgttagtctgtattcttgatttcattgttttgaagttaaatctgaaattttattttacaggacattttctttaactttgcaaactggtcttcctgctggcacatactgtgatgtcatttctggagataaaattaatggcaactgcacaggcattaaaatctacgtttctgatgatggcaaagctcatttttctattagtaactctgctgaagatccatttattgcaattcatgctgaatctaaattgtaaaatttaaaattaaatgcaaatccgcaaagca

SEQ ID NO: 557 - DNA, 9034 bp, Homo sapiens
tcttctcaatatcagcactggattgtagaacttgttgctgattttggcctggcattcaagttaactcttccccttggtatctgtacatacctttgatgtcagtgtttagtacacgtggcttggtcacttcatggctaaaaacgtgcttgtggaagacaagtctggcttggtgagtctgtgtggtcagcagtctctgatccgtgcagggtattaatgtgtcagggctgagtgttctgagatttatctagaggctgggaagggctcctgaaccagttgtttccgtcttgtcggtctgtcagggttggaaagtccaagccataggacccagtttcctttcttagcttacgttatctaccagagcaccgtgggctgttacttgccttgagttggaagcggttcgcatttataccggtaaatgtattcatccttttaatttatgtaaagttttttagtatgcaattctcgatcttttaagagttgacaacaaattttggttttctgctgttatgtgagaacattaggccacagcaacatgtcattgtgtaaggaaaaataaaagtgctaccatatgcaaaaaaaaaaaaaaaagaaaagaaaagaaacattaatgtctaagaggtcattgagatgatttccatgagagactttttgatgttcttcaccagttaggattattattgataatccttttcagattatgaataaacagtttgccctcaagtatttattcatgctactatttacattgtaaaatgtgcttcttacaggaatataaatagtttctggaaaggacactgacaacttcaaagcaaaatgaagctcttttggttgcttttcaccattgggttctgctgggctcagtattcctcaaatacacaacaaggacgaacatctattgttcatctgtttgaatggcgatgggttgatattgctcttgaatgtgagcgatatttagctcccaagggatttggaggggttcaggtgggtatgattcatagtatcaattgcagaattcactgtgcttgtagtaaacactattctgatcttctacgtgaagcttgggcaacattttacttcacaggtaagtattctaagtaaaagaattttctgaggaaaaaacaatgtagtattctttgcaactgtatattttgtttctgatataatctttcttcaacaagagccctccgatgtgctgttaatattttcaagagatagctgcctataccaagattcaagaatcttttgtattattgattagattctagaacattcaatgatatacagtaagacagaatttggtacttatgaagactgtttaatttgtaggtctctccaccaaatgaaaatgttgccattcacaaccctttcagaccttggtgggaaagataccaaccagttagctataaattatgcacaagatctggaaatgaagatgaatttagaaacatggtgactagatgcaacaatgttggggtaagtgaattctagtttcctttaaaaataacagataggaaaatgatttctgtctcttctttcttgctccttttgagcagaaagttttccatatcagttttaattttacttcatactttaaaactcaaaagtaactgtcaccttatgttcaatttttgaaaatatttgtatatgtgctctctactaaagagataagttaaagtttatagcagagtttacttctgaagcaaaacatcaaattttaaccgctataactatccatatttcctggaaggattttctggtgaggaattttaattccagttacaatatttgctctcatttttagatgacttgtgtctccattcctaattcttgggttttttttgtggtgaataggtagcttatctatttaatgaggagcagaatttgagatgaatagctaccttatttgtcttccaagcttagtagagagtacaggctttctcctggtgacccactgaaatttcccaaatagtaaccttttcagtctcatctgagttgtgtctccccaaaatgggctttttgcctttcctcctatttatggtagtttccggttctctcagtttatcattcctatatatatttggccaagtgtctggaatgaatgtaggtgtttagttcacattactttcctttcacagttgatttttgatcttgtaggaaaatagttataaggtatgaaatattttggaattttattagcacactataaatttaatcaataattctttaaatttctgcctctctgtaagtcacactgaattagaaactttgttttctaggttcgtatttatgtggatgctgtaattaatcatatgtgtggtaatgctgtgagtgcaggaacaagcagtacctgtggaagttacttcaaccctggaagtagggactttccagcagtcccatattctggatgggattttaatgatggtaaatgtaaaactggaagtggagatatcgagaactataatgatgctactcaggtaatttttttacgagagtgatctgaataaggagtgatatatgccttttgttgtagacatgtagctaattgaacttcgttgtaaatatgaatttagatctcttagggacagaggttaacaagtttgactactttaagaaactcaaatccatatttgaaaacctttaaatattgatttaagatttttaatcaatacacatttgtccacttttaaaaagctcccaaccaattgaaaaactcatcgactttatttcctaagttctctattttctattagaaaatatttccaagatacatctatagtagaatgtgagcatccccagtgtccaatgcaaggaagtcaccatagaatatctcttgaggaatcatggaataaatgaataatcaaatggattctcaggcgaaaagtgaggttttattaatcaatcataacattcttacctcaacaggtcagagattgtcgtctgtctggtcttctcgatcttgcactggggaaggattatgtgcgttctaagattgccgaatatatgaaccatctcattgacattggtgttgcagggttcagaattgatgcttccaagcacatgtggcctggagacataaaggcaattttggacaaactgcataatctaaacagtaactggttcccggaaggtagtaaacctttcatttaccaggaggtacgtcaatacatataggcatataaaatatcatcctattcattagaaaattcacggcagattcaattaaaaatgcaatttctgtaggataaagactgagtcatttccttaaaacagtgttctttaacctcctcttcttcacatacagcatatctaattctttatcacaacaggttttatggaggtacacagaatgtaggatactgataatagttatgtctttattttctttggaaaatgaaatgagttaatatttatcaaaaaaagtcagtcagatagtaaatatcgtattcctgtgagctgttattattatcattgatgtacaagactaaaaattaggtaagtattctcacaggacaacaggtaactttgacattatgtttctttcaatattgtagtgtatactttatcaaaaaaagaatataagaatattaccgatgaagataataagaataagaaaacgattttgagcgtttcatataacaaataggaccaggcgtggtggctcttgcatgtaactcagcactttgggaggctgaggcaggagaattccttgaggcctggagtttgggaccatcctggacgatatagcaagaccctgtctctaaagaacaaagcacaacaagtctaaaataactcagaaatagctgaaagctaatttttatataatataaacttatcggttaaaatgctttaaagtccttatgcaaaatgtttttttttcctaaatttcttctaggtaattgatctgggtggtgagccaattaaaagcagtgactactttggtaatggccgggtgacagaattcaagtatggtgcaaaactcggcacagttattcgcaagtggaatggagagaagatgtcttacttaaagtaaataaatacaacttttcccctgaactatttcatagatctgttagtcatactaccccagtgcgagttatcttctggaacattcttattcagacaactattaaggagtcagttgttaatgataagtattctagtgccctaaactctaatcaatcatcttttgtatttagagtgtctgtcacaagacagtatgcctaggaacgctaaacttaccctaggagtttctgtctgcgtacaagatgaatatactggatttgactgatgtttgcatataatcttttaaagccaggttattattaaaatgatcctatcatttataaagtatgtacaaagtgtccatgctattgtatttacttatacgaattggaaatgtaaaatgatttatattataacaatacaatattaaagccttattttaatctagtttgacattctgtataatgtgatgtggatattgatccttctggagtgcctctaaatgataatgtgctgaaacctctgaaaggaaattttttaataacaaacattttatatttgtaatatgaatataagtattccatacatgtatatacaaatatggactatatatatgtagattacacacgtgtgtttgtttatgaggtgtgtgtgtatatatatgtgagtgtgtgtttgtgtgtgtgtgtgtatatatatatatcttacagagtaaccatctaattagagaaagaatttaatcttcagatgccatgccttacagaaagagatgcacagtagagttactctcaaactattgtgaaatgatacatcaacgtatatcttatgtttcaaaaataggaactggggagaaggttggggtttcatgccttctgacagagcgcttgtctttgtggataaccatgacaatcaacgaggacatggcgctggaggagcctctatacttaccttctgggatgctaggtaaaaaaccaagttctctatttttttaacacctcttttaatgatggtatgaatattgtgatattctatgataatataattatgtaactttcaggctgtacaaaatggcagttggatttatgcttgctcatccttatggatttacacgagtaatgtcaagctaccgttggccaagatattttgaaaatggaaaagtaagttttggagttgttcaaaatatccttttctcaagaaaaaagaggcaatcttctcctaatttaatatgacaactattaagtgtttatttattcaacaaatatttaattattgtaaacctgatacaggattgtgatttagtaatgcaggttatattaaaggaataaactttatattctccattgaaaaagaatagcaagctttttcagagatatgacaaacatccccctagcccgcagggaaaataaaaataaaaattaaaaaaaccacttaaaaataagagctaggcacagggattaaaatatatacttcgtaccttcctcaggtttaattggaagaatatagatgccaacccttgtagagaacttaaaacatcatctgcccgtagtgagaacaatataaatgtcttttaaatactgttaaaaagttatatggaatagaaacaaatgatccagttcagctgagttaaatagggaaagtatactataagaggaaggaaattgtatgtactaaaggatagaaatttatagagagtattccaagaaaggtaagaatgagaaaaatatttgggagtatggtaaagacatcactctgctgagtagtttcaaaaaggaacagagaaataagagtgtaaagatatttggaaagctagtagaaggttttcttttaaactaaagggttgagaaacagcatcagagacttcagaactaaagcagaaattcctccttcctatgagtcacacagatatctagctagctttttttagattcctttcagtttgagaagtccgctactatgtataacaactgattctattgttaaacagctttaatatttagaaggtgtacttttatattgagacaacttcttataatttctactaattggtcttatttctgttgttaggagtcagagagttcttttattttttctattactataacattcccactttgacaggactgctgcatgctataaactcttaagttttgttcacttttcaccatatgacgtgattttaaggtgaacactgataaacttcctagggttactctgtgttttttaatgaagatttcttaaagtgccaatcagaaaagcataatactaaaaatatggtcaatttataaaaaaaaaatgttcagatgtagtattttgtacatttatctaaaaagaagcatgacggcctccaatatttatttagcatatgtcatgttcaaggcattttcacatatattacttaatttttatagcaaaagaactcattattctcattttacaaatgaggaaactgagacacagagaaattatttatattgattaaattttctcagctactagtaatagagcctatgttttaatcctggtgtttctagtactaatgcccttcccatttcaatgccattgcatggcttacagtgatgttaagaagcccttgcaggccaggtgcagtggctcacacctataatcccagcactgtgtgcggccagctgagaaggtcagctgacctgaggagttcaagacctatctgggcaagctagcaagaccttgcctctactgaaaattaaaaaaaaaaaaaaattagctgggtgcggtggtgcacaccaacagtcttagctacttgggaggctgagatgggaggttcgcttgagcctcggagatcaaggctgcagtgagctacgatcatgccactgtactccagcctgggtgacagagcaaagaagtctttgcagtgccttggaatgaaaaggagaggataacaatttgctacctttgtttgaaatatggcaaaagagaaccagaggatagagagatgatgaagacccagtaaagggctataaaaatcaatgaaggcattggattctagataaagtcactgaatgcagagacacaagtaacaggataggttgggtttggtttaaaggagaaggaagagataaatatatatatgctaaaatttggcttttcctcctgtaattaaggatgttaatgattgggttgggccaccaaatgataatggagtaactaaagaagttactattaatccagacactacttgtggcaatgactgggtctgtgaacatcgatggcgccaaataaggtgagaatatgtatttagacatgtcctctaatagtaaatttccgtagcactttatttaaaacagttgaagtttaagaatatcaacgttttatatggtattgtgtttttaggaacatggttaatttccgcaatgtagtggatggccagccttttacaaactggtatgataatgggagcaaccaagtggcttttgggagaggaaacagaggattcattgttttcaacaatgatgactggtaagtaaatatcaattaaaaataatattttgtaccagtatgttcttggtttattcttttttttttctgttcattgacatttatcatatctgaaaaatcatgtagtcagtggagcgagaagacaatagagatcaaaattgggtagaagcaaaaggatgatggctgttactccttcgttctcctgttttcataagtgctttctgttgtaagcagaatcctttctgtgcacccttgcaatatcttatgcatatatagaatgcacattcatatgcttacctacacatgccacaaaatacacaaagtaattaatagaaggattgtgaaatcattaaaagaacgtttcttatagtcctgctcttttaatcatggaaaaatgctgcctcagtactaaaatatctttatttctctttttctcaatgacagctctacctagttttttggtatactttcttcacttctctgtctccttgtgacaaataacatttttaaagcatatggataaataatatgtatcttgtggttaatgatttgcttcaggagacttgagttttagttctgaaacttctcattattggcctttcatctgtgatttttgtatcctttggctgtagtataaatgattcccgaaactgtagctgagaagacctccttgcaaacagttgaattgtctctgtccaaggccaactgacactcatacttagctcactctagtataaattatacttcacttatgaaaaataaataaatacaaaaatatataagtcaagttgatctctttcctgccaaaaaaatgcgtgtctatttccttagtttccttcttttgtggatgaaaataccaaaaaaatcttttgtgaaaaagctttatatttcaaactatcacttcctcatacaaatgctagactgtttttatgtacaccctaaattctttttgacctcatgtagaataaaagaaggttaaaaaaataataccctttaaatttttaaagtaattggcattaagttcagttgagaaaaaatttgattttaccaaggtagcactttatcaaaatgtgaccgctcccgccaatcttcggtgatattcttcaactttgatttttcggttatattttcactactgaaaaggaaattggtaggttttctgtaaggttacttttggtcctagaaagctgtttacacctactagggaggcatatgggttttcttcttaatgagacttcactgcttagggttctaaaacataaagttatgctgtttatttgtgttagtctgtattcttgatttcattgttttgaagttaaatctgaaattttattttacaggacattttctttaactttgcaaactggtcttcctgctggcacatactgtgatgtcatttctggagataaaattaatggcaactgcacaggcattaaaatctacgtttctgatgatggcaaagctcatttttctattagtaactctgctgaagatccatttattgcaattcatgctgaatctaaattgtaaaatttaaaattaaatgcaaatccgcaaagca

SEQ ID NO: 558 - DNA, 8403 bp, Homo sapiens
taaaatgtgcttcttacaggaatataaatagtttctggaaaggacactgacaacttcaaagcaaaatgaagttctttctgttgcttttcaccattgggttctgctgggctcagtattccccaaatacacaacaaggacggacatctattgttcatctgtttgaatggcgatgggttgatattgctcttgaatgtgagcgatatttagctccgaagggatttggaggggttcaggtgggtatgattcatagtatcaattgcggaattcactgtgcttgtaggaaatagtattctgatcttatctgtgaagcttgggcaacattttacttcacaggtaagtattctaagtaaaagagatttctgagggaaaatctatgtagtattcttggcaactttatattttgtttctgagataatctttcttcaccaagagccctccaatgtgctgttaatattttcaagagatagctgcctataccaagattcaagaatcttttatactattgattagtttctagaacattcaatgatacacagtaagacagaatttggtacttatgaagactgtttaatttgtaggtctctccaccaaatgaaaatgttgcaatttacaaccctttcagaccttggtgggaaagataccaaccagttagctataaattatgcacaagatctggaaatgaagatgaatttagaaacatggtgactagatgtaacaatgttggggtaagtgaattctagtttcctttaaaaataacagacaggaaaatggtttctctctcttctttcttgctccttttcagcagaaaattttccgtattttatttttttaattttacttcataatttaaaactcaaaattaactgtttatttatgttcaacttttgtgaatatttgtgtgtgtgctatctactaaagaggtaagttaaagtttaaatcagaatttgcttctaaagcaaaacatcaaattttaacccttataactgttcgtatttcccggaaacaatttactggttaggaagtataattccagttacaatgtttgctatcatttttaggtgacttgtgtctccatccgtaattcttgggtttttcatggtgaatagctagcttctctatttaatgaggagcataaattgagattaatagctaccttgtttgtcttcaaaagcttcatagagagtacaggctttctcctggtgacccactgaaatttccaaaacaataacctttccactctcatctgagttttgtcttcccaaagtgggctttttgcatttcctcctatttatggtagtttctggtctctcaatttatcattcctataaatatttgaccaagtgtctagaaggcatgtaggtgtttagttcacattactttcctttcacagttgatttttgatcttgtaggaaaataattataagatatcatgaaatattttggagttttattaacatactataaacttgcatcaataatgctttaaatttctacctctctgtaagtcacactgaagtagaaactttgttttctaggttcgtatttatgtggatgctgtaattaatcatatgtgtggtaacgctgtgagtgcaggaacaagcagtacctgtggaagttacttcaaccctggaagtagggactttccagcagtcccatattctggatgggatttcaatgatggtaaatgtaaaactggaagtggagatatcgagaactacaatgatgctactcaggtaatttttttacgagagtgatctgaataaaagagtaatatatgccttttcttgtagacatgtagctaattgaatttcatttaaaataggaatttagatctcttagggacagaagttaacaagtttgactactttaagaaactcaaatccatatttaagaactttcaaatattgatttaagatttttaatcaatacacatttgcccacttctaagaagttcccaattaaaaatctcatcgactttatttcctaaattctctattttctattagaaaatatttcaaagatacatctgtagtagaatgtgagcatccccagtgcccaatgcaaggaagtcactatagaatatctcttgaggaatcatggaataaatgaataatccaatggattctcaggagaaaaatgaggttttatgaatcaatcataacatttttacctcaacaggtcagagattgtcgtctgactggtcttcttgatcttgcactggagaaggattacgtgcgttctaagattgccgaatatatgaaccatctcattgacattggtgttgcagggttcagacttgatgcttccaagcacatgtggcctggagacataaaggcaattttggacaaactgcataatctaaacagtaactggttccctgcaggaagtaaacctttcatttaccaggaggtacatcaatacttatatgcctataaaatatcatcttattcgttagaaaattaatggaagatttaattaaaaatgcaatttctgtaggataaggaatgagacatttacataaaacagtgttctttaacctcctcttcttcacatacagcatatctaattctttatcacaacatgttttatggaggtacacagaatgtaggatactgataatagttatgtctttactttctttggataatgaaacaagttaatatttatcaaggaatttcagtcgatactaaatgttttattagtgtgagctcttattattatcattgatgtagaagactaaaaattaggtaagtattttcacaggacaacaggtatctttgacattatgcttctttcaatattgtagcctatactttatcaaataaaagaatataagaatattacctgttgagataataggaataagaaaaccattttgcacatttcgtgtaacaaacaggaccaggcatggtggctcgtgcatgtaatctcagcactttgggaggctgcggcagggggattgcttgaggccaggagtttgggaccatcctggacgacatagcaagaccctgtctctaaaaaacaaaacaaaacaagacaaaaagaaataataaatagcttaatttattaataaataacaaatagcataaagctatttttatataatattaacttattggttaaaatgctttaaagtccttacacaaaatgttattgtttcctaaatttctactaggtaattgatctgggtggtgagccaattaaaagcagtgactactttggtaatggccgggtgacagaattcaagtatggtgcaaaactcggcacagttattcgcaagtggaatggagagaagatgtcttacttaaagtaaataaatacaacttttccctgaagtatttcatggatctattagtcatactacctcagtgtgacttatcttctggaacattcttattcagacaactatcaaagagtcaattgtgaatgataagtattctagtgccctaaactctaatcaatcatcttttgtatttagagtgtctgtcacaaggcaatatgtctaggaacgctaaacataccctaggagttttcatctaagtacgagatgaatatactggatttgactgatgtttgcatataatcttttaaagccaggttattattaaaatgatcctatcatttatgaagtatgtacaaagtttccatcctgtagaatttacatgtattatatgaattaaaaatataaaaaatatttatattataacaatacagtattgaagccttattttaatctagtttgattaaactagattggtctagtttgattaaactagattaaacttcttggtctaggcacatgaatattgttgtggggaagagaattctgtataatgtgatatggatattgatccttctggagtgcctctaaatgataatgtgctgaaacctctgaaaggaccttttttaataacaaaaatcttatatttgtaatatgaatgtaagtattccatacatgtatatacaaatatggaccatacatgtagattacacatgtgtgtgtgtttgatgtgtgtgtatatatatgtgtgtgtgtgtttgtgtgtgtatatatatatatatctcttacaggaaaagcatttaattagagaaagaatttaatcttcagatgccatgccttacagagagagatgcacagttaagttactctcaaactgttgtgaaatgatacatcaacgtatatcttatttttcaaaaataggaactggggagaaggttggggtttcgtaccttctgacagagcgcttgtctttgtggataaccatgacaatcaacgaggacatggggctggaggagcctctattcttaccttctgggatgctaggtagaaaaccaagttctctatttttttaacacgtcttttaatgatggcaagaatattctgacatcctatgaaaatataattatgtaacttccaggctgtacaaaatggcagttggatttatgcttgctcatccttacggatttacacgagtaatgtcaagctaccgttggccaagacagtttcaaaatggaaacgtaagttttggagttgttcaatatatccttttctgaagaaaaaggaagcaatcttattctaacttaacatgacaactattaattatatatttattcaacaaatatttaattgattgtaaactggatacagggctgtgattttagtaatgtaggttatattaaaggagtaaaatttatattctccattgacaaagagtatgcaagctgtttcagagatatgacaaacatccccttagcccgcagggaaacaaaaaacaaaaaacagaaaaacactcaaaactaagagctagacacagggattaaaatatatacttcgaataagtacctacctcagggctgataggaagattatacatgccaacacttttagagaacttaaaacatcatctgcccgtagtgagaacaatataaatgtttgttaaatacttttaaaaagttatatggaatagaaagaaatgaatcaattgagctgagttaaatagggaaagtatcatataagaggaaggaaatgatatgtactaaagaatagaaatttagagagtattccaagaaaggtaagaatgagaaaaatatttgggagtatggtaaagacattaatctgatgagaagtttcaaaaaggaacagagaaattacagtgtaaagatatttggaaagctagtagaaggttttcttttaaactaaagggttcagaaacagcatcagagacttcagaactaaagcagaaattcctccttcctatgagtcacacggatatctagctagctttttttagattcctttcagtttgagaagtccgcactttgtatagcaatttattctattgttaaacagctttaatatttagaaggtgtacttttatattgagccaacttcttttaatttctactaattggtcttatttctgatgttaggagtcatagagtatttttattttttctattactataacatttccactttgccaggactgctgcatgctaaaaactcttagttttgttcacttttcaccatatgacatgattctaaggtcaacactgaaaaacttcctaagattcctctggattttttaatgaagattttttaaagtgccaatcagaaaaccataatatgaaaaatgtggtcaatttataaataatgttcagatgtattgttttgtacatttatctaaaaagaagcatgaatgattctaatatttattcagcacatgtcacattcaaggcattttcacatatattacttaatttttatagcaaaaaaaccaatattcccattttacaaatgaagaaactgagacacagagatattaagtgtattgattaaattttctcaggtactagtaatagagcctatgttttaatcctggtgtttctagtactaatgcccttcccatttcaatgacattgcatggcttaccacgatgttaagaagctcttgcaggccaggtgcagtggctcacacctgtaatcccagcacctagtgaggcgaggcgagaagatcagctgacctgaggagttcaagacctatctgggcaagctagcaagacctcgtctttactgaaaattttttaaaaattagctggttgcggtggtgcacaccaacagtcttagctacttaggaggctgagataggaggatcgcttgagcctgggagatcaaggctgcagtgagctatgatcatgccactgtactccagcctgggtgacagagcaaagaagcctttgcagttctttggaatgaaaaggagaggataaaaatttgttaccttgtttgaaatatgccagaagaaaaccagaggatagagagatgatgaagacccagtaaagggctataaacattaatgaaggcattggattctagataaagtcactgaatgcagagacacaagtaacaggattggttgggtttggtgtaaaggagaaggaagaggtaaatacatgcatagtaaaatttggctttttcccccctacttaaggatgttaatgattgggttgggccaccaaataataatggagtaattaaagaagttactattaatccagacactacttgtggcaatgactgggtctgtgaacatcgatggcgccaaataaggtgagaatatgtatttagacatgtcctctaatagtaaactttccactgcattttatttaaaacagttgaagtttaagaatatcaacgttttatatggtattgtgtttttaggaacatggttattttccgcaatgtagtggatggccagccttttacaaattggtatgataatgggagcaaccaagtggcttttgggagaggaaacagaggattcattgttttcaacaatgatgactggtaagtaaatatcaattaaaaataatattttgtaccagtatgttcttggtttattcttttttttctctgttcattgacttttatcatatctgaaaaatcatgtagtcagtggagcaagaagacaatagagatcaaaattgggcagaagcaaaaggatgatggctgttactccttcgttctttttttttcataagtgctttctgttgtaagcagaatcctttctgtgcacccttgcagtatcatatgcatatatatgatgcacatgcatatgctcacctacacatgccacaaaatcaatatataaaatcacaatcaatataaggattgtgaaatcattaaaaaaaagtgtcttataatcctgcttttttaaccatggagaaatgctgcctaggtactaaaatatctttatttctaactctttttctcaatgactgctctacgtagttttttggtacactttcttcacttctctgtctccttgtgacaaataacatttttaaagcacatgtatgaataatatgtatcttgtggttactgttttgcttcaggagatttgagttttatttttgaaacttctcattattggcctttcatctgtgattcttatatgctttacctgaagcataaatgattatctaagatatagctcagaagaccttggtgtaaacagttgaattgtccctgtccaagaccaactgacactcatacttagctcactctagtataaattatatttcactgatgaaaagtaaataaatacatcaatatacaagtcaagttgatctctttcctgccaaaaaagcccatgtctagttttttaatttctttcttttgtagatgaaaataccaaaataagtttttgtgaaaaagctttatatttcaaactatcacttcttcatagaaatgctagattatttttatgtgcatcccaaattcgttttgatctcatgggagaagaaggaggttaaaaaataataccctttaaatttttaagagtaattggtattaatttcagttgagaacaaatttgattttaccaaggtagaacttttatcaaagtgtgaccgttcctgccaatcttcagtgatattcttcaactttgatgttttggtaatattttcactactaaccaggaaattgctaggttttctgtaaggttacttttggtcctagaaagctatttccacctactagagaggcatatgggttttcttcttaataagacttcactgcttaggtttgtttctacaacataaagttatgctgtttatttgtgttagtctgtattcttgattttcattgtattgaagatcaaccttaaattttattttacaggtcattttctttaactttgcaaactggtcttcctgctggcacatactgtgatgtcatttctggagataaaattaatggcaattgcacaggcattaaaatttacgtttctgatgatggcaaagctcatttttctattagtaactctgctgaagatccatttattgcaattcatgctgaatctaaattgtaaaatttaaaattaaatgcatgtcctcaaaacaa

SEQ ID NO: 559 - DNA, 8871 bp, Homo sapiens
tggcttggtgagtctgtgtggtcagcagtctctgatccgtgcagggtattaatgtgtcagggctgagtgttctgagatttatctagaggctgggaagggctcctgaaccagttgtttccgtcttgtcggtctgtcagggttggaaagtccaagccataggacccagtttcctttcttagcttacgttatctaccagagcaccgtgggctgttacttgccttgagttggaagcggttcgcatttataccggtaaatgtattcatccttttaatttatgtaaagttttttagtatgcaattctcgatcttttaagagttgacaacaaattttggttttctgctgttatgtgagaacattaggccacagcaacatgtcattgtgtaaggaaaaataaaagtgctaccatatgcaaaaaaaaaaaaaaaagaaaagaaaagaaacattaatgtctaagaggtcattgagatgatttccatgagagactttttgatgttcttcaccagttaggattattattgataatccttttcagattatgaataaacagtttgccctcaagtatttattcatgctactatttacattgtaaaatgtgcttcttacaggaatataaatagtttctggaaaggacactgacaacttcaaagcaaaatgaagctcttttggttgcttttcaccattgggttctgctgggctcagtattcctcaaatacacaacaaggacgaacatctattgttcatctgtttgaatggcgatgggttgatattgctcttgaatgtgagcgatatttagctcccaagggatttggaggggttcaggtgggtatgattcatagtatcaattgcagaattcactgtgcttgtagtaaacactattctgatcttctacgtgaagcttgggcaacattttacttcacaggtaagtattctaagtaaaagaattttctgaggaaaaaacaatgtagtattctttgcaactgtatattttgtttctgatataatctttcttcaacaagagccctccgatgtgctgttaatattttcaagagatagctgcctataccaagattcaagaatcttttgtattattgattagattctagaacattcaatgatatacagtaagacagaatttggtacttatgaagactgtttaatttgtaggtctctccaccaaatgaaaatgttgccattcacaaccctttcagaccttggtgggaaagataccaaccagttagctataaattatgcacaagatctggaaatgaagatgaatttagaaacatggtgactagatgcaacaatgttggggtaagtgaattctagtttcctttaaaaataacagataggaaaatgatttctgtctcttctttcttgctccttttgagcagaaagttttccatatcagttttaattttacttcatactttaaaactcaaaagtaactgtcaccttatgttcaatttttgaaaatatttgtatatgtgctctctactaaagagataagttaaagtttatagcagagtttacttctgaagcaaaacatcaaattttaaccgctataactatccatatttcctggaaggattttctggtgaggaattttaattccagttacaatatttgctctcatttttagatgacttgtgtctccattcctaattcttgggttttttttgtggtgaataggtagcttatctatttaatgaggagcagaatttgagatgaatagctaccttatttgtcttccaagcttagtagagagtacaggctttctcctggtgacccactgaaatttcccaaatagtaaccttttcagtctcatctgagttgtgtctccccaaaatgggctttttgcctttcctcctatttatggtagtttccggttctctcagtttatcattcctatatatatttggccaagtgtctggaatgaatgtaggtgtttagttcacattactttcctttcacagttgatttttgatcttgtaggaaaatagttataaggtatgaaatattttggaattttattagcacactataaatttaatcaataattctttaaatttctgcctctctgtaagtcacactgaattagaaactttgttttctaggttcgtatttatgtggatgctgtaattaatcatatgtgtggtaatgctgtgagtgcaggaacaagcagtacctgtggaagttacttcaaccctggaagtagggactttccagcagtcccatattctggatgggattttaatgatggtaaatgtaaaactggaagtggagatatcgagaactataatgatgctactcaggtaatttttttacgagagtgatctgaataaggagtgatatatgccttttgttgtagacatgtagctaattgaacttcgttgtaaatatgaatttagatctcttagggacagaggttaacaagtttgactactttaagaaactcaaatccatatttgaaaacctttaaatattgatttaagatttttaatcaatacacatttgtccacttttaaaaagctcccaaccaattgaaaaactcatcgactttatttcctaagttctctattttctattagaaaatatttccaagatacatctatagtagaatgtgagcatccccagtgtccaatgcaaggaagtcaccatagaatatctcttgaggaatcatggaataaatgaataatcaaatggattctcaggcgaaaagtgaggttttattaatcaatcataacattcttacctcaacaggtcagagattgtcgtctgtctggtcttctcgatcttgcactggggaaggattatgtgcgttctaagattgccgaatatatgaaccatctcattgacattggtgttgcagggttcagaattgatgcttccaagcacatgtggcctggagacataaaggcaattttggacaaactgcataatctaaacagtaactggttcccggaaggtagtaaacctttcatttaccaggaggtacgtcaatacatataggcatataaaatatcatcctattcattagaaaattcacggcagattcaattaaaaatgcaatttctgtaggataaagactgagtcatttccttaaaacagtgttctttaacctcctcttcttcacatacagcatatctaattctttatcacaacaggttttatggaggtacacagaatgtaggatactgataatagttatgtctttattttctttggaaaatgaaatgagttaatatttatcaaaaaaagtcagtcagatagtaaatatcgtattcctgtgagctgttattattatcattgatgtacaagactaaaaattaggtaagtattctcacaggacaacaggtaactttgacattatgtttctttcaatattgtagtgtatactttatcaaaaaaagaatataagaatattaccgatgaagataataagaataagaaaacgattttgagcgtttcatataacaaataggaccaggcgtggtggctcttgcatgtaactcagcactttgggaggctgaggcaggagaattccttgaggcctggagtttgggaccatcctggacgatatagcaagaccctgtctctaaagaacaaagcacaacaagtctaaaataactcagaaatagctgaaagctaatttttatataatataaacttatcggttaaaatgctttaaagtccttatgcaaaatgtttttttttcctaaatttcttctaggtaattgatctgggtggtgagccaattaaaagcagtgactactttggtaatggccgggtgacagaattcaagtatggtgcaaaactcggcacagttattcgcaagtggaatggagagaagatgtcttacttaaagtaaataaatacaacttttcccctgaactatttcatagatctgttagtcatactaccccagtgcgagttatcttctggaacattcttattcagacaactattaaggagtcagttgttaatgataagtattctagtgccctaaactctaatcaatcatcttttgtatttagagtgtctgtcacaagacagtatgcctaggaacgctaaacttaccctaggagtttctgtctgcgtacaagatgaatatactggatttgactgatgtttgcatataatcttttaaagccaggttattattaaaatgatcctatcatttataaagtatgtacaaagtgtccatgctattgtatttacttatacgaattggaaatgtaaaatgatttatattataacaatacaatattaaagccttattttaatctagtttgacattctgtataatgtgatgtggatattgatccttctggagtgcctctaaatgataatgtgctgaaacctctgaaaggaaattttttaataacaaacattttatatttgtaatatgaatataagtattccatacatgtatatacaaatatggactatatatatgtagattacacacgtgtgtttgtttatgaggtgtgtgtgtatatatatgtgagtgtgtgtttgtgtgtgtgtgtgtatatatatatatcttacagagtaaccatctaattagagaaagaatttaatcttcagatgccatgccttacagaaagagatgcacagtagagttactctcaaactattgtgaaatgatacatcaacgtatatcttatgtttcaaaaataggaactggggagaaggttggggtttcatgccttctgacagagcgcttgtctttgtggataaccatgacaatcaacgaggacatggcgctggaggagcctctatacttaccttctgggatgctaggtaaaaaaccaagttctctatttttttaacacctcttttaatgatggtatgaatattgtgatattctatgataatataattatgtaactttcaggctgtacaaaatggcagttggatttatgcttgctcatccttatggatttacacgagtaatgtcaagctaccgttggccaagatattttgaaaatggaaaagtaagttttggagttgttcaaaatatccttttctcaagaaaaaagaggcaatcttctcctaatttaatatgacaactattaagtgtttatttattcaacaaatatttaattattgtaaacctgatacaggattgtgatttagtaatgcaggttatattaaaggaataaactttatattctccattgaaaaagaatagcaagctttttcagagatatgacaaacatccccctagcccgcagggaaaataaaaataaaaattaaaaaaaccacttaaaaataagagctaggcacagggattaaaatatatacttcgtaccttcctcaggtttaattggaagaatatagatgccaacccttgtagagaacttaaaacatcatctgcccgtagtgagaacaatataaatgtcttttaaatactgttaaaaagttatatggaatagaaacaaatgatccagttcagctgagttaaatagggaaagtatactataagaggaaggaaattgtatgtactaaaggatagaaatttatagagagtattccaagaaaggtaagaatgagaaaaatatttgggagtatggtaaagacatcactctgctgagtagtttcaaaaaggaacagagaaataagagtgtaaagatatttggaaagctagtagaaggttttcttttaaactaaagggttgagaaacagcatcagagacttcagaactaaagcagaaattcctccttcctatgagtcacacagatatctagctagctttttttagattcctttcagtttgagaagtccgctactatgtataacaactgattctattgttaaacagctttaatatttagaaggtgtacttttatattgagacaacttcttataatttctactaattggtcttatttctgttgttaggagtcagagagttcttttattttttctattactataacattcccactttgacaggactgctgcatgctataaactcttaagttttgttcacttttcaccatatgacgtgattttaaggtgaacactgataaacttcctagggttactctgtgttttttaatgaagatttcttaaagtgccaatcagaaaagcataatactaaaaatatggtcaatttataaaaaaaaaatgttcagatgtagtattttgtacatttatctaaaaagaagcatgacggcctccaatatttatttagcatatgtcatgttcaaggcattttcacatatattacttaatttttatagcaaaagaactcattattctcattttacaaatgaggaaactgagacacagagaaattatttatattgattaaattttctcagctactagtaatagagcctatgttttaatcctggtgtttctagtactaatgcccttcccatttcaatgccattgcatggcttacagtgatgttaagaagcccttgcaggccaggtgcagtggctcacacctataatcccagcactgtgtgcggccagctgagaaggtcagctgacctgaggagttcaagacctatctgggcaagctagcaagaccttgcctctactgaaaattaaaaaaaaaaaaaaattagctgggtgcggtggtgcacaccaacagtcttagctacttgggaggctgagatgggaggttcgcttgagcctcggagatcaaggctgcagtgagctacgatcatgccactgtactccagcctgggtgacagagcaaagaagtctttgcagtgccttggaatgaaaaggagaggataacaatttgctacctttgtttgaaatatggcaaaagagaaccagaggatagagagatgatgaagacccagtaaagggctataaaaatcaatgaaggcattggattctagataaagtcactgaatgcagagacacaagtaacaggataggttgggtttggtttaaaggagaaggaagagataaatatatatatgctaaaatttggcttttcctcctgtaattaaggatgttaatgattgggttgggccaccaaatgataatggagtaactaaagaagttactattaatccagacactacttgtggcaatgactgggtctgtgaacatcgatggcgccaaataaggtgagaatatgtatttagacatgtcctctaatagtaaatttccgtagcactttatttaaaacagttgaagtttaagaatatcaacgttttatatggtattgtgtttttaggaacatggttaatttccgcaatgtagtggatggccagccttttacaaactggtatgataatgggagcaaccaagtggcttttgggagaggaaacagaggattcattgttttcaacaatgatgactggtaagtaaatatcaattaaaaataatattttgtaccagtatgttcttggtttattcttttttttttctgttcattgacatttatcatatctgaaaaatcatgtagtcagtggagcgagaagacaatagagatcaaaattgggtagaagcaaaaggatgatggctgttactccttcgttctcctgttttcataagtgctttctgttgtaagcagaatcctttctgtgcacccttgcaatatcttatgcatatatagaatgcacattcatatgcttacctacacatgccacaaaatacacaaagtaattaatagaaggattgtgaaatcattaaaagaacgtttcttatagtcctgctcttttaatcatggaaaaatgctgcctcagtactaaaatatctttatttctctttttctcaatgacagctctacctagttttttggtatactttcttcacttctctgtctccttgtgacaaataacatttttaaagcatatggataaataatatgtatcttgtggttaatgatttgcttcaggagacttgagttttagttctgaaacttctcattattggcctttcatctgtgatttttgtatcctttggctgtagtataaatgattcccgaaactgtagctgagaagacctccttgcaaacagttgaattgtctctgtccaaggccaactgacactcatacttagctcactctagtataaattatacttcacttatgaaaaataaataaatacaaaaatatataagtcaagttgatctctttcctgccaaaaaaatgcgtgtctatttccttagtttccttcttttgtggatgaaaataccaaaaaaatcttttgtgaaaaagctttatatttcaaactatcacttcctcatacaaatgctagactgtttttatgtacaccctaaattctttttgacctcatgtagaataaaagaaggttaaaaaaataataccctttaaatttttaaagtaattggcattaagttcagttgagaaaaaatttgattttaccaaggtagcactttatcaaaatgtgaccgctcccgccaatcttcggtgatattcttcaactttgatttttcggttatattttcactactgaaaaggaaattggtaggttttctgtaaggttacttttggtcctagaaagctgtttacacctactagggaggcatatgggttttcttcttaatgagacttcactgcttagggttctaaaacataaagttatgctgtttatttgtgttagtctgtattcttgatttcattgttttgaagttaaatctgaaattttattttacaggacattttctttaactttgcaaactggtcttcctgctggcacatactgtgatgtcatttctggagataaaattaatggcaactgcacaggcattaaaatctacgtttctgatgatggcaaagctcatttttctattagtaactctgctgaagatccatttattgcaattcatgctgaatctaaattgtaaaatttaaaattaaatgcaaatccgcaaagc

SEQ ID NO: 560 - DNA, 8849 bp, Homo sapiens
cagcagtctctgatccgtgcagggtattaatgtgtcagggctgagtgttctgagatttatctagaggctgggaagggctcctgaaccagttgtttccgtcttgtcggtctgtcagggttggaaagtccaagccataggacccagtttcctttcttagcttacgttatctaccagagcaccgtgggctgttacttgccttgagttggaagcggttcgcatttataccggtaaatgtattcatccttttaatttatgtaaagttttttagtatgcaattctcgatcttttaagagttgacaacaaattttggttttctgctgttatgtgagaacattaggccacagcaacatgtcattgtgtaaggaaaaataaaagtgctaccatatgcaaaaaaaaaaaaaaaagaaaagaaaagaaacattaatgtctaagaggtcattgagatgatttccatgagagactttttgatgttcttcaccagttaggattattattgataatccttttcagattatgaataaacagtttgccctcaagtatttattcatgctactatttacattgtaaaatgtgcttcttacaggaatataaatagtttctggaaaggacactgacaacttcaaagcaaaatgaagctcttttggttgcttttcaccattgggttctgctgggctcagtattcctcaaatacacaacaaggacgaacatctattgttcatctgtttgaatggcgatgggttgatattgctcttgaatgtgagcgatatttagctcccaagggatttggaggggttcaggtgggtatgattcatagtatcaattgcagaattcactgtgcttgtagtaaacactattctgatcttctacgtgaagcttgggcaacattttacttcacaggtaagtattctaagtaaaagaattttctgaggaaaaaacaatgtagtattctttgcaactgtatattttgtttctgatataatctttcttcaacaagagccctccgatgtgctgttaatattttcaagagatagctgcctataccaagattcaagaatcttttgtattattgattagattctagaacattcaatgatatacagtaagacagaatttggtacttatgaagactgtttaatttgtaggtctctccaccaaatgaaaatgttgccattcacaaccctttcagaccttggtgggaaagataccaaccagttagctataaattatgcacaagatctggaaatgaagatgaatttagaaacatggtgactagatgcaacaatgttggggtaagtgaattctagtttcctttaaaaataacagataggaaaatgatttctgtctcttctttcttgctccttttgagcagaaagttttccatatcagttttaattttacttcatactttaaaactcaaaagtaactgtcaccttatgttcaatttttgaaaatatttgtatatgtgctctctactaaagagataagttaaagtttatagcagagtttacttctgaagcaaaacatcaaattttaaccgctataactatccatatttcctggaaggattttctggtgaggaattttaattccagttacaatatttgctctcatttttagatgacttgtgtctccattcctaattcttgggttttttttgtggtgaataggtagcttatctatttaatgaggagcagaatttgagatgaatagctaccttatttgtcttccaagcttagtagagagtacaggctttctcctggtgacccactgaaatttcccaaatagtaaccttttcagtctcatctgagttgtgtctccccaaaatgggctttttgcctttcctcctatttatggtagtttccggttctctcagtttatcattcctatatatatttggccaagtgtctggaatgaatgtaggtgtttagttcacattactttcctttcacagttgatttttgatcttgtaggaaaatagttataaggtatgaaatattttggaattttattagcacactataaatttaatcaataattctttaaatttctgcctctctgtaagtcacactgaattagaaactttgttttctaggttcgtatttatgtggatgctgtaattaatcatatgtgtggtaatgctgtgagtgcaggaacaagcagtacctgtggaagttacttcaaccctggaagtagggactttccagcagtcccatattctggatgggattttaatgatggtaaatgtaaaactggaagtggagatatcgagaactataatgatgctactcaggtaatttttttacgagagtgatctgaataaggagtgatatatgccttttgttgtagacatgtagctaattgaacttcgttgtaaatatgaatttagatctcttagggacagaggttaacaagtttgactactttaagaaactcaaatccatatttgaaaacctttaaatattgatttaagatttttaatcaatacacatttgtccacttttaaaaagctcccaaccaattgaaaaactcatcgactttatttcctaagttctctattttctattagaaaatatttccaagatacatctatagtagaatgtgagcatccccagtgtccaatgcaaggaagtcaccatagaatatctcttgaggaatcatggaataaatgaataatcaaatggattctcaggcgaaaagtgaggttttattaatcaatcataacattcttacctcaacaggtcagagattgtcgtctgtctggtcttctcgatcttgcactggggaaggattatgtgcgttctaagattgccgaatatatgaaccatctcattgacattggtgttgcagggttcagaattgatgcttccaagcacatgtggcctggagacataaaggcaattttggacaaactgcataatctaaacagtaactggttcccggaaggtagtaaacctttcatttaccaggaggtacgtcaatacatataggcatataaaatatcatcctattcattagaaaattcacggcagattcaattaaaaatgcaatttctgtaggataaagactgagtcatttccttaaaacagtgttctttaacctcctcttcttcacatacagcatatctaattctttatcacaacaggttttatggaggtacacagaatgtaggatactgataatagttatgtctttattttctttggaaaatgaaatgagttaatatttatcaaaaaaagtcagtcagatagtaaatatcgtattcctgtgagctgttattattatcattgatgtacaagactaaaaattaggtaagtattctcacaggacaacaggtaactttgacattatgtttctttcaatattgtagtgtatactttatcaaaaaaagaatataagaatattaccgatgaagataataagaataagaaaacgattttgagcgtttcatataacaaataggaccaggcgtggtggctcttgcatgtaactcagcactttgggaggctgaggcaggagaattccttgaggcctggagtttgggaccatcctggacgatatagcaagaccctgtctctaaagaacaaagcacaacaagtctaaaataactcagaaatagctgaaagctaatttttatataatataaacttatcggttaaaatgctttaaagtccttatgcaaaatgtttttttttcctaaatttcttctaggtaattgatctgggtggtgagccaattaaaagcagtgactactttggtaatggccgggtgacagaattcaagtatggtgcaaaactcggcacagttattcgcaagtggaatggagagaagatgtcttacttaaagtaaataaatacaacttttcccctgaactatttcatagatctgttagtcatactaccccagtgcgagttatcttctggaacattcttattcagacaactattaaggagtcagttgttaatgataagtattctagtgccctaaactctaatcaatcatcttttgtatttagagtgtctgtcacaagacagtatgcctaggaacgctaaacttaccctaggagtttctgtctgcgtacaagatgaatatactggatttgactgatgtttgcatataatcttttaaagccaggttattattaaaatgatcctatcatttataaagtatgtacaaagtgtccatgctattgtatttacttatacgaattggaaatgtaaaatgatttatattataacaatacaatattaaagccttattttaatctagtttgacattctgtataatgtgatgtggatattgatccttctggagtgcctctaaatgataatgtgctgaaacctctgaaaggaaattttttaataacaaacattttatatttgtaatatgaatataagtattccatacatgtatatacaaatatggactatatatatgtagattacacacgtgtgtttgtttatgaggtgtgtgtgtatatatatgtgagtgtgtgtttgtgtgtgtgtgtgtatatatatatatcttacagagtaaccatctaattagagaaagaatttaatcttcagatgccatgccttacagaaagagatgcacagtagagttactctcaaactattgtgaaatgatacatcaacgtatatcttatgtttcaaaaataggaactggggagaaggttggggtttcatgccttctgacagagcgcttgtctttgtggataaccatgacaatcaacgaggacatggcgctggaggagcctctatacttaccttctgggatgctaggtaaaaaaccaagttctctatttttttaacacctcttttaatgatggtatgaatattgtgatattctatgataatataattatgtaactttcaggctgtacaaaatggcagttggatttatgcttgctcatccttatggatttacacgagtaatgtcaagctaccgttggccaagatattttgaaaatggaaaagtaagttttggagttgttcaaaatatccttttctcaagaaaaaagaggcaatcttctcctaatttaatatgacaactattaagtgtttatttattcaacaaatatttaattattgtaaacctgatacaggattgtgatttagtaatgcaggttatattaaaggaataaactttatattctccattgaaaaagaatagcaagctttttcagagatatgacaaacatccccctagcccgcagggaaaataaaaataaaaattaaaaaaaccacttaaaaataagagctaggcacagggattaaaatatatacttcgtaccttcctcaggtttaattggaagaatatagatgccaacccttgtagagaacttaaaacatcatctgcccgtagtgagaacaatataaatgtcttttaaatactgttaaaaagttatatggaatagaaacaaatgatccagttcagctgagttaaatagggaaagtatactataagaggaaggaaattgtatgtactaaaggatagaaatttatagagagtattccaagaaaggtaagaatgagaaaaatatttgggagtatggtaaagacatcactctgctgagtagtttcaaaaaggaacagagaaataagagtgtaaagatatttggaaagctagtagaaggttttcttttaaactaaagggttgagaaacagcatcagagacttcagaactaaagcagaaattcctccttcctatgagtcacacagatatctagctagctttttttagattcctttcagtttgagaagtccgctactatgtataacaactgattctattgttaaacagctttaatatttagaaggtgtacttttatattgagacaacttcttataatttctactaattggtcttatttctgttgttaggagtcagagagttcttttattttttctattactataacattcccactttgacaggactgctgcatgctataaactcttaagttttgttcacttttcaccatatgacgtgattttaaggtgaacactgataaacttcctagggttactctgtgttttttaatgaagatttcttaaagtgccaatcagaaaagcataatactaaaaatatggtcaatttataaaaaaaaaatgttcagatgtagtattttgtacatttatctaaaaagaagcatgacggcctccaatatttatttagcatatgtcatgttcaaggcattttcacatatattacttaatttttatagcaaaagaactcattattctcattttacaaatgaggaaactgagacacagagaaattatttatattgattaaattttctcagctactagtaatagagcctatgttttaatcctggtgtttctagtactaatgcccttcccatttcaatgccattgcatggcttacagtgatgttaagaagcccttgcaggccaggtgcagtggctcacacctataatcccagcactgtgtgcggccagctgagaaggtcagctgacctgaggagttcaagacctatctgggcaagctagcaagaccttgcctctactgaaaattaaaaaaaaaaaaaaattagctgggtgcggtggtgcacaccaacagtcttagctacttgggaggctgagatgggaggttcgcttgagcctcggagatcaaggctgcagtgagctacgatcatgccactgtactccagcctgggtgacagagcaaagaagtctttgcagtgccttggaatgaaaaggagaggataacaatttgctacctttgtttgaaatatggcaaaagagaaccagaggatagagagatgatgaagacccagtaaagggctataaaaatcaatgaaggcattggattctagataaagtcactgaatgcagagacacaagtaacaggataggttgggtttggtttaaaggagaaggaagagataaatatatatatgctaaaatttggcttttcctcctgtaattaaggatgttaatgattgggttgggccaccaaatgataatggagtaactaaagaagttactattaatccagacactacttgtggcaatgactgggtctgtgaacatcgatggcgccaaataaggtgagaatatgtatttagacatgtcctctaatagtaaatttccgtagcactttatttaaaacagttgaagtttaagaatatcaacgttttatatggtattgtgtttttaggaacatggttaatttccgcaatgtagtggatggccagccttttacaaactggtatgataatgggagcaaccaagtggcttttgggagaggaaacagaggattcattgttttcaacaatgatgactggtaagtaaatatcaattaaaaataatattttgtaccagtatgttcttggtttattcttttttttttctgttcattgacatttatcatatctgaaaaatcatgtagtcagtggagcgagaagacaatagagatcaaaattgggtagaagcaaaaggatgatggctgttactccttcgttctcctgttttcataagtgctttctgttgtaagcagaatcctttctgtgcacccttgcaatatcttatgcatatatagaatgcacattcatatgcttacctacacatgccacaaaatacacaaagtaattaatagaaggattgtgaaatcattaaaagaacgtttcttatagtcctgctcttttaatcatggaaaaatgctgcctcagtactaaaatatctttatttctctttttctcaatgacagctctacctagttttttggtatactttcttcacttctctgtctccttgtgacaaataacatttttaaagcatatggataaataatatgtatcttgtggttaatgatttgcttcaggagacttgagttttagttctgaaacttctcattattggcctttcatctgtgatttttgtatcctttggctgtagtataaatgattcccgaaactgtagctgagaagacctccttgcaaacagttgaattgtctctgtccaaggccaactgacactcatacttagctcactctagtataaattatacttcacttatgaaaaataaataaatacaaaaatatataagtcaagttgatctctttcctgccaaaaaaatgcgtgtctatttccttagtttccttcttttgtggatgaaaataccaaaaaaatcttttgtgaaaaagctttatatttcaaactatcacttcctcatacaaatgctagactgtttttatgtacaccctaaattctttttgacctcatgtagaataaaagaaggttaaaaaaataataccctttaaatttttaaagtaattggcattaagttcagttgagaaaaaatttgattttaccaaggtagcactttatcaaaatgtgaccgctcccgccaatcttcggtgatattcttcaactttgatttttcggttatattttcactactgaaaaggaaattggtaggttttctgtaaggttacttttggtcctagaaagctgtttacacctactagggaggcatatgggttttcttcttaatgagacttcactgcttagggttctaaaacataaagttatgctgtttatttgtgttagtctgtattcttgatttcattgttttgaagttaaatctgaaattttattttacaggacattttctttaactttgcaaactggtcttcctgctggcacatactgtgatgtcatttctggagataaaattaatggcaactgcacaggcattaaaatctacgtttctgatgatggcaaagctcatttttctattagtaactctgctgaagatccatttattgcaattcatgctgaatctaaattgtaaaatttaaaattaaatgcaaatccgcaaagc

SEQ ID NO: 561 - DNA, 58218 bp, Homo sapiens
  misc_feature (2675)..(52674): n is a, c, g, or t
tggtttccagaatccttagcgcgaggcggaaaaaatatttctcccagcttgtgttgatgccgcgattttgactgagacttcttcccacgatttctgtttttgcttctccaaggaaaatggcagctcccgagcagccgcttgcgatatcaaggggatgcacgagctcctcctcgctttccccgcctcggggcgaccgaacccttctggtcaggcacctgccggctgagcttactgctgaggagaaagaggacttgctgaagtacttcggggctcagtctgtgcgggtcctgtcagataaggggcgactggtaagggcgcgcccctccggagtctcccgggaaggcatttgggaagtgaccggggagggggagcgctgacaagagtaaaatggaaacgagtggggaagatggacttgtgtgatgagagctcccccatcctacctcttttttatcaaaatatctgctctgcgaagtggagttttaatcggctcgagtctggattagtcatagcactgcagaaaagggcaagtgagaacgacaaagcagaagaatggaaattagcttagttatattgagttttcggatccatcctgagagcctcacaacttttttgaatttggggttatttctcctggactcaagagtattcttacaaatgtgcatcaagggattttttaaagtcctacttcatttataagccaatgttaaatcgttcattaaaatagaggagaagctacattggtgacttgcgtaaattaaatgcagaatttcaactagaaaaagaggcttttcataaaaatttcccgatgacatcttttagggaacaattttttagggctgttaagagtacctgtgtaggaatttacacaattactttgttttgctttatatccaaagatattttagatttctcttcattaaaataggaatagcgatggtgcaagactcagtggttttaaagtttccctaggtgattttaatgttaatgtgcagcccaagttgagagttactgaattagaagaaagaccaattttgatcagtttaaatgtcacttatgcctgcaaattaaaaaaaaaaaattatatatggctcaatttaagtacatcaggtcatcgtgtatcagattagacaaaattagaatgtgcgatataattattaaagtaacttttaataagcattgaccagagctcttccttagcatagtgattcttttactgttgatttgtgtttcttttctgatggtttttaaaatccgtataatttatgtttaaaaatagacttctcccattgaacattattacaaagataaagcacaaaggaaatatgcaccttgaagaacgatttctctgttggtgaatgtttttaaactacgcattgttatgtatagaggaaagtttaaaatctttagatctgtcataaatgaaggaaataaatttttagttggttaaaagtgaccctctgtgtagaacaggtctttaaacttttggtcttttgaactatttgcatgtgtaaaacgtgtgtctttatatgatagaggttgcatagctttcatctcaagtctgactcaaaaagtattgaaaaccactggactgaaattagtaatcagttaaatggtcttgagttttcatcctttcccgtgattttattaacatgtcacattactccactggtaaaaagtcagatttctttgtgagaaactgaaattatattggaagtaatttgtaccttaactctgtttcagaaacatacagcttttgccacattccctaatgaaaaagcagctataaaggtatgactttttcttgacgattaaagttgtcaacaggatcctcttatacaatcttggttcagataatgtttaactgtggtttttaagaagcaaaagcgtttgtattccaacagtttccccaacagactacatttgatttgtcagttggcagatcttgcccagtcctttagtagattatctataaagaaaaactaactgcgtatgtaattaaaataacaatttctaaatgatttagattgataaatatctctgtgactgttacaaggtaagatgtttcaagtgttaaaaggagaatatacatttctttataatgccagggaatcattcacaggaggtgatcttttagctagaagtctaatgattaattggattttttcagaaggaaacaagtggagatgggccttctgggcttgcagaacaccaaataaagctgtgagacattggaagttataagtggagcaggagctaagggttgagatggaaatggaacttgaaaaatagatttgagtctgggagagaggtattgagtttggtttagtaggtggacacttgatacttttgagctggctcataatatgatcaggcctgttaaagatatctggtatagttcatatcatggattggatgtgcagaattattagaggtaggagaccaaatggaaggctgttataatggccaaggcaagaataactatctgaagaagacagtaagaagacaaagggggaagtaaatatatattcaatagagattgagtttgtaggttttataatataggggttgagagagaatagttcaggatatttagattgaggattgagttatttgggttgttatattagctgacatgaggatccagaggatgtttgcaaaggcataggatgaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatcactatattaggaatttaaaaatttggtttgtgtttctgactttagatcttagctatctgctttgaagagtcactcactgtctctggacatcacctgtaaaattatggttttaattagataatcattgaggttcctttctactccgaagttctgtaattgcttataataatataatgaactctaggccaggtgtggtggttcatgcctgtaatcctagcacattgggaggccgaagcgggggggatcacttgaggtcaggagttcaagaccagcctggcctatatagtgaaaccccatctctactaaaaatacaaaaattagccaagcatggcggtagacggctgtaatcccagctacccggggggctgaggcaggagaatcgcttaaacccaggaggtggaggttgcactgagccaagatcacgccactgcactccagcctgggcaaccaagcaggactctgtctcaaaaataataataatcataataataataatataatgaattctataattgcttataactggctgttaatcctttctatttttccattcttggttatgtagtagtagttgtttttttaatcacttgagcagatagtgccagattgtaaggaacttaaaaaattgagataaatagtaatttaagaagtttgcagccagtgcggtggtccacgcctgtaatcccagcactttgggaggccgaggcgggcagatcacgaggtcacgaggtcaggagatcgagaccatcctgactaacacggtgaaaccccatctctactaaaaatacaaaaaattagccaggcgtggtggcggacacctggagccccagctacttgggaagctgaggtaggagaatggcgtgaacctgggagatggagcttgcagtgagcggagatcatgccactgcactccagcctgggtgacagagtgagactctgtctcaaaaaaaaaaaaaaaaaaaagaagtttggttttctagttgctaatagtataatttttaaatcacatacttttatgatagttgagaatagttaaaagtatatcttaaacaaatactacctacttgtagaatcaattttagtgcagaacatgaaatatatttttagaaaactgaataattgacgtgcctatcaaatagtgtagtcacttttatttgaaatagcaaaatgttagattattcaacacattttcattcacattgaaactgacattctttgaatcaaaactgtttcttccttctaggtttgatatacgtttgatgaaagaaggtcgtatgaaaggacaagctttcattggacttcctaatgaaaaagcagcagcaaaagccttaaaggaagctaatggatatgtgctttttggaaaacccatggtggttgtatcctttaaatccatctatttcaaaactatataatttttagaaggatataactgaaattaattttcatgttaccctttagaaatttccacaattggcattctagcagtagatattcattcgttacaattaaacccaccttactgagtcagatgacagtgttatttagatttttaataaaagagcttcagcagcatgaggttgttcaatttcagccaagtttaaatgtttcacttatgcagctcaaaagtacataggcatgctaagagactagagtatccagaagtacatttggagtcataaaagaactaattcattttatcattttattgtaatttatatttctacatgagaattttaataactagagtatatcattgattaaccatcttgcttttagtagtcaatgcagtttgcaaactagaaatcagcaagataggtaaagaagcaaaggcccaggtataaaaaataatgactgtaaaggaaaagttaattattaatttcctctcaagtcatgaagagaggcaggaggcactcaaggtaaattaaaaaaccatactcccaccatacactagaaagtttttgagaattatttagaaaagattacttgcatattcatgaaggaaaccttaattttaaattattagcagtttgctcgatctgctagaccaaaacaagatcctaaggaaggaaaaagaaagtgttaaaaattaataaaggtaagtgtgaataaaacataataaaaagacaagactaattcttgagataaaattaagaataaaagtttgacaaggtagtaattcaggtatctctttttttttttttttgaggaaatacctatctgtgcagttaagtcccattaaacgtcaaaactataactacagattaaaacccatttatatgtgaaaattaagtttggagaatgaatcttataaggggagtgtgcctgttactctttttttaactttttctgcctatagtaaagcaatggttcttaaaccctaatatgtatcatatcacttggagagcctaataaaacacagattcgtaggttccttccttccctgaaagagttgatttggtaggtctgatgtggggacctagggaaactgtttataccagttttccttttaatgaggggatttccaggatgctggacatttagtgctgaaatggggaatgtgtctggtaagccaagacaggtcggtcacccttgttggcacctgaaaatttgcgagattaatgaggtttcaggtaatgatgaggcatcttatccagagaccacagcttgaaaactcctggaataaacacttacagatacattttctaactcttaaaattaacctaaagtaaatgttaaaataaaagttaaaaaaaaaagtcaaactgtcattaaaaataattctggctgagcacggtggctcacccctgtaatctcagcaatttgggaagtggaggtgggcggatcacaaggtccagagatcaagaccatcctggccaacatggtgaaaccgactctctactaaaaatacaaaaattagctgggtgtggtggcgcctacctgtagtcccagctacgtgggcggctgaggcaggagaatcgcctgaacctgcgaggtggaggttgcagtgagccgagatcaagatcacgccactgcactccacactggcaacagagcaagactccatctcaaaaaaaaaaaaaatctacagtgctgagtatataaaattattaacacatttcacaacaatatgtgtttgtggagttaaatattttttgtctttaaaacaggtaattttagtgcatacttaatttgatgattaaatatggtagaattaagcattttaaatgttaatgtttgttacattgttcaagaaataagtagaaatatattcctttgttttttatttaaatttttgttcctctgtaaactaaaagaacacgaagtaattggtcacaattactggtgtttaactgccaaatatgggtaaataagggaaaattttgtttaatatttagtccttctgagatggcttgaatatttgaattttgttgtacgtctatactgggtagtcacaagtcttataaacactttagaggaaagatggatttcagtctgtatttttaaacatcatttattttaaatctggtgctgaaaaataagaaaaaaattaaactgcattctgctgttcttctttagaagcattcctgcgtaaatactgctgtaatactgtcatgcaaagtgtatcctttcttgtcgtatcctttttggggcagtgtttttttgtttttttcctagaaatgtttgtccttcccccacctgttgatccaggttaaggaatacttttttacactttattcaaatgaaatatttctaaaattatttgtatagactgaacagatcttttatgtgtttttagatttgttgttgaattttctgtgctgtcctttatataattttttgagggaaagttagtgaatcaggtcaacttacttagagaatgtgttcatttactttaacccagaatacagtcttgtttcttctatttgtatgtttcctaaacctaattcaataacatatgctttctgttgtgtaatatatctggtttaggtatttataatgtgtttaaaatttgggcaaaggaaatgtttttcttttaaaaagtacttacattgaaaattaagatgtctggattactatgtaaattctagagagtagcagacctctcatctgaagtcttagtgaatctcttttgacatagatagcaatagaagtatctttcttctttcccctttctttttctaaacaagagaagaaaagcgtaatagaggggagaacacataatgcccactaagggtagtgcattaaggaaaaacagtcttggcaggtatataggaatagtggtttccagactggttgatgaccgtaatcaccaagaacagtggttctcagtcttggctgcacattgcagtgatctggaacttaaatactaattttaaaagggtgcagtggctcatacctgtaatcccagcactttgcaagtccgagatgggagaatcacttgagcccaggagtttgagaccagcctgggcaatgtagggagaccctgtccctacaaaaaatacaaaaattagccaagtgtggtggcttgcacctctggtctcagctacttgggatgctaaggcaggaggattacttgagccccagaggttgaggttgcagtgaaccatgatcacaccactgcattctagcctgggtgacagagtgagaccctctccctcctaaaaaaatccttaagaaatatattgatgcttggttcctttggtcagaattttgatttaaggtgttgggagtgtagcacagatgttggaataaacctctcaaactgattttaatatacaaacaaggtcgagaaccaccaaggaagagtttttatgcataaagattcctgtactctaccctagaactaatacatctgaatctctgggaatggagtataacaatcagatttgaaaaggtttctttagtaattttaaggactgaccagtttagacactgctttgttagagtaaaatgattaggtacctagtatcaacctagccatccaaccttatattaataactaggaaaataaagggttggagcctctgtgtttctttgttgaaaaatctgctactattattagatctgtgaaaacaattgaaaattcggttattatcaccttaaaagtacaaaacctatagattttgaaaatgtaattatttttctgtaggcatagttaaaaagattttgtaaatgttataaatcagtttctttataagcggtttatttagataaattttgttatactgacatgattcactaattttctaaatataaatggttcagctcttagttatttttaaactaatgacctgtgttatacttcctatttttaatgggcttttatgatgttttaggtttttttgaatcccgtgtccttcaagtgctttctaactttgagaggaagaaattgaccacctggactatggaactgtgcgtaacagctttgaaagtgtatttaaaaattaaatctatatgcctttaaatcagtgaattggaaacatattacatgtattttaatgattttcctcaaatataataaattgtttcctttccaataa
